United States Patent 6,812,339 (POLYMORPHISMS IN KNOWN GENES ASSOCIATED WITH HUMAN DISEASE, METHODS OF DETECTION AND USES THEREOF) - sequence listing, part 42

SEQ ID NO: 14164 - DNA, 18773 bp, Human
taatttagttcttttcaaagaagaaattatagactagcttattttaataacccagtccaaattataaaaagaaaagctttaccagcctaatctctggtatagagaatgttctctttttttagttgacattggggggagaaaagcttgactttgaagttcagcaagtctggtttcaaccccagccacaactgggtgaactttgtcaaattacttaaacagtcttatccttgggtttttatttgtaactataaaatttgagtgatgttaatgataagtaccacagagtattgtactttgaatgaaaggtcttaattgtcaaatgaacaactgaattattttataggaagagttcaactttaataaatactcctgcagaatttcatcattatgatgttaaaattgatggaagctttattttttaaactgagaaactaatgcttacgtggcctagtttaagaatgaatgctccaacttaatacatgttttaaaaagatgttttgggataccaaatgtaaaagaattccgagtttgtgttattttattgaacaaacctattcagcacttggggaatcgcaggcagcattgcagactcgctggctcctggctgtgatctcacacccaaactgcaataatatcctgataaaacggacttccacaagtaggtcaagaataataatgtgcagacctaattcctctaatttacggcgaacatctcatggtcaatctccccgcggtcaaaggactgtgtatctcttcctctcagagccactccacaggctgaaaggctgactaaacccctgacagataagagattcaagagtagtcccagcccccatggggagcaaagacgctggctcaaaaaacgtactgataactctcccttttgcagctactcctttctgaaccttccacaagcagtggcagttggattctgtgattagtctagtcttcagagccagccttcttgagttcaaattctgacttcaccccttaatgtgaagtgacatgggcaagttgcttaatctctctgtgcctcagtgtccttgtctgtaaaatgggcatcataataatagcgcctgccacattgggtgagtgtgagaatgaaggaattaatacatgtaaatcacttagactgtgtctggcatagaggacattctaaagaaaagttagctattatcattatattattatatgggtctggaattagttcctgaatccttctgagatgtgatgacttataaacgtaggttgagtttactcatgatagggtcatcgcaactatgcatagctaaaatcaaattttgcttttcaagtttgttttacctggagccctagagttcagggttatggtttcctttgtcactccccttgagggaagcttcttagtcacactctccttctctttctctgcactctatgcactctagaaaagctcctttttttttttcttcatccaggcagagaggcctactgggacttaaatccaaggagctgaaatctgttttgggatggggtggagtcacattctggaacctagacagagaatttctaagttccagaaagtgctgcttacttcgcatttcctctcccccacctttgcttttgaaactcctggcaccaatgctgccaaggctggcggagctttcctgagtggtgtctgccaaatgaggagtcaaggaatatctggaaaggcagcctccaggtccccgatgtcaagaccatttagaactgaaagtgtcccaatatcggggtacaggcaataagcattagttattaatcagcctgagaagttgattctaaaataggaggaaatgattcaattatttcctctcaagggattactcaatgttgtttttatgtttaaatatttatttgtcaacatcaagaattcttagtacatgatgcaccagcatttttgaacaagtcatagatttggccacaaatcaaatttcaggatgggaggagtgtctcccctttaaaatagaagagagtgagtagtctatgaggagggacctacaaagactggaaactattcttagctccgtcactgactccaagttcatcccctctgtctttcagtttgggtaagcatcaattacttatctaaaatttgtaataagaaaagtcttcataattcatgattgtgtttatctttatgttagtaaatttctatgttggttctattcttccccttatattttaagaaaagaagtaagaaagtaaatgattatttttctgaaagaaaaaattaatgtatttattattattcatagaccttcaactactcttagaaagcctttggtgactcctgggaacaagctgagtcaggaacaaaagtttgagggtttggggttgagaataggacaattacttggctaatgctttagtctagttctgattttgctactccttagttgctttgtgatgactacttgcacatgtgtctgtttgtgagttatttttgtgagcatgctgctaccagcctgtgtggatgtctgtggtttcacatgatacattttattttctaaagtctactgaattttatggtttttttttcaaaaatagaaactcatattctttccttcttaatttagtttctttcaggacattctcatgagactggtgaaatataactgcgaagtagcatgataactgtgaaatagcatgatcattgtgaaagctatatgacccaaaacttccataggaataagtgcaatgcttgcatatctgaaacctgctgttacatctctttgcacttaataaatatgtgttgactgattcattctcctgggtggtgctgagaaagtaaaaatcatggctgataaaaattctgtttatggttttgtctaacttatttttcagttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaagtattgccttctaagtataatttaaatttttataaattaaataatttcaagaacatttaccttgttttaagcagtttgcttccagttgttccagttgaattgtaaactgaaaaatatattgcttttgtacaatcatttttcattacaaatctatcagaagaaattctttgtaatgaatatatcatcagtttggctttgcatattcaaatgcagcagaatttaatgtggtgcctgcacatgggaagtgttgtggatgtttattgactgacacacagtttgtttagatagataaggctgcttttccattggataactgtgggggatttagctccaaattaattcattaacatttcataagagatcttaacagttacttattctttcccaaggtatcacagtatatgaccggcttctaaatttaatcctagaagaaaatattgagagtataagaattatgatcttttcatttgatcatttcaggattgtctttatatcttttatttgcaggtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaaggtattatgcagaaggctcccatcttctttcaccctgctcccctttcttcagtggttgattgcctgagctgcccttgctttcattccttccctagtcctttctggaacagttaaatttataaaatgatttgaataaaagtgatttggataaacttctaggaatactatcaggttgaggtctagctcattctgagctatttggatttacagttgcagggattgatttgtagctgacttagagaaaaacctagctttcctagtgaccaagataactgagagcaattgcttacttttggctggaattaagaacaaactagcacagaaaatagtaatctggatgttttccatctcagggggcctctagtaggtgaaaaggggcttctaaccttcaagttaagccacagaaggctgatgagattgtgtgcctaaaaattaattacttttgttcacaaattgttaaatgttttgattttgtggctgtatttggcacacacaaaatgtcaaatgaattaaatcaaaaagcaggatgtattagttaagggcctaggtctgagactagacaagtgtcaaattcatgctctgccactagttaactgtgcgatgccagcaagttacttctctgcccttcagtttccttctctgtaaaatgcatataatgtaataatatatttcatctcaaagcattattgtgaaaataaactaaggtaatgtgtgaaaagtgctcatcatcatcactggtacagagtaaactctgaataaatagtaattatctttattacactgggattacagcattacagcagatgtagtgtatgaataaatggtgaagaagtcattgttagggctactatgggggctatgtttttagctcaagtgtaacaaaaaagtatttaaactctagattttaatgtttatttttaaataataaaataaccattatgtatattgatggtttttaagaagaaaagcaatattaagtaaaggctgaatttagattaagttatttcacaatgctaagtgactcttttaattgtctgacttattttaacagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaaggtaagaagaaatttggaaggaaatagatgaaaattacacaattaaaatagacacaagtggccgggcacagtggctcatgcctgtaatcctagcactttgggaggccaaggcaggcagatcacttgaggccaggagtttgagaccagcctggccaacatgaggaaaccccatctctactaaaaatataaaaatcagctgggtgtggtggcacacacctgtaatcccagcagcttgggaggctgaggtatgaaaatcacttgaacctagaaggcagaggttacagcgagcccagattgcaccactcactccagcctaggcaacaaacattctgtcaacagataaataaataaaagtgaagaattactgagaaggaaatggaatttcttatttcagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaagggtgagctactgacattaatgagatagaatactacgtgaaagaagtcgaagtgggaacagcggtgcccttctggttgggtttcttgcacttctccctcctccctttacttcctcctgctccatcttatcttatacattctgaactatgacgcaaagaggttttctgaacacactatcaagatttaagaaatttcagggggaaattacattactaattcaaagccacatctgttctttattctttttttgtgacttaattttccaaagataaagcaatctgaatgctaacttaacttactttttttgaatggcaatacaactatttggagagcaaaaccagctttttttttttttttctagtttggtgtcagagtttctgcaaattaaaaaagagcttaatctttagtaatactcattggattcaaagtttaatgagaggctttgtgatggtatactatggtgtacataaatgttgtcgagtggtttttaatctttgtttgcaatactttcaacatcatcaatggccttgagtaagtcacttcattctaaaaatgtgttttccaagttattttaaattttataaaagcttatttaagggaaagatttcacaatcatagcttatcaatctacaaaggattggggtctccttagcacaagtcgatctacagacgtagatgtaatagcccctttacgtatgacagttttttcagggcaaagcaatattggagacaaatttttggagtttttcaatactccaccgctgtaaaataagcatcaccagaccacattcctatcagtgcctctttctgtttaatatcaacccttacagtggtccttaatcacactgtcattaaataaatgagcatgaagggatggaggattgcagcagtgctccataagcactgcccgtctttcagccttagtggtcacaggagtcagaattccgtacggggaagatttcactgaggatgggccaccctagtggagaactgcgagcaaatctgtggactcatccatttattattttcatgggtcttttgaaatcttctctgtagtcttattcttattctgtagaagagtagttttctaacaactactaggtcatgtaattagttttatgggttggatctgcatttgtttaagtgatatcagagaataatgatattaaagagcatcataggtaataaaagaaagttttatttaagtgcctttctgtttcgtgtgtgtgtgtgtgtgtgtgtgtgtgtgtgtttgtcattatgggttattgtcagaagaacttgaaaaacattgctatgaaatagaatagaaacatgaaaatacaagctttatattgactagcattcaatgctctcctaatatttatatttctttttgtctttaagatgagcaaggcttttctctgtttccagtaatcggagcccctgcacaaaatgaaataaaggaagtggaaattggtaagaaaatttatcagaatgctgtaaatattgcctggaaaaatccttccatatgacccctgttctgaattcccttagcaggggtcaggcaattagcataaggaaccttgaggagtaagtgaggtgacatccctgaaagcacctgccccaagcatttgctaatattgggaacagggacacagcaattgcagtgtttacatttgtttattgtactttgtaattcatgatgctttcatgtatgcatctaatttcatcttcatctctatcccagagcttgggatggagacctgcagggtgttcattctgggcaatggtagccagatccagtaaaacatgtttatcttcaaagtagcttatggagagatgaagagagttctgtagaaagatgtggaagagggcagttggaaagaaactctaatttctagtagagggcaatccttttactagaaatcctttgtaatgtggggttggtgaaggcagaatcattggccttgttagtttcccatgcagatgagaatatagtgggagctgagcttcaaacccagctgggtgaatgaaggtaatggaagcagggaggaggcaagagaggacatagaaagaggaaggtgctagagatgagggagggaggtcctggtggggtgcatactaagtgttcagtaaggttttttttttacattaaatgggataaaatgccagtcgcagaagttaattttattggtgaatgtccttactcccctctaggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaaggtatttttatattgaagagaaccatcctcttccccttgcacatggtttgcacctgcaaagtaggcattaaaagtaacaggttgctttcttagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactgaacgtgttcttttgtgctcttttataacttgcattacatgttgtaagcatggtccgttctatacctttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacggctctgcaggctgtatgggaagcatggcggcatctgcttctggggacacctcaggagctttactcatggcagaaggcaaagcaaaggcaggcacttcaaacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcatcgttaaactttgtaaagtatttaaggtacatggaacacacgggaagtctggtagctcagcccatttctttattgcatctgttattcaccatgtaattcaggtaccacgtattccagggagcctttcttggccctcagtttgcagtatacacactttccaagtactcttgtagcatcctgtttgtatcatagcactggtcacattgccttacctaaatctgtttgacagtctgctcaacacgactgcaagctccatgagggcagggacatcatctcttccatctttgggtccttagtgcaatacctggcagctagccagtgctcagctaaatatttgttgactgaataaatgaatgcacaaccaaattattgataccaaatgttttttttgtgtacatttctacttctctagctataagtcttaattatacaacaaaatactatttttatatttatgtttggtaaattcaataactttcctcatcatttggaaagtcaaattgtttattgcttccctacagttttttctgaatctagcaggattttaacgatatcattataatttgacacaataaaaggacaacatgaaactgatgaatctttattgggttaatttcagacactatataatcttttaaaaatgtaacattcttttttatatataaataattggtggcatcacaaatagccaaagcagggtggagagagtgatccttcctgggtgcaggcaagaaggggatatgttttctacagagttttcaaaacagtgataaagctgtctacaagtcattgtgctttttatcatcactatgcccagacaatgtgaaacatcagagatgaagtgctcttcccacagaggtggactgatccttctccccactcccttggtgtgtctctgaatgcaatgttgtcttggaaaacagctttccaagcatttcactcctgagcacttgccagtttcctcacttgttcttcacatatccaggcaaagacatcctgtttgctatatgaagcattgtatcccgtataaaaggaaggaaagagagaaatatatttttacactcatcactcctcaggggctgtacaatcatgtagaaattgtttaatgtgcctgtcaaatagccaaagagtgttaaaccctgagttcccacccatgtgtgtggtatggttaggattcatccagatacacagagagaggcacaacaggaggagaaaggataggggtgtggggacagcgggcccccaatatggtgtaatcgtggcaggtctctgcctgaagtgctatgtggggtttttcttgttttaattttgactttaacccctgatttgtaagtttttcataaaataaacagaatcataactcatgtagatggctataagtgccgtagtgttctgtgggtctctggtgtctgccagtgataagtgtggcaccccaggaaggctgtggaccccatcaaggtgctatgtgagggccatgcttggggtggtggtgggcccagtagaccctgcagccatccatccagcctgcccactcacactgcccttgtgtactcctgctttgctacgttatcattgatcaatgtccctggttacctatgtgtttgaattatcttcgtgttacaggtgtttaatgattttgctccttctagcttatttgtatttcacctgtttttctttaaatcaacatggttacactctgtttcagcaactgtataaattaaacacaaattattactactgctattgagttgtcatgatgaattcttttttatttctgaaattatagcatttcttgaatttaagagaacaaaaacttgaaaggcctatgtctccattttattaactattactaaatacatatttgatgctcataataataatacacatttattcattatttcctatgtacaaggactcatctgcttattttacatttaactttctcatttattttctcaatacttcaaagtaaaagacaaagaaagttgaataacttgcgaaatactacagttatggagcaaggattcaaacacagccagcattttcctagctatatgtgtatacagaaagtaatgttttgtcatcacatacctgaattacttatacttttataaaataattcacacttacgaagacttcctctgatgtcttggatcaacttctttcctctacttggaagcgtccagccaatggcatggttacttcccagcaatccccacaggaagtacacattcctctgtgcatccagctggggtttttagagagagagtgacctggaaaggaatcctgttgaaatgatttacttacggagttttcattatttaacctgatgacagtaagctctttgtcaattttcactttttccccccaattttgtgtcacatcaccttgataattcttgattccatactgctggtcattgagagaactgataaactattagaggttgtggaggaattcgtgaatatgggccagtgatttttctaccttaaaactgggagcccatgcatggagacttaagacggaaaagaaccgtatcagcaaatctcatttgagattcttctcacattcatcagtgcatatgcatgttgcatctacattttgtgaagcaaggagtactaggaaaaatttctgggttggttgagtaatgttcaccatgagagaagtatgggctatgagtaggacctagaacttagtaatttgacttttgaattctttatcaaagacgctttagccacttaggtgactcttgcttcttctcctacctcccacactgctaagcccttagaggcaacaagtgtctcagacccgttgatgccttctccttaatgccctgacagcaccttgtccgttcctttctcattattgcatgagttacaaccctctgcatcttgcaacccaagtaccacactccattcttctctgagtgcccatagtttctttccacagaaacaaactttctgctaccatcagattaatctcttgggaaaaccactcaagtctccagtgctcctgtgaccttcagaataaggcaatctgccttagttggggtttcaagtctggacagaacctggccctgaccaaactttctaatcatatcttccaccaattccccaaactgggttattccatttcctcagaaaacacacttcctctctgcacttaggcttatggtattctctctgcccaggtgggcatttccttttttgcatctccctgaatcctactcatctttcagaggcctcctcctcctccaggaaggctccctttcccagtcctgcatggagcaagctctccttctaaactcctctgccagcaaaaatcatgcttttgcctcccatcttagttaagttgacaagtgtctctctgcctcttttgcctttgagaatgccctataatgcttagcctgatgtgttgtagaggctcaataaatgtgactgtcctggtacttaaagcagccatgaaaattcccagtgggtatatcttatgtgaaattcttgtactcccaagggaagccaacatccatgtatcagtttattatatcttgtttcagtagtaataataatctttttctttcttttgaatagttgatcatcatagcatctactgcataattgcagtatgtagtgtatttttaatgctaatcaatgtcctggttatcatcctaaaaatgttctggattgaggccactctgctctggagagacatagctaaaccttacaagactaggaatggtaagtggcaaataccaagtttttctcccaaagaaaaagtcccataataactgttggttacctgtctattaatctttcagtagctaggctgctaagcccagattccattttgcttgctaatctgttatcagtgagttgtgtttttggattttcttaaaggccattttccatcctgctatgtaaatcctcatggtcctgagatccatctcaacagctcacttttcttccccgataggattgctattcctactgagttcccaataacagaatctgccccaagcccagaaaggtgtaaatttcataatgtatcggtaagacattatgaagttaaacacagtagcaaaattgttcctgttttccagatgtgagcaggttagaaaggtccatcggaatgcatgtgtgttctacctgaaaccctgatctgtaaagtctaacccaggcacacaagcatgtgcatgaaaggagtcagttctgcctgctagatgcaaacttcatgcttacatttggaggcagatacatgttgcatttttcaaacagttgactgaagtaggagctcattgtttgatctgtggaaaattcagatcccttaaaaaattctatgcccttgctactattagctttaaattttttcacttccccaggggagtatggggaaaccaaagatgaaaccaaagtctattcagcacagaaggcccccttagtcatagattattaatcaaaattgatgagatggacaggttcttgtccacttttttgttatttagtctgtgacagtaaaaaggagaaacactttgggatgaagactgttatttcctgatagtgttttgtggcagtggtttgccgtcaacatctcttgagtctagaatattttggaggatgacatacattcaccaacagccataaaacttggagaggaatgtcttcaaagagtccagtgagaatttttagaatcaagtaagaagttgtacttcttgttttcattttcagatggaaagctctatgatgcttatgttgtctacccacggaactacaaatccagtacagatggggccagtcgtgtagagcactttgttcaccagattctgcctgatgttcttgaaaataaatgtggctataccttatgcatttatgggagagatatgctacctggagaaggtaaagctattgacatacattagggacagaaattcatgcttattaaaggctgtgaactaggtggccttatccctgcattggataatgaattgcatttactaccacaggccttaagaccagaactttaaatatttatccagaagcagacacttatccttcaatcgcccctctcccatcattgtcctggtgatgagatcttcacagtaatgttggtggtgtgaattcagagttagaagtcctttgcttcaaggacttagcaaaccatcatccctactttattcccttggtcccccaccaggataactctgccacttcttaattctgtccataagatttgaaagaggacttaaaaattgatgagttttgttctggtagccataggcactagctgaaataccttaaaagtactcagagagtcttcatgactttctttatgttggtgaaacatttgcaaatttatattctcaccagaacaaaaagaactatagcttctgttccttaatattcctacccaattttatatacttttgacagttttatcacaactcctgtgtttgcagtagttatttttcccttcccttcatacatttatgtccagtacctgtggaccctccttgtgaactcttctctaatttctcacagaccaggaagggtttggaatataactggggctcagctatcaagggcctaagcataataaagtaaatgttcagttttacattttaaactcattttactaagaagaggaattcacatgcctatagatgtaaaggtatgaacaacaggtgactttggtttaccctggaatatctgggaatgctaatagcctcaataacggctcaagagacttgtgaaagatacaatttaggagaatctaatgcatttcttctctcaaggctctcttcttcccccattttcccactggccacccatgcaggtagaagtaatgagtaatgctctcaaacactcttttcatattacaaatgtactcaagaacctgcagggactcctgttgtttgtgagctcaacaatgtgccacatctggccacaagctcttcacctcttctttttcagtctatccacctaagttctagttacacttctcctcagccaaacccagatgctagctctctcacactcaagcttgtgctgccttcaatgtgtgacaacatactaatctggaatggttttctacttccctctgtcaatgcatgtcctctgacctttcctcaaccaaaataaatgaaacccaacaacaccaaacttcactcttcacttaggaaagttcatgactgactaaggtactgtctatagtctcatgcaacttaccttgcatttgccccatcaaaatcctctctgcaccaccattccatccagtggccctgggtggctgatcatcatggaatccattgcacccttgtcctctgctccaggctgggtttggccaatgggaggcactggcaggaggtcagagggtggtcatgtacctgcctctccacgtggggcttctggagcagctgtgcttctccttctgggagcacctcttctcagctggcctgcctcatgcatctgcaatccctcagacacccgtctgtgagaatatcttggattgttttattcacggttgtgctttctcctgttgcagtgaggactgggtatttcatgttctttctgagtccacccagagctaattggaatcaccatggtgtctacgctgtataaatgccaaatgggaaaggggatctattgtcccttgagatttttctagtttggatcaaatcagtttctacaacagagattaatgggggtgaagtaaagtcaggacttactttcctagagactttggacaattttgaggggcaaagcttcctgagtttgtgatttttaatatgtgagttaaaattttaagccattgaaaaacatataagcaaatattctaagaagataatatgtattctaagaagaatgaaccagaattctaagtctctaatgcaacaatagactaaatatctttacattcccatttacttggaaggactctgttttagttaagactaagctacctgggaaataaaaagaggacattggggctgatattctcacaaatgaaaggaacacaaagaacaaaacgggttctatatccacacatacttccacttctctgagtaagtgacttgatgtcagagaatctcacaccagattataacaataagacttttaaatgttcaggatgtttatgtttaaagcattagactgataagaaatctgatctatttcttgtatgactagatgtagtcactgcagtggaaaccaacatacgaaagagcaggcggcacattttcatcctgacccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattctaaattctggaagcacgtgaggtaccaaatgcctgtgccaagcaaaattcccagaaaggcctctagtttgactcccttggctgcccagaagcaatagtgcctgctgtgatgtgcaaaggcatctgagtttgaagctttcctgacttctcctagctggcttatgcccctgcactgaagtgtgaggagcaggaatattaaagggattcaggcctcaggtttcatctggtaactttccttccatttccctgcttctgggtggatgcaaaatggccagaaatttttctcctcaatcctccaccatcctccagccaccattttcttcccttttcccttttgcttgcctgtcttcactgtggtgtgggatgttttcactactcttttttcctctctctctgtcttgctttgtttctcctcattcttgtcaataatctgaatagcaaactaatcattcgagagtagattttcacgtcacttgaagaacattctgattccctcaggcagaatgtcagttgtaaatcttgttcccaacatgccagattttctttattttctatatatatataatattttatatataatattatatataatattttatatataattttatatataaaatattatatataatattatatataatattttctatataaaatgtgtatataattatatataattatataaaatataatatagaatatctaataatgtataatatataacatataaaataatattatttaatatataatattttatatataatatttttatatataatataatatatattttatatataattattaattatataattaatatataatatatattttatacataattattaattatatataattaatatataatatatcttatacataattatcaattatatataattaatatataatatatattttatatataatataatatattttatatattatatattatatataatataatatgtattctatatattatattatataaaatatagtatataatatataatataatatataatatataatacaatatataatataatatataatataaaaatatataatataatatataatatataatataatatataaatgtataatatataatataatatataatgtataatatataatatataatgtataatatataatatatattatatattatatatatattatatgtaatatataatatataatatataatatataatatataatatataatatatattatattatatataatatataatatatataatatataatattatatataatatataatatatattatattatatatgatatatattttatatattatattatatatgatatatattttatatatatatgaaatttatatatactattatatataatattatatattttatatataatatatattatataatattatatatattatacattacatatatattatatataatattatatattttatatacaatatgatatataatataatttatatattatatatatttatatataattattatataaattatataaatataaattatatatttatatataattattatataaatcattatataattattataattataatatataatataatataatattatatataatatatagtattctatataaataatataacatatattttatatagaatattatatataatatcatatatattttatatagaatattatatataatataatatatattttatatagaatattttatatatataatattatatatatgtatttgagacagagtctcctatgaacatacttgtggacttatgattttattttgacacttaagagtggtcatagggtaggtgcatatttaactttcagagaaacttatacattgtttcgcaaactaattgtactactttacattcccaccagttgtgtatgagagctctgctgcttcattgcctcaccaataattggtgttgtcaagtttctttatattttaacaattttcacaggtgttagatgaagatcaccatggtcttaacttgaagttccccgactcatgatgatgagcccttttcatgttttcattggccattcgtatatattttttagtgaaggcaaaatattttgccttatttaaattgtatttctttttatattgttgatgtgtaggaa

SEQ ID NO: 14165 - DNA, 20084 bp, Human
aaaaatagtaaagacagagtaacttctcttaaatgtttcaaaacaaaataattaagatgaatctcagtaaacaaccatgaaattcagtgaggtatttcctttattttttaatggttacagactcagggtctgtcatggaaatagctgcatagttttgactctgccaaatcactcactgaaattacatcacaggagggctgccagtgccctgtgggggctctgaatagcatctacccctttggccatttgggacctgcctgctgagctgtgaagtggcaggttttttccagcgtacagactcttcctaattatatagcatcatgacaatttgtccagcctaattaggggaggttatccaaccctgattgaggacactcaataaacaataatggaaaagacagctttaattgtcctgaggcttgaaatttctcccatggaaaatatcaggggcagtggctagattactggatttctaagaaaagggtaattctctataccagggaagggagtaaatcttgaaagcagccatgaaaataaacatcaaaaacctcccagccctcaaatgttatttggtctctttccctccagaagacattcaggtagtaaagggaatgaaatcaacactccttagttgcctgatacaaatactaagtcattccaatcaggaagatagttgtaattaagactactacactagttgacttccaggtgatggtggtgtatttgtttctcagtataaaatggcatgggaatacttttcaacaataaaaagaaaggaagtactgttctataatgcctcatggatgaacctcaaaaacattctgtgcagtgaaggaagccgcacaatgtataatcccatctataagaaacgaccactaagaaaaatctatagagacaggaaataggttagtgattgcctaggactaggagtgggagaagagactgactgacaatggcgaggagatcattttggggaggatgaacctgttctgaaattggcttgtggtgatggttgtacagctctgaaaatttactaaacatcattgaactgtacactcaaaacggatggattttatggcatgtaaattgtaactaaataaggctatttgaaaaagtttatattgtaccagaaaggttagcgtctgggcctgggtctggttcttccgctgccatgcaggtcgcctgtcactaacactcctcaagaattctgctccttctccatttccatttgtaaaacgttagcaggatggtgcggggagaaggagaacacattatcaaatctgagattctgtgcagtcacaagacaccaagtctgggaatttcgaaaggcaatcaggcataaattcttcctgaggtgagaaagaagcaaaggtaccggctgctggggtcagggccgtctcacacgcgtggctctaggcaggagcacaaatggaaccactggggaaagtaggactccagcagaaacgaaggcgcaaggccgaatccctaaggtccaacgagctagcagtcagttgacagggtttctaacaaaaacgcggcatgcgtttaccaaacctagggtggttttatttcagaagtaggaactctttccacgagagcaccaagttgagaagttcggttctcaggccgcgtggacctgacagctctcagaagctccaggcctcgctgggtggggcgggtagcggccgccgctgcctcagcagccctggtcccggcagagcagggctggcgaggccgctgctgccgccgtcggggccgccggccctccacactcgttgagacgccggcacggggaccttcgtgcccctctagggactggcgccgcgtccaggtggccgagcctgcgctgctggaggaggcgcctccgcgccggcctcaccccggggccggcagggggcgaaggcggagctggaagtcgccgccgggccccgggggaccggctcccgcgcttcctcccgcgccccccgcacagtgctcatgcgcacggcccagcctttatagcggccgcgggggccttgccttccgcactcgggcgcagccgggtggatctcgagcaggtgcggagccccgggcggcgggcgcgggtgcgagggatccctgacgcctctgtccctgtttctttgtcgctcccagcctgtctgtcgtcgttttggcgcccccgcctccccgcggtgcggggttgcacaccgatcctgggcttcgctcgatttgccgccgaggcgcctcccagacctagaggggcgctggcctggagcagcgggtcgtctgtgtcctctctcctctgcgccgcgcccggggatccgaagggtgcggggctctgaggaggtgacgcgcggggcctcccgcaccctggccttgcccgcattctccctctctcccaggtgtgagcagcctatcagtcaccatgtccgcagcctggatcccggctctcggcctcggtgggtgcgcgcccctcacgaccccggccccttgctccgctgggtggaggctggagccagccctcacgcttctctcttcgcaggtgtgtgtctgctgctgctgccggggcccgcgggcagcgagggagccggtgagtgggggagctggggtgcgtccaggcggtcgcaggggctgagcaccagcgggtacaagcgggactcagatccagccccttgggcttcagcccgaccgcctgaggaggaaggcgcgaaggttgagccgccgcgtggcgcgcccgcgttaacccctgcagccgatctgctcctgctcacctgtttctcccatggtagggggcccctggggtccagtggggggacgttctccaagagcactaggaagaaggcctcctccaggcccacccacagccccagaccccgggcccgctgagcgccggcagcaggaggtcgaggaaggaggactccttgagcctcaccgaggagcgcaccagtcctgggctctgctgcgtttgggggtggaggagaagccgcccagacccgacttcaggttgccgtagccgagagagagggaggcgaacgtcgctgtcccaccttgtttgactcgctagctatgtttctaggtgtaacccctataatcagaagcactcgcggtctcactctacacgctagagagtttaaaaagtttgtaccacgtgtagaggtccgggtatgggtgtgtggtttggtgtattttccagtgtaaaaggcaacgctttcctaagagctaccgtttgttttccttgaaagtaggaatgagggttaagtatccctcatggctgtatttctcccgctctacttaacaaaagtcagtgttcgcaactaaaggcggtcggtcttggcaccggattccgatgccgcccccatctcagcggaaaatgggaggaaggattaaggctgtttgatgataggtatgaggctgtttaggggtaaggattttaacctctcagctctctagactgcttcagagctaagaaatgggcattgcgcctgcatccttccttctcttccatggaatgtaaggtacctgtcaccacaaagggcacagaggagggtgcttgtcacaggcaaggtactcagttggacagtatggccagaaagtattcctctgccttggaaaaaaaaggtttttaaaattaatatatgttttaaaaaggtttggataactacaacttcccatgtttgaaaaatagcatttaataacattaatctcaatttagtatcgacagtaaattcacaaattaacatgttgtattatgttatcttgttacttgttgccaagagcttgtctcttcctagcatcatttatagtaaaaactgattctttgttaggttgacagtgtaaaacttgagaatattaacagtgctttctaaaaatgcatccgctgcttgataaatctcactggacagatctggagcagaaataatcaggttcaattaagataaaaatgctgtattctgaagggattcacttttctgttttctgtccttcgggagttgtagaatgttgtttgggcaaattaaccccacggctttaattttctcatctataaaatgaacaatcaagttagataactttctgtgaatctaagcatctttttgttggcttccttaatgtgtgagtttaaggatctgcatttgtaggctaactaggataaatggtcctatgaaggaaaggatggctttgatttgtgcacatgtctatgaaaatgttccacaaaggctcaatccagatttactatctttacctcaagcaactgtgtacatagcgtcatcaaagttgagatttaaaaatttttttttttcttctggagacaagatcttattctgtaacccaggatggagtgcagtgatgcaatcatagctcattgcaagcttgaactcccgggctcaagcaatcctcccacctcagcctctccagtggcggagagtacaggcatgcaccaccacgtgtggccatttaaaaaaaattttttttttttagaagagatgaggtcttgctatgttgtccagactggtcttgacctcctggactcaagcaaatcctcttgtcttggcctgctaaagtgctgggattataggcatgagtcaccacgcccagccaagattttttatatttctataattaatattaaatgacttttattttctagttcagatatagttccaattatgtatttccaacctggttaagaactgagaagccaggcacagtggcacacctgtaatcccagctactagggagttggaggtggatcacttgagctcgggaatttgagcctagcttgggcaacttggcgagtccccatttcaaaaacaaaaacgaaataaaaacccagaactttcacattagagttttatagtggctggggactatattaaattggaaaacaaccttgtggcttgccaaaatctggaatggtatggaagggtatataagtcaatagtcataactagaagtgtagaaattagggaagtaaaacttaaatctcacactgtagtctccccaccactatgccccaagaagtcctaagaatgcttacaatattatctcctttttcttcagctcccattgctatcacatgttttaccagaggcttggacatcaggaaagagaaagcagatgtcctctgcccagggggctgccctcttgaggaattctctgtgtatgggaacatagtatatgcttctgtatcgagcatatgtggggctgctgtccacaggtaagcccaaacacaccagggtgggagagaaatgcagacgtgattatttcctttcctgctttacccatctggatccctttcctccctgcattctttcttttgttgccattgtggccacagaaaatggatatattttcacggttctcctggatatacttgaaacaccaaatacacatggaaagctttctgacaaaaggcaaatagcattacctcttgatggctagattgctatgattccaaaacattcctaatcatgtgatatattactgagttattactatgtgccacctattgttttaacttccaccacaactctacaaggtaggtagaattttactccagttacagatgaagaaactgaactcagagagttgtcaagtatcttgcccaaggtgactattgttagcaagtgccatgctatcctgtagtagaatagccagtataatacttctaaaaaaattcagtccaaaggcatgtagctaaagtgagtatcttaggaaaattgtttggtgctctgaatttctaagttgtgggtaatgggatattacaaatgtgttcttatcaacacttaagaagttcaacagcacaaaaccatttttttccaggcaaattttgttcttgtgtaagcaagtttttaaaaggctagcagcagctgggagtggtggctcacacctgtaatcccaccactttgggaggctgaggcggatggaccacttgaggtcaggagttcgagacctagccaacatggtgaaaccctgtctctactaaaaatacaaaaattagccaggtatggtggtgcatgcctgtaatcccagctacttgggaggctgaggcaggagaatcacttgaatcctggaggtggaggttgcagtgagccgagatcgcgccactgcactccatcctgggctacagagcgagacgccatcaaataaataaataaataaagcagaatctttagatgacttccctgatgagctattttcttgattaatcaaagcaatagatacaacatggcactataagtcagtgggatgccctgaaaaagtgtggatagcatctcagctgctattcttgtgttacaggggagtaatcagcaactcagggggacctgtacgagtctatagcctacctggtcgagaaaactattcctcagtagatgccaatggcatccagtctcaaatgctttctagatggtctgcttctttcacagtaactagtaggtataattattgttctcattctgtaatattctcccaccccccaaacgttttctgctttttttagctcagcctctttaaccttgatggaaaaacctgtgatcaagactaaagctgacctatagaggtaaactgtaggttagactgaggggtcaagtacccactgaagccaaatttgggtgaatagaagacaatcttactgacagatgatggcaatagaaacttgaattatttgcagtcagaatgcccggacacttaccaaggaactgaaaaactactaaatacatttttgatgatcctttgaagatataatggataagcattttggttctctgaaactagcatgcagcaggatgtttgtaactacaatcaccattaccctattacatttgtcattgtagagagctctaaattagattcataatactttggtaaagaaggaaaaggaaaaaaataagcttatttttattttaacagaaggcaaaagtagtacacaggaggccacaggacaagcagtgtccacagcacatccaccaacaggtatgaactatgaaacctatctcctagttgcccggcacagcatttggaagttatgaataaacgtgttgttggtagaagcttttcttaaagaaatttgatattaaagagaaacaaagcaaataccttaagtttactggtatattacatatggaaacattcattatgtgtatattttaaagacagggtctcactctgttgctcaggctggagtacagtggtgcaatcatagctcactgcagccttaaactcctaggctcaagcaatcttctcaccttggcctcctgagtaggtggtactacaggcacatgccaccacacccagccaatttttttgatttttaattttttttatttttatttttttagacaggtctagctatgatgcccaggctggttttgaactcctgacctcaggcagtcctcccacttcagcctcccaaagttcagggattacaggcatgagccactgcacccagcctaataattctctaaaagtcctattttctcccagatttgataaaccacgcctaagaactggtcaaagtaccatgaacttctagttccatttgcttcattaaattcctttaattactgcactgtcatgtgactaaaaggaatgtgtgtctattgtaagaaatagccagggatccccttttgtatgacgatggcagttttaaagtcaaagatattaagaacattaggatttaatgttgagttcctgcctcacctgtgggtttggggtattaaagtcctggattagggcatatcaaatatgtaggcctacatactgatttgtttatttgttgggtcattgctttccctagtccagaaaatcctgaggaaattaatttttttaaaaaagtcctttcaagaatggcactctgttgttatgagcttctccccatgtgggtttcttgctatgtaactgtcttccttttgttaatgccaagtgcatcttttatttcaggtaaacgactaaagaaaacacccgagaagaaaactggcaataaaggtaagaatcaagatctccatttgggaaggtagcattttccctccctcctcttgagactgctaatgaggggactggtttggttgttcgcagattgtaaagcagacattgcatttctgattgatggaagctttaatattgggcagcgccgatttaatttacagaagaattttgttggaaaagtggctctaatgttgggaattggaacagaaggaccacatgtgggccttgttcaagccaggtaccaaccttgttaaaatgggagatttaaaaaaaaaattattttgtaattgacacataataattatatatacttatggggtacatagtgatgttttcatacatacaatgtatagtggtcaaatcagagtaattagcatatccatcacctcaaacattgatcatttctttgtgttggatacattcaaaatcaaatgaggccgggtgcagtggctcacgcctgtaattccagcactttggaggccaagtgggtgtgtggatcacctgaggtcaggagttcaaaaccagtctggccaacatgtgaaacaccgtctctactaaaaatacaaaaattagccagatgtggtggcatgcacctgtaatcctagctacttgggaggctgaggcaggagaatcacttggactcgggaggcagaggttacaatgagccgagattgcaccactgcactccagcctgggcaacagtgagactatgtctcaaaaaaaaaaaaaaaaaagaaaaaaatcaaatgagaggagatttgaatgagtcttgaatgatgacaaatgatcagttcttttagtgggtacatgtcagttcagtataaacatttgagttatggacacactgggttcccaaactgtaagttcaggatctaagactgcctgggcagactgagtagatctgagtgcctcctttttggaataaaagaatttagaaaactgtgtgctatctatataagaaccagaaggtagactggagagtcctgttgcttacacaagtcacctctgcttatctactctgctcaattcctaatttctctcttctgaaggaagaagcagtgatatgtctattccacctccctattctgttattctttttagctctttccatattctcttggttggtgatctgaagcacgacctttctattttattcatttaaaaatatttattaattgctggccaggtgcggtggctcacgcctgtaatcccagcactttgggaggccgaggcggatggatcacggggtcaggagattgagaccatcctggctaacacggggaaaccccgtctctactaaaaatacaaaaaaaaaaaattagccgggcgtggtggcaggcgcctgtagtcccagctactcgggaggctgaggcaggagaatggcgtgaacccaggaggtggagcttgcagtgagccaagatcgtgccactgcactccagcctgggcaacagagcaagactctgtttcaaaaaataaaaataaaaataaataaataaataaatatttatttattaattgcttttagaaatagaatatgctcattatagaaagcttgaaaatacatagagcacaaaaaaagaaatgctctaaatcatatgccctagagataatcactataaaatggtttttttttttttttttttttttttttgagacggagttttgctctgtcaccgaggctggaatgcaatggcacgatctttgttcactacaacctctgcctcctggatttaagtgattctcctgcctcagcctcctgagtagctgggatcacaggtgtgcactactacgcctggctaatttttgtatttttagtagagacaaggtttcaccatgttggccagcctggtctcgagctcctgacctcaggtgatccacctgcctcggactcccaaagtgctaggattacaggtgtgagctaccacgcctggccccttcagtattttaaggaaatatttgactgtattatttttaaaaaactcagactattaaaaatgccctgcatcctgtttttttcatcctttagtatttttagcattttctcatatcacaaatattcatcaaaaatatttcataatattccgctgcatgattagtcattcttattatttcttcactacattacacactacactgtgatgaacatccttatatcatctttgtgcccatctctgattatttcatcaggttagatttctaaaagtgaggttctgacttaaagcctctgatataaatagtgaaattgagccatgcacagtggctcatgcctgtagtgccagctgctcaggaggctgaggtgtgaggatctctcaagcccaggagttcaaagctgcagtgagctatgatggcaccactctactccagcctggacaacagagaaagaccccatctctaaaaaaacaaataaatagcgaaattgcttcctagaaaggtgaagtagtttaaactactatcagcagtgtgtaaggttgtataaacagtgctattacaaatattaatttccatttcatttctgttattttttacaagtggctctgctcttagattagatagaatttttttggcatgagaagaaaatttaactgttttaacataatttaaccatttgtctctcacccttaaaaaaaatgtgttccttgtttcattgacttatggtatcacatttatacctgagtttgagcaagtctatttctttgattcatatgctaatccttacatatttttttctacgctgctttgattatcacagttttattgcacattttaacatcccatgaggcaaattcccctgcagtactttttgtcttgtacttttttctgactactttgacccaattctttttgaagatgaattcttcattaccttgtagactcatacaaagttttgtagtttttctgttttagaaagaccattagaataggtaaaccatgtcaagtttatatgtatgtaagtcaaagaacagaatatatcaaggatacaaaaatgagactaatttcataagtcataatctggatagttgaaaagtgaccacaagtgaaaaggttttcaacccatgaaatctgattttatgacccaatattccatcaggtatgtatgcagaaatacagtcagtgttctacttctccctcaaaaaatcttgaataaaatggctactgataatgctaagatcttaaattttgcactaggaaatactgactcatctagaaactaaacacaacagattgtgctgtggttgtttatactcaaaacggtctctgctgaacacagagtagttatataaaagtgagctgaaattcctttaatattaaatataggaaatgagatctcaaaactcttacaatacacataattttaaggtgcacaaatgtcattgtcattataagaaaaactcaatattgtaactttataattcatttcacctttgtccctttaaaaaaatgttgacggtcacatcaatgaaattgtttctcctgaacagagagctctgagttaatagatccacactacttagagcctctggggtcccacactggaacagaccctagtctcatacccagccacttcctcatttagtttagctacctggtgcccaactctgcggacttctgttaaacccgaggctctgagccaagcccgatttcaagttctccgtatagtttaggcatggactttgcagccagacaacttgaacttaaaatgcagctgtgtttcatcaggcaaactccctaaatgctctgagactcagtttcttcatttacataattgggataattccaaccttatagagctatgatgaaatgaggttttacatgtgttatgcttttggcttattacccagaatataataaatcctcaatatggcaattatttgttacacctctgaaatatctccaataattcaagtaaggatgcaatgcctcagttgactatgtactatggaattaagaaagaaacttgtgtgttgtctggttttaaaactgttttttaaggcatgtaatgttgcttattttacctttttaattctccctgaataacattttctttcttccactcagtgaacatcccaaaatagaattttacttgaaaaactttacatcagccaaagatgttttgtttgccataaaggaagtaggtttcagagggggtaattccaatacaggtaagtagactttgatacctgggatgtaacataggagagggttatcagtgatcagacatgtaaaacagtattatgctattttatatgagcagatgtgaaatcctcctggaactgaaatcttggctaggtctgcatttgatcatctgagataaattttcaatttataatggaagtataccaaagtgttgatatttcttattttaaaaaatataaagcatggtgatttagaattctcatacattggattgactagatataacattggagaagtatctctttgtaatgctaaaaagaagtgaaaatcaacagacttatctaatgaatgcagatgtggcagaaagaatgagtagcactaccgttgactctgaagagagacttcttagaggtactaatcagtcaccaaagggctacatagagagcacatgcatggaagtgggaatcagttttgtgtttctaactggcgattgatgtggggtaaacaaatgtgaggcttctaggaggtggagggggatctaatatggcttgtgaagataaataggcctggtagataattaaactttcccagctgatgcatctgttacagaactgggttctatataattcttttttgtgtgccccgccccactgccagttctatatataattcttaaactttgcagcatcaaatgctacagggaaacagaaatgtggtttgagcagtggtaaaggctatttgtttgcttctttttcaaatttaggaaaagccttgaagcatactgctcagaaattcttcacggtagatgctggagtaagaaaagggatccccaaagtggtggtggtatttattgatggttggccttctgatgacatcgaggaagcaggcattgtggccagagagtttggtgtcaatgtatttatagtttctgtggccaagcctatccctgaagaactggggatggttcaggatgtcacatttgttgacaaggtaaagtggtgagggttatcttctgttacagtgatgggtattccattttggacctctaagtgcagtgctgactgcctcttatctagattaacttgaaacattcaggattttccagtttttaagaagaaacaacttttgatccttttggatatcttttatgtgtctcccccattaggctgtctgtcggaataatggcttcttctcttaccacatgcccaactggtttggcaccacaaaatacgtaaagcctctggtacagaagctgtgcactcatgaacaaatgatgtgcagcaagacctgttataactcagtgaacattgcctttctaattgatggctccagcagtgttggagatagcaatttccgcctcatgcttgaatttgtttccaacatagccaagacttttgaaatctcggacattggtgccaagatagctgctgtacagtttacttatgatcagcgcacggagttcagtttcactgactatagcaccaaagagaatgtcctagctgtcatcagaaacatccgctatatgagtggtggaacagctactggtgatgccatttccttcactgttagaaatgtgtttggccctataagggagagccccaacaagaacttcctagtaattgtcacagatgggcagtcctatgatgatgtccaaggccctgcagctgctgcacatgatgcaggtaaggtccttgttctttataggagaagggaacagaaaaaacggttcagtgaatttaggagtaaataaaaatttaagcatttatttcattaaacaaacacctgtggctttacccaatattaactgttaaagcagccctactcatctcattctacagataaggaagcaaacttcctggaaatgacatttctagtaagtggcaaggccaagatccaaacccaggcattctggctccagagtgcacattcctaaccactgtattgttgggagaattgccatgagaaccatgtcacattaaggaaatatgcttatacatatacaattaaggtgctcatatttagctcaaacttggactatatctccaaatagccagcttataacctaccatgaatctgccattcagtaatttatcctaactttcttgtgtatgaaacaggtaattgctctgtcaccaggctggagtgcagtggcatgtagtgagctacaacctccaactattgggctcaagcaatcctcctgtgtcagccttccaaatagctaggacgacaggcacatgccactgcccctggctaatttttaaattttttttgggagagacgggggtctcactttgttgcccaggctgatctcaaactcctgggctcaagcgatcctcacaccttggcctcccaaagtgctgggattacaggcataagccaccacacccaaccctaacttttattttagtcaagttttgtctggcatgagtttcctaagataaggtctcccatagactttacctatcccatcaaaatttccttggccaggtgcagtggctcacatctgtaattcagcactttgggaggctgaggtgggcgggatcacctgaggtcaggagttcaagaccagccgggccaacatggtaaaacccagtctctattaaaaatacaaaaattagctgggtgtggtaacatacacctgtaatcccagctactcaggaggctgaggcacgagaatcacttgaacccaggaggcagaggttgcaatgaactgagatcgtgccattgtactccagcctgggcgacagagtgagactctgtctcaaaaagaaaaaaaaaaaaaacaaaaaactttttcccccccgcttaagataataaaaacacactctggtgttataaaagggtataagaagggtttctttcttcctcaccccagccttaatattacttttggcacaggcctcgttcctgaagacattaacgtaatgtgttagagatcaaataggccaacaaaaagctaagattccctttctgaggatataactgagtgacaggagggaagaatcaatggacttgttttttttaacactcttctgtacctcattttccctacttaattcctaatgacataacctttttcctttctacacattagtacctctgccaatgtactcacatatttttacagatactgatgaaagattattcttaaaacagagaacacatgcaatttaagttccacatctagcttgtaaaaagtattttttatacatcagcaactagcctgtgaagtaaagacctgtttactatcatattccttaatacttagcttactgaacttatagttaacaggattgtattcaggctataaagtgattaggttgattaaagttcaggaggctggactacaccaatattgattcgtgaaaattatcccttagtgatattgaaagttgcaaaagccagaaaatagggtaggattttaggggtagatcacaacagtttttatttattttcagggtcttgctctgtcacccaggctggagtacagtggtgtgattatttttttttttaactgtaattatatgctgggcttgagctaaacaatctgaactagaatgtagaactgaaaagaagtgaggaaaactgagggggaggaaaaaaatattttgactttttttttttttaaccagggagtgagagtcaggaaaaggagactggaacaattggacattgttccaagtagcttttacatcatctaaacctgctgcatatcttaggtatttaccactctgagcactgtataccactagaaggggaatgaaaccttagatctgtagaggaaaactattacagaaactccaaaagttatagaaaattgcacccagcattagatagatggtactctacactaagaatctgctaaatgaggccaggtgtggtggcttatgcctgttaatcccagcactttgggaggccgaggcagatggatcgcttgagccctggagttcgagatgagaccagcctgaacaacatggtgaaaccccatctctacaaagaaatttaaaaattagctgggcttagtggcatgcgcttgtagtcccagctacttgaggatgggggtgctgaggaggatagtttgagcccaggaagttgaggctgcagtgagccttgattgtaccactgcactccagcatgggcaaaagagccagaccctgtctgagaaaaaaaaaaaaaaaagattaaatgaaaacttctacaattgggattggggtgaatccaactaatgtattattaccctaaatgtacagttgtactaaaagccttctagtaactaaagtgaatggaaatagaatacctcaatgaaactggaagaaattactccagtttcataagatccctcttgggcagtactttttagtcactagttttgctttgggattataggctgacattttctgattattagacagtttgccaatataaagattgaaatggaagaggatttttcattatcagaggactagtcaccattcctcaaacaatgcaacctttgaacacttttgctatttacttatcccatctcttgtgccattcttccttgctttaatggattgtgactctgactccagtatactgtttgatgcaggccaacctcatacggaaaattttcaccatccgcatttactgtaggattttaaaaaagatactgtggatcaggttaaaagtcttcttctattcctagtttataggtgtgttctgtcattaatggatattgaactttatcaaattatttcttatcagtgatgacttacctgttactgtggtgaattacagatatagcagagtttctggtttggaccactcttttgccactctcgtcacaatgactgtgaaaacttaatttgttcaggggatttaattgtccagaaattagtaagcagttttcgctgcaactatgtaacagtgtatggaaaacatatagacataattccatatattagctagacctgattttcaattcactttaaaatgttttcattgtaggaatcactatcttctctgttggtgtggcttgggcacctctggatgacctgaaagatatggcttctaaaccgaaggagtctcatgctttcttcacaagagagttcacaggattagaaccaattgtttctgatgtcatcagaggcatttgtagagatttcttagaatcccagcaataatggtaacattttgacaactgaaagaaaaagtacaaggggatccagtgtgtaaattgtattctcataatactgaaatgctttagcatactagaatcagatacaaaactattaagtatgtcaacagccatttaggcaaataagcactcctttaaagccgctgccttctggttacaatttacagtgtactttgttaaaaacactgctgaggcttcataatcatggctcttagaaactcaggaaagaggagataatgtggattaaaaccttaagagttctaaccatgcctactaaatgtacagatatgcaaattccatagctcaataaaagaatctgatacttagaccaaaagcaacattcgttctctaaccattctgtattgattatataagcaaaatgaaaagagaaacttaaatgaacacagctctttaacatggttcaggtacacatattttgacccaagtggatattttcttaaaaccaatcaataatagctagctattactgcagactataaaatctggatatagaaaggagacctgtatcaaactgcttttgtagtgtgttttcataacaacttatgactaaaaatatcacactgaataagagagcaggattgccaggtatttttctatttctctccttaattttatatgtatatagatatatttggcttatattctaagtcacctaagtacttaaaagttaagttggtaaagtatttactgactgcttataaacatttaaagacaaagacatttcaaataactgcagaaaaaatattgtagtttgaatatttaagcaataaaactgctagtgagttattgtaagctggcttacttttattactgctagtgtctcccctgaggatatggtaaaaattcatgtggaaagaccaatctgaattgttttttaaatcatgtaataataccaagaatattttttctttgattcaattatttattgaggccaagcacagtggctcatgcctgtaatcccagcactttgggaggctgaagcaggaggactgcttgaggccaagaattcaagaccagcctgggcaacatagtgagaaccccctctacaaaaaagaaaaaaaaattagccgggtgggatggtgcatgtctgtagtctgagctacttgggaggctgaggtgggaggactgcttgagccgaggaggtcaaggctacagtgagccatgatcacaccactgcactccagcttgggtgacagagcaagaccctatctccaaaataaaaaaaaaaataaaaagacacaagtttattgaatacctactgtcctaggcattatacacagccactacctgattaaacagtataagatatttttgagtacttgcttcaccagaaatgttttgtaattgacatcattttttacttaaaaatgcttgtgaagttggttcctatgaaaggagaacatcaggactcccttaatgtgacttagatgattcgcttaccaaggcctctcccaaaagacagaggtgctctatcatcccaccttgtctgtcttttctaaagataggtcctatctcctcctctcatccacctaagccccctgaaatgtgttaactggttagaataatatactccagtaaatcttctgagtcttacaattttataccctgcataagaggaataaaaggactacatgcagggagaaacaaactggaattgactttttcactacataaaaatttgaatttgaaaatagagtttgagaagacaacctccccttttataaaatgcttcaaacatgactgaatcatgtaacagggataattttaattaaacatcataaaaactgggtttagcatagtatgatttttccccagtaagtagaccaaaaactctcagctaggagtacaaccccttggaaaattaagctctaatgaaaacccagctaccactcattagcccttttaagaaagtggttttttctttaattttataaaggaccaagttttgagtcacctgaagtaaccagggaatagcagcaagacagcagaaatcagaactgtaggttactatcaataattatgtaagtaaacataatcaggataaaggttatttacaggagacagagtaaaaaggaaatacgtattacaatccaacttaagcaaacatgcttagatttcaaatatgctggcccatttataacttaatgcattaaatgcaatgttagtcttcaacaggtaagttacctagtttgaaataatgagaaaaacaacatgaaatgagaggcagaatatgattaactattgaagaaatcaacatattaagatttgtataaagtactatttaatagtgaaattaatctaatttcccatgtgtcaaatggaagcacacataatgaaaataagacattatttttgcatacctttagtctcttccaaatgtttaatactgcagagaaaaatacaaccaaaggagatagaacaaaataaacatatatactaatttttatccatttcagttttaatacattccaaaatacgtcaatgtttatgcattccaataatcatcacatttcagatcaatgataatgtactgggttggaataggtgctagaaacaattctagctttggaaaagcttattctttatttcaaaaaagaagaaacagaagaggagaaaagtaccccctttaatttgtcctttagttgaatgttcagttcagaaaaacaaaaaaaatggtatttaaaaaaaacttgctgggcacggtggctcacgcctgtaatcccagccagcactttgggaggccgaggcgggtggatcacctgaggtgactcaggagtttgagacctgcctg

SEQ ID NO: 14166 - DNA, 321022 bp, Human; identical to SEQ ID NO: 11852
  misc_feature (1)...(321022): n = A,T,C or G

SEQ ID NO: 14167 - DNA, 93398 bp, Human
gagacggggtttcaccatgttggccaggctggtctcgaactcctgacctcaggtgatcacctgcctcagcctcccaaagtgctgggattacaggggtaagccaccacgcccggccttttttttcttttgtgagacaaggtctcactctgtcacccaggctggagtgcagtggcgtgatcttggctcactgcagtctccacctcacaggctgaagtggtcttcccacctcagcttcccgcgtagctaagaccacaggcacatgccaccacgcccagctaagttttgtatgttttgtagagacaggattttgccatgttgtccaggctgatgtcgagttcttgggctcaagcaatccttctgccttggcctcccatagtactgagattacaggtgtgagccactgtgccccgcctacgtggaattgttttatatgagaacagaggttctaccatcattcagtgatagcagggctgaaatatatttcaggcagactagtgtgatatattagaaaatgagggtattttaggtatgtgtaaatcatatttgcaaacttgggttttccatttcagtcttttccgcccccggaggaatgggttggagcttggtccgtctcacggcctggctctggggaatgtcctgaatatctcactgctgtcctagggttgagacctccttctgctcagttggattcacggaattatcagagtgggctttagctgacatctaagccagtgggcaaggttggagcagtgaggcctactgtgtctgaagtgttaaagctccccagagaaccgggcacggtggctcatgcctgtaatcctagcactttgggaggctgaggcgggcagttcacgaggtgaggagatcgagaccatcctggctaacatggtgaaaccccatctctatcaaaaatacaaaaataaaaattagccgggcgtggtggtcggcacctgtagttccagctactcggcaggctgaggcaggagaatggcgtgaacacgggaggcggagcttgcagtgagccgagatcgcgccattgcactccagcctgggcgacagagggagactccatctcaaaaaaaaaaaaaaacaaaaaaaaacaaacaaaaacgaaaaaacgaaaaacctcaccagaaatgcacactagggcttacccagccccagtccaggaaggaatagtcttcctgcctccccattgccctctatgctttctcttttcctagcatatctactcttcctattttctgcctctctcctctagaatattagcacctcaagaataaggaaggcattttgtttgttgctctatttccaagtgctggagaacttgggtgggactcagtggttctttatttttatttctttatttttattttaattttagagatgggtctcgccatcaccatgttgcccagtctggtctccaactcctgggctcaagcgatcctcctgccttggtctcccaaagtgctgggattacaggtgtgagcccccacacccggcctgagtgagtgggttctgaatggtgactgttgttgtccatagccttccccctgcttctgagagtggagtccctcccctcatgttggagacctcccaaggtccatgtggtcctataggggctgttcagcctccctagccccttaacgtgtcaggtaatactgtatatattccatgaaatgtgaataattagttatataattcctaagcacttattttaaaaaacagcaatgtgatgcttaactcttcccacctctgttcctgtcccccttagaaaaccactgataactctttttttttttgagacggagtcttgccctgtcgcccaggctggagtgtagtggcctgatctcggctcggctcattgtaacctccgcctcgggtttgagcgattctcctgcctcagcctcctgagtagctgggattataggcgtgcaccaccacgcctggctaattttttgtatctttagtagggacgggtttcaccatgttggccagagtggtcttgaactcctgaccttgtgatccgctcgcctcagcctcccaaagtgctgggattacaggcatgagccaccgtgcctgtcctagaaccactggtaactcttaactggtaatttttgttttaacctctgtatttttatttttcacctgagtgctcaaatattttcatcttttttataatggtcatgttgcatttgtaattttaagaagaaaaatatttataaacgaggaattcttaggttattagtcttcttcctacaacagcacttctccagtaccaatctgattcctctaagtccgcatccccaggtttgacatctctaactctaatcccttccgttctttgtccttgtgattttacacctttcttttgtgaaagagatatgcatattaaactctcaggccaggctcggtggcttaaatgcctccaatcccagcactttgggagtccgagacgggtagatcacctgaggtcaggagttcgagaccagcctggccaacatagtgaaaccccgtctctactaaaagtacaaaaaaatgagccaggcgtggtgatgcatgcctgtagtctcagctactcgggaggctaaggcaggagaatcacttgaacccagcggcagaggctgtggtgagctgagattgtgccactggcacagttccagcctgggcgacagagactccgtttcaataaaaaaataaataaataaactctcagtctttgcatattgcaagatgtattttgcctctttttttgttttttgttttttttttttttttgttttgttttgagacaaggtcttgctctgtaccccaggctggagtgcagtggtgctttcttggctctctgcaatctctgctgcccaggctcaactgatcctcctgccacagcctccccagtagctgggattatgggcatgcacccagctgatttttgtatttttttgcagagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgaggtgggcatttattttcccttaatgcttgcttgattgattgacagacagtcttgctctgtagcccaggctgcagtacagcggcatgcttataggttgctgtagcctcgaattcttaggcttaagtgatcctcctccctcagcctctgaagaagctaggagtagcttctaggactagcttctaggactgtaggtgtgtgtcactgtacctggctaaatttaaaattttttgtagagacggcgtcttactatgttggccaggctggtctcagactcctgacctcgagtgatcttcccacttcagcctcccaaagtggtgggattacaggtgtgagccaccacgcctggtgaagattttctgtttgtcctccatgttctgtcatttcaatacaatgtatctagatgatttgttttcatttattttgctcagaacatagggtgctcttttattcagaatatctaattttcctttcatctctggaaaatgtttcacctctttgaaatttgttggctggctgaggtggctcaacctgtaatcctaccactttgggagtccaggagtttgagaccagcctgggcaatgtggtgaaaccccgtctctacaaaaaatacaaaaattagccagtgtggtggtgcatgcctgtattcccagctaattgggaggctgaggtgggaggattgcttgggcccaggagttctaggatgcagtgagctgtgatggcaccattgcattttagcctgggcaacagaggaagaccctgtctcaataaaaaaaaaaaaaaaaatgaaaagaagaagttgtctttccctcatcctcccaagcctctccaactagaactgcattggaatgtaagctccttgaaggtagaggatttttgggggtatacgtaacataaaatttaccattttaactattttaaagcatttagttctatggtcttaagtgcattcacattgttatacaaccatgacactgtctccagaactttttcatcttctcaaactgaaactctgtcccataattccccatcctcctttttcttcccccagtttctggcactcaccattctacttcctgtctctatgtattctattctggggacctcatgtacgtggaattttacagtatttgtcttttttgtgtctgccttatttcacttagcatagtttcttcaagattcgtccatattgaagcagatatcagcatttccttccttttaaagctgaatactactccactgtgcagatagtctacattttggttatctattcatctgttgatgggttacgtctaccttttggctactgtaatagtgctcctgtgaacatggttgtacaaatatcttctggttcctgcttttaattcttttgggtagacagactgtttttcaccctgttttgttcaatgttataatcccaacacctaaaatcagtgtcttgctcatagtaggcactttatatttgaaagaatgaaacattcatgaatgttatgtcttaatttatcttacatggttttcatctctttatcagcccttttccttgctgattctctcagatttatcttctaatctattatatttttagctgtgcctggtctgctatattcaactcaactgagtttttaatttcaataccaatacttttttttttccaagtctgcaaatcatgaaaacagtaatttcctgttctcctgtagaagaccttccatactgtcccatgcctggctcctggaggatctctcactgctggtgggaggctgtgtttacctcaggggcatctctcagtggctctcccggggagaggggggctccccatgagcagttctcaggtttccctgcaggtcctaccagtgtcactcattctagacctgttttgacattttttggtctccggatttagccttcttaggcggaggcttggggttcacatttctcaagggtggctctgtcaccccagtggcctctggtgggtgtttgctgagggcccagccctgggctggctggtagaggggctcaggtgatgatgacagcactgtgaccacagacactcacctggtgatgaggaagtcctctgcctggtggtggcttcttttcctccttactgtttgaaagtacctgcaaggtgggtcctctgtcctcaggacatggagtgaggatgagtggtagaggctcttggccggggtcccacagtgtagtaagtggcagagctgggattctagtccagacagcagctccacacttggtgctcctaatcacggcagccagctgctcgccatgactcctctccttcgggctctgtgcaggcagcccagtcaggcccaagcccctgtcctgcacctcccttctgtattccggctgccaagccccagcacctaaaccctggggtcctgccatgggcagcctgcagcctatgaggctccagactgctgttcccttttcatttctagacctggagattctctctattgctttgcattaggcagtgtagctagacaaggtcttgctgagtctggcgtgcaatagtgtggtcacagctcactgcagtgtcaacctcctgagcccaagccatcctcacacctcagcctcccgggtagctgggactgtagatgtgcgccagtgtgcctggctaattttattttttgtagagacagggtctcactatgctgcccaggctcatctcaaactgctgggttcaagcaatcctccctctttggcctcccaaagtgctaggattacaagtagtgaaccactgtgcccggcctccctccctccctcccttccttcccgaactcttccattcctctccttccttcctttccttccttcccttctctctttctctttctttctttccttctttcttctcttttttttcttttcttttctttctttctctctcattctttctttctttcttttcctttcttctcttctcttttcttttctttctccttgccttccccaacataagaaagatagttaaacccgggtatggtggctcacatctgtaatcccagcactttgaaaggccaaggcgggtggatcgcttgagcccaggagttggagaccagcctcggcaacatggtgagactttgtacaaaaacacaaaaattagctgggcatggtggcaagtgccttgtagtcctcacagctgctcaggaggctgaggcaggaagatcacttgagcctgggaggcagaggttgcagtgagccatgatcataccactgcactccagcctgggtgacagagtgagactctgtctcaaaggaaaaaaaaaaaggaaagtggtttgggctgggtgcagtgtctcatgcctgtaatcccagtactttgggatgttgagatgggaagatcccttgagcccaggagtttgagatcagcctggacaatatagtgagatccatctctacaaaaaaagggttaaaaagttagctgagcatggtggggtgcacctatagtcccagctactcgggaggctgagatgggaggattgcttgagccctgaaggatagaggttgcagtgagctgaaattgtgccattgccctgcactccagcttcggtggtagtgagaccctgtctcaagggaaaaaaaaaattgtttggcagggtacaggggctcctgcttgtaatgccagcactttgggaaggattccttgaagccaggacttagagactagcctggtcaacaagacaagatcccgtctctacaaaaaattttatttttatttttattgatatatttttgagacagagtctcactcaggctggagtgcagtggcgtggtctttgcttattgcagcctccacctcctgggttcaagcgattctcctgcctcagcctcccaagtagctgggattacaggtgtgtgccaccaagcctggctaatttttgtatttttagtagagttgtggtttcaccatgttggccaggctggcctcgaactccagaccacaagtgatccacctgactcagcctcctaaagtgctgggattgcaggcatgagccacctcacccagctgctgaacttcttgaatctgtacatttgtgtcttattaaattggggaacttttggaggaccactgttttctccaaatatttttgcctttttttttccctcctccttctgggtggaactccagaccctttaatattgttccacagatctgtgaggctctgcttcctttttttcccccttctttttacagtcttgctctgtaatccaggttggagtgcagtagtgcaatcatagctcactgcagccttgacctcttggactcaagcgatcctcctgcctcagcctcctgagtagcagggactacaggtgcacatcaccacgactggctaatttttgtattttttgttgagatgggctctcactgtcttgcccaagctggtcttgaattcctggacttgagtgatcctcctgcctcggcctcccaaagcctgaccacattccccttaaaaatggtttcgtggccaggtgcggtggctcacgcctgtaatcccagcactttgggaggccaaggcgggcggatcacgaagtcaggagatcgagaccatcctgggtaacacggtgaaaccccgtctctactaaaaatacaaaaaattagccgggcgtggtggtgggcgcctgtagtcccagctactcaggagggtgaggcaggagaattgaacccgggaggtggaggttgcagtgagctgagatcgcaccactgcagtccaacctgggtgacagagcgagactccgtctaaaaaaaaaaaaacaaaaaacaaaaaacacacttttttttttttttttgtccagcagctggaatctcttttcagttatttcataaactaggctgcttggaatcagcctggaatttgggcagagtttataggcagaatttgggactcccctctgagactctctccttgagatttcccccctcattttatagttgttacagttgcttcaaactctcctcagtcacacatttcaaaatggagttcacccagtgctgttccctttctttcaacagttggttccgtccattttctctctgcttttggttgctctcagttccttcaggaggtggttttttatgttttgtccagggttatagtttttaccttgggacagttggtatgatatgagctggaagaggaactgactttgatctacctttttaagaaattgtgcgggtcagacagaacacatttgtatgtgttttggtgttaaagagttgtccagagcacatgaagctgaactgggacttcaacattttttcaaggttttacatttgctctttttttcctgtctccttcctcagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagaggtcagggtccgccccctagtggtggtaataaaaaatgcttccagatgaggttaagtgtccctggggaacaaaatcctccccatttgagaaccgctgttctagtccacgggcatctctggtccttactgtactcagattttccctagtgtctgatgctattgatttctggcttctcagagggctgttgttggagcttgtgatggtgtactcctgagagatgccttcccagctggggcgggtgcctacctgtttcttattcctagctgtgttttggggctctggccccttcactagatgtctcagattagggactgtagctttgcagggaagaccccacaccagcatgctgcagcgagttaccttcctaaactgccccttctgcacgtgggcctcactggccagtgtggtgcactggcaaagtaacctgtgttgtggctcagcagtgttgttctcaagtagttaatcttcaggtagtagctaaaaaatgtgaccttactgctgtgttctttcttgtttaatttaggcctgaacacggaggggattagtggactgagataagaatactgggttgagcatagccagacctgactgggattgctttcacccttggagactcttggctttttgcttcttattttcatcaacctggagctaatcctgtgcttggagttggaatatctggttttagactttgctgaccaggtcatcttgggcacattctgagcctctgcctgatacctcagctgtaacaggagggattgggatgagctcttttcctgttagtgtcgattttgcttttatgctattccctgttgtccttttgcataggcctggcattatgccagctgcctcacacatattagctcttttaagtatatgttggtggacaggtggaaatctgtgtttcagggatgattggcaagttaagttatgtgtccatggccacactgtagattattagtggtatgactggagtgtgctgtcttgactgactttcatgttcttcctttaaaaaatgattcctttttctttcagctttatcattttgtgattccgtgtaatttttgtgatactaaaactgccttctgtgacctgaattattataaaaacatcataaattgcttacaaagaaaatcagaccccacaaagctgtagaggtcctggcatacctatcctaggttttaaatgtaattgctttttctttcttttttcttttttttaataccatagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaaggtatttaggagacgttgtgtaaggggtcatgtgaccttgagcagtgagcatggccaccctatgagggcacctgcacgagtactggggcgggcggagaaggtgaggacaggcctggtacttccagccacttgcctgagccctggctttgggttggagggtgggctccaggatgccctggcactgcctcctcagttctcagctggctgctgagccagttgagaggtctagagaggtgagctaagtgttcaagattcaaatggctaaaaagaggcaaagcttgtttcttaacgtggttctgccagtttcagagcccttgcttgacaacgtcaggctacactcttttcatggatctcatctccaaggtgttctttagcctgatgtggtcagtggagacaggctgggctctagagtgtgacttcttaagtctgcaccatctgatgagtgggaagcagagctgtgcagaggtgctcccgctgtccttaccctgtggtccagtgtccacttactgtctcctcagccaggtggtccagcagatggcctgcctccctgaggcctagggatgtgtcttttgcctcctgttcttggttcccagtgcagagcccagcacactgaacacaagcgaatgagtgtttccttatcctaacttgcgatggaaaggtgtggtggtgctgctccattctgcctggtgatggtgtctccacgccttcacgtggcactcgggatggccctgacactcggatgagtataagccataggaaacaaccaaggggccatggctttggcagaaggaaggaactcttgatggggcagcagtctctgttcatctggtggtctatagggtgttgctttttagttgtaactccttgaaattgttaaaataatgaagagctttgagggttaaaaaaacgttttttgattactcaggagctgtttagttctcgctcatgtaatggcagtggtgaagtttttaaattttatttatttatttatttattttgagatggtctctgttgtccaggctagagggcagtggtgtgatcatggctcacaacagccttgacctcccaggcttaggtgatcctcctacctcaccctcctgagtagttggaccacaggtgtgcaccactatatgcccagttaattttttattttttgtaggacagggtcttgctgtgttgcccaggctggtctcaaacccctgggctcaaacgatcctcccacctctgcctcctgaagtgctcgagttacaggtatgagctaccatgcccagcctacaaagattttttgaagtgcccacagcagtattgaacctcatgcttttgcttgggaagaggcctgtgcaagttgtcagagtcctagctgttttgttttgagacagggtcttggtatgttgcacaggctgttcacgaactcctgacctcaaacgatgttcctgcatcagagctggctttttctttctcctccaactgaaaaacaaaccaaacaaaaaaatctggcttttattcctagccatgtcccttggttttgttaaaacttgagtaactcaacctgaattttgactcttcctctggagagtggggtcaataaatgtaaacctgggttgctgtgcagtaatctggtagctgttctgaaagtatgtcaggcctgatggggtggctcacatctgtaatcccagcactttgggaggctgaggcaggaagattgcttgagcccaggagttcaagactagcctgggcaacatagcgagacccggtctctataaaaaataaaattagctgggcgtggtggcactgcctgtggtcccagctactagggaggctgagatgggaggatcaaaaaaacatgaaaatgtgtcatgtggcagctcatgccaggcttcaccagcatgcttatggcaaggttttgggccggcctcttcagcttacaggtgagaaaactgaggcctgaggcagtggaacaatttactcatgtgtatagtgctcttgagcaaggctagagattcacccttggagggttggggccatgctggctgtgcttatttccactggagagcagaactgtgagtggcttgtggggaggagtttttctttggtggaatgttcagccttaacctacccattatgttctagagatggagaaattgaggctcagagagccccaaggactcaaattacatgtgatggagccgagacttgctcctagtcctcctggtgcccttgccctcaccacactgggatggttcatgttggtgacacatgggctgctgagaactgatcgtcagacatgactggaggggcagaagtcagtatggatttggaattctgtgagaattccttttcgaccagttgaataaagtaccattaaagaccgtctattaatactaggccaaggaaatagatttatatagagatcttcaaaatgttgaacacctgctgtgtgctatgcactgtcctgatcctttagctgagagtgagagagaaattttttttttttttttttttgagatggagtctcgccctgtcgcccaggctggagtgcagtggcgtgatctcggctcactgcaagctccgcctcccgggttcacgccattctcctgcctcagcttcctgagtagctgggattacaggcgcctgccaccacgcccggctaattttttgtatttttagtagagacagggtttcattgtgttagccaggatggtcttgatctcctgaactcgtgatccgcccacgttggcctcccaaagtgctgggactacaggcgtgagccaccgcacctggcctgagagacaaaattttgatgaaacgatgttgaggctatcatctaaaacacagcaagggagcacactccatttttgggggtctgtgtgtatttggacattgtagcctggtgaatccttggtcttctggatacacaggtagtgattggatgtgttagtgtttgtcttctgttgttcattttcagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtattgtgttctttgggttgtttttccaactttctcttctgcacttaatctttctcatctccaggcttctttcttactctttctaaatagccctgctatggttcatttttgcagctttacctaaagttagtgattgattcaagtgtgatgtgttgccatttctttttatattcaactcaaatatgtacttcatctgattgaattagtgttaagggacacatgacctttgccttgtataacttctgtttttatgatagtttattatttagttacgatgattgcttgtttcaggatgatttgcagcaagagtgttttatgctaagtttaagttgtaaaaatgtccaagtgaattttattaggcctatgggaagaatggaaaacactggaagtgatcatctttgtcttatgaagcttgggtagataaattgatttttacatggagcggctgatgtaacatattaagaatgtacggccgggcacggtggctcacgcctgtaatcccaacactttgggaggccgaggtgggtggatcacttgaggtcaggagttcgagactagcctgaccaacatggtcaaaccgcgtctctactaaaaatacaaaattagccggacgtggtggtgcacgcctgtaatcccagctactcaggaggctgaggcaggagaatcgctagaacccgggaggtggaggttgcagtgagccgagatcgcgccattgcactctagtctgggcaacaacagcgaaactctgtctcacaaaaaaaaaaagaatgttatatgtccctgatacagagcaaataatggttggtcaacccataaatgtgtttttagaggaatagtaaaagataatgtggtttgaggtttttctgaaagttcttctagagtgaagttggaatttagtttgagcaagttgcgatgtggcgagtgcggagttagaactgagcaagttagtgtcaccctgtgatctgatctgtgcaccctctggaagtgtggcgtctagagtcaggccagactaggccaatgctccagtccaatattgctgaccagtcagcctcttatggccccttggtggtccttgcgtacatgtccccttctggtctctggctggaggcctgagctcctgtgggggcagcgttgctgcccttgctatgagcttatgtctttgtactgccacctgcatggccaaaacaggcttgtcagctggctgtgggagcaggtggctgctaggaatggggtacagaggtgcctccctggcagatgtagatgttagaggggcaggctgaggacgaagaggactctgccgagtcctgggtgcccttgcctgagtcctgccctggcctcctgtcctgtgccatgtgtgctctgcaggagttgtggcagaagagcctatggcctggcttcagctctgtctccatggaggacctttggcatccttggcttgccagaattcggggattcctttccaaggggttgcgggaaccccagggtgtaccccagggcctctagactcggtcagtgtatgaaaaaataaatgctggttgagacagaagctgtctcccctttgtctgaggatggaccttcaagcctctgcagcccgggtgcaggcacacatgggtgtgtgtgaggggctgctaattctttctctgctttctaaaaccaggcatagtctccacacagcaaaccctgtgactcccatgtcatttgtttgtgtggcacacaagcagctcttactgatttcctttttagtgtctggggatatttacttatttatatgatgccatgtttagctgttagcctctcatgcctgtgaaactgaagtagtcttttgaaagtctccttgttcttcctattagggcttattacttttaatttctttttttggggatggaggctcgctccatcacccaaactggagtgcagtggcgcagtcttagctcactgcaacctgtaccttctgggctcaggtgatccttccatctcagcctcctgagtagctgggactacaggtgcgtgccaccacacctggctaatttttgtgttttttttgtagagatggggtttcaccatgttgcccagttggtctcaaactcctgggccccagtgatccgcttgcctcggcctcccaaagtgctgggattacagaaatgagccacagtgccgcagcccaacttatatatcattgcatcttttccctgccttggagttaagtaattcctgtagtctgcaacagcttctctgacattcagatatactgccatttttacttctctctctctctcttttttttttttttttttttttttgagacacagtttcactctgtctcccaggctagagtgcactggcgcgatctcagctcactgcaacctctgcttcctgggttcaaggaattcttgtgtctcagcttcctgagtagctgggattataggtgtgtgccactatgcctggctaatttttgtatttttagtagagatggggtttcaccatattggccaggctggtctcaaacctctgacctcaagtgatctgcccacctcggcctcccaaagtgctgggattacaggcgtgagccaccgtgcccggcctcatctctctttctttgcttgactccgggaccttgcactgtggctaagtgctttcactcttgtgcttatggcaccgttgtgttactctctgcggttgaggctgggactcaggaatcagcctgccagggtctagttagctggctgatcttgataatgaacttaatctcgctaagcttcagtttccctgtatatgaaaatgaggaagatgataccatcaccttcatggaaaggtcttaatgcagtgaccaccggatgctcgtattagcaattgtcattatcctcacttttacttttaaaacctgagtttttattgtttcaactcccattcccctggtttcttctatagctgcttcctgaaaaccttcatgtttgaccagttattaaccctgcagccacctagtgtttggttaattttaatacttttgtatctgtttttaagtgttttcatgtcctcaggtattccctcagttttcaaaacataatgccaaatgggtatacttggattctagctttttttgtgtatgtgtgaaatatttgatctatttttttaatctattttaaaaactttcaagtcaaagtaaaacagcacagcagacacctatcccctcatctagattctccaccttgaaacatcttgttctacctgttgaatctctttttttttttttttttttttttgtgacacagtctcactctgttgccaggctggagtgcagtggcacgattttggcaacctctgcctcctgggttcaagcaattctcctgcctcagtctcccaagtaggtgggactacaggtgcacgccaccacacccagctaatttttgtatttttagtacaaatggggtttcaccatgttggccaggatgatcttgatctcttgaccttgtgatccacccaccttggcctcccaatgggattacaggcatgagtcactgtgcctagcctccatctcttttgttgcatgatggctggtagctttcgtggcactgttacccccaaatacgtcagaacaaggacagtttccttattgactcagcaccagccgcatttcgggaaacatcacatcagtaacaagatctgttgctgtgctaagagcaggtgtagggcgtgtccccagcaggcccctacctgtctttttctgtacttcagggttgagatgcatactcggcatctggtggttgtgcctctttagcttctgctagtctagaacagcactcccaatccccaattcctcatgactgctttagctttctcatgatcagacctaggtcagaaaggccaggttggatctcacagttggaaccttgaaaggtagctttggccctttactaaagatctgtgtacagaagaagggagtgtcctgcaccagcataggctgggcagtggcctgcctcacctcagcagtcggcttctctaggaattattgtgggatgtagagtaggaggcacaagcaaacctacttcagaagactgataatatacttttttgtgtgtgtgaaggcattagagtataaaagatactgtacatttgaaaagcagttcagaaggagtcaagcctgggtagataaccctccaactgaaaggagattcagataatcttaaaagaaaaggggtcaaaggaagtgagcagaacaaagagaagtgagggaaggacagagtgctagtcagaccacatcaggaggagcttatgtgtcagctgacccacccctggtaggcgatgaccaccagagctctctgtggaaaggcacaggtccccattgtcactaatgagggacctgtgggctgtgcttgtagtctgtcccaacagtgtagcttttgttgttgttgttttgagatagggtcttggctctgttgctctgtccaggctagagtacagtggcacaatcatagctcactccaggctcaaactcctgggctcaggtcatcttcttcctgccttggcctcccaaattgttgggattacaagtgtgagccaccatacctgtccccagcagccacggctttagcagtccttgatgattcatcatggacttgttaaatggtaactggctattattgcactttctacattttagttgtcatttttctatgaaaatgagctcctccctaaaaaaaaaagagttatatattttagttcttattttcttaaatcctcacattgtcccaaatttgaccagtgggagttctattaagttcctttaagttgtatgcctttgacatgtccccgtcagcccttgagcacctctttacgttctggtacaacaagatgttccaggctcatcttgtactgtttttcccaccaccccccccaaccctagcatcagccgtttctcagagaaggcctaggttctttgagtacagaatagtatgtaggagcccaggtctggtcgctggttgtgttcattgctctgggagacagagtttgcaagggaaactctgtgcagtaggtctccaagcagtgctgagcccttgctccaagtggagctcttgggtccatttttgattctccaacacttggcctgcagcaccccatgatgagaatgagacagtgagtggtgagtgtcgttgttttggaaggacagggatgtgaagaagagatagctcctgccgtggagtgggctgagcatgggtcctgtgaagccagtacttttatatttttctatcctctattcctatcctttttttttttcttttcctggagatggagtcttgctcactcgtccaggctggagtacagtggtatgatctcggctcactgcaacctccatttcccaggttcaagcgattctcctgtctcagcctcccgagtagctgggattacaggtgcacaccactatgcccagctaatttttgtatttttagtagagctggggtttcaccatgttggccaggctggtctcaacctcctgaccttgtgatccgcccaactcggcctcccaaagtgctgtgattacaggcgtgagtcaccgcgcccggcacccgttaaaaaaaaaaaaaattatttatcatgcttgggatttatggaccagtttgaatccgtgtatcttagtaatatacttaaattttgaaaactgaggtataatatacatgcaaaagtgaacataactcataagctacagctcaatctagattcttttggaaatcaaaatttcctttggaaatcttaagttaatgaaagtcttaatagcattgttgtaatttacagcagcagaacctgtgttagctagtatctaccagggcacctaggtggactagcagcttttaggctcaacctttttttttttcgagacagtctttctctgtcacccaggctggagtgcagtgtcacaatctcggctcactgcaacctctgtctcccaggttcaagtgattctcctgccgcagcctcccgagtagctggcactacaggcatgtgtcaccacacccgactaattttgtatttttgctagagatggggtttcaccatattggccaggctggtcaaggctcaaccttttaagttggaaacagaagataactatatgttttagatattacactcactggtctctttaggtaactgtggtctggaatcaagtaattttctgttgtggagatttttgttgtcaccttttctgtgttatggaagggaatgttaggaattaaccctccttgctttatataggaaaaaaaatgcttctggcattttctaaaaatattgcaggtaatctggctttctcgtgtcttgtgctgtttgatggtattatcttcctactgatttgtttcttgcttgttctattacttgctgagagatgtgttaaaatctcccatgggattgtggatttgctgtttttctacttgtagttctggcagtttctgctttacctattttggggctctggtgccctccagagactgaactgggaaactcaggcatggtcatgcttgtcctttgtttcccagggagctctgtggtctcatgtcgttgtgactttgctcctgtgctccattcttggcttccgcagacacctggccttgtctgcatctttatggcttctcttccctccctggagctttatctctgaggcagccttgtctcttggtggggttcattttgcatgcatggaacttaacaggctccacaaaatctggagagaaactctggcttagttgagcccagagagtcacaaactacctgtagtctaatgggctgtgatggggaaaaaaggaacacagtacaaaattaggtaccaggactgttagtagaagccaggttctcttcgaaggggatgtaggtggggaggtcagtgacttgcatttttatacagatggtgattaatgaacatcagaaattgcataggaagagggccaggtgcagtggctcatgcctataatcccagcactttgggaggccaaggcaggtgggtgacttgaggtcaggagttcgagaccagcctggccaacgtgatgaaaccctgtttctgctaacagtacaaaaattagctgggtgtggtcccaggcgcctgtaatcccagctcctgggaaggctgaggcatgagaatcgcttgagcccaggagacagaggttgcagtgacccgagatcgcagtactgcactccagcctgggcgacagagcgagacgccatctcaaaaaaaaaaaaaaaaaaaagaaaaaaaaaaagaaagaaagaaattgcataggaagggaggattactaataacatagtactgggacaactggttaattattggtaaaataaaaacagtgagatattcacctctcaacttggaccaaaggatagttcctatggattaaagaaacccataaaaatagtagaaaattcggttatgttatccggtttctagatgggaaagaacttcagaatgttacactcatttattttacaaacttgggatcagattacaataatctcttctgctttttttcccacctgacatgtaaggagcatttatctgtgtcattatttataaacatggtttaattttatattgtgtgtgctgttacaggttttctttattataaaaatgctataacatacctgtattcattttcattactaagaaaagttcttacaaagttttaaagtaatggaagaagtcacaaatcccttgacatatccttgaatcttaggtattttcaaatcaaagaagtttgaacacttaaaaacaagtcaaattgtactgaaagattaatagtgaaaaatcatcccctgccttcctctctcctccccagaggtaattatttttatctctttcatcattttcttctacttctaatactttgatttctcatgtagacattttctgttaactttctatcatggaaaatgaagattgaactcttcagccattttctatttctttccccccattctccccatataattaagtcactatttgtaataaatgaaaaataagtgtttacataattttgactatgtaaatatcattcagtgaaaaaccaagttatgttctgtaattgcattttcttgtaaaaccttttgtttcccttggaattaattactgcctttcttttgaaatcatacactatgttgtccatacagccttaatttttttcaagtattcatctcctcatccttaaaactcatccttattatgaagttagtttctcctatttatatatttatatagttattttttctccttaaaaaaaaatgaaaacctgggtttgagtcccatcttccctttctgcttcttggaactcatcttttaaccctccttccttactacttagattttctttctttgtaaaaaagttgttttctctcatcttttcttcccttggagctctctcctagaatcttcctttttcctgcttgattctggtttgctagcactcttaaccttttgcactgcagtaagcttagactttctttaagctgctttccctagttatttacattgttttctgtagttctatgtgggcagcaagccacccaggtgccaaggcaagagactgaaggcacaggctgttccagtataataaagaaaatacttaaaataagaatagttatattagacatagaatatagacatgattatatatgaatattattaatcattagtttgtagcattactctttattcaaatattataacaatctctgttctacaattataacctaggaaaaaccaggtcatacagagataggagctgaagggacacggtgagaagtgaccagaagacgagtgtgagccctctgtcacgcccagacagggccactagagggctccttggactagcggtaacgccagtgcctgggaaggcacctgttacttagccgaccttggtctagcggtagcgccagtgcctgagaaggcacccgttactttgcaaaccaggaaagggagtctccctttccgtgggggagttagagaagactctgctccaccacctcttgtggaaggcctgacatcagtcaagcccacccgcagccatccagaggcctaaccgtctccctgtgatgctgtgcttcagcggtcacgctcctggtccactttcatgttccgccctgtacatctggctccgccttctagatagcaatagcagaattggtgagaatattaaagtctttgatctctctgagaaatgcatagaagaaataatgtaagctgtcccctctctctctctgcctcggctaccaaacagggaagggccccctgtctggtggacacatgactcgcttgaccttacctatcattggagatgactcacactccttaccctgcccccttgccttgtatacaataaataacagcgcagccagacattcagggccactaccagtctccgcatcttggtggtagtggtgtcccctgtgcccagctgtcttttcttcaatctctttgtcttgtgtctttatttctaccatctctcgtctccacacacgaggagaaaaacccacaggccctgtagggctgatccctacagttctatgctgtgttctttcttggttaagttttcttttttcctggaggctatttttggtatcttaagacagtttgtatgggaagtaaatttgagtccttgcagttcagagtatgctacttttgtttttgtgaggtggagtcttgctttgtcgcccaggctagagttcagtggcgggatctcagcttgctgcaacctctgccacttgggttcaagtgattctcgtgcctcagcctcccgagtagctgggactacaggtgtgtgccaccgtgcccagctcatttttgtatttttagtagagatggggttttgctatgtcggccaggctggtctcgaacttctgacctcaagtattctacccgccttggcctcctaaagtgctgagattacatgtgtgagccactgcacccagcccagagtatgctactttttttttgagatggagccttgctctgttgccaggctggagtgcggtggcacgatcttggcttattgcagtctccacctcctgggttcaagtgattctcccgcctcagcctcctgagtagctgggactacgggcacacgccaccatgcctgactaattttttgtgttttagtagagacagggcttcaccatgttggccaggctggtctcgaactcttgatctgaggtgatctgcccaccttggcctcccgaagtgctgggattacaggcgtgagccactgtgcctggcccagagtatgctacttttctatcttcacacttgattgatggtttgactgggtgtagaattttatgttgagaagaattcccctaggaattttgaaggtattactccatttccttctagcatccagagtttttggccattcttcacataatttgctattcttcacataccttgctattctatttcttgttccattaacttggaggctggcctttcacccaacccccagcagcttgaatttcagcagggtgtgccctgctgtggatgttgcagtgggacacttaggactgttttagttggagacttgattttgggtttattcttggagcttctctgtttctccagaaagcctattatttgggtatcaaacctcctagattgatcttacaggttgctatggaaataggtatttttcatcttaatttttttcttctttctgggagatttcttatcttccaagctttcttgttgaattttttctttttttctcttttttttttttttttttttttgagacggagtctggctctgttgcccaggctggagtgcagtggcgcagtctcggctcactgcaagctccgcctcctgggttcacaccattctcctgcctcagcctcctgtgtagctgaggctacaggcgcccaccaccatgcctggctaatttttgtatatttagtagaaatgggatttcaccgtgttagccaggatggtctcgatttcctgacctcgtggtccgcctgcctcggcctcccaaagtgctgggattacaggcttgagccactgcacccggcctgaattttattttcatagttgtattttagaatttcaaatatctctttgtttttctgtgttctcttttcatagcacacagggtttctctgttgggtatcttctcttcccttgccttatgtctgtggccctgcagagggccattcatttctgtgtgttttggattcattcatactggatgcttccctgggtccaggggttccttggtgctgggctcgtgtttaagagcacgacacttagagctgcctgcaaccatgggtggggaggcttggttatccaccctcctttgcattagagggtctgattggccattgaccacttaattgggggaatctccagaagactcactggagaggtttttcctctggagcacttcaggtcttcaggaaatatcctttgattcatctgggccagtgttctgcatgaggggacagggagtggtaactgcccccaccctgtgccagggagatccccctccctcctctcacctggcacagagatctgaccttttaacctgcttacctgtattcaccttctcatttgacttcagtggaatctggtacctcctttcttttattttgggcccgtctctttctttcctcatccccctggctgcactgtgggacgtggcttcttcctctcagctaagagtaagactagtgggcatctgtggggttactctgtggtctgagctgctctctgaggccactgatgctcctgtcactctagcactgtgagataggggggtagctagctggtaggtagcagggctgggatttgaacccaggttgtgtgatgtccgtatactgcctccttcactgcctctctcactcctttcttgcacatgtcctcttgtcttatttggtatctttttaagagggaataaaggagtgcatttagtcagctagctagcttttttctttttcttttttttcctttctttttttgtttttgagacagggtctagctctgtcacccaggctggagagcagtggtatgatcttggctcactgcaacatgtgcctcccaggctcacgccatcctctcacctcagcctccagagtagctgggactacaggtgcacaccaccacacccggctaatttttgcatttttcgtagagatgggcttttgccatgttgcccaggctggtctcgaaatcctgagctcaatctccctgcctcggcctcccaaagtggtgggattacaggcgtgagggactgcgcctggcctggttggctttctttcccattcaattttgaaccttatctgagtctcttgtaagttaattagtttccctctttggcatgtggcatggaagggataagaagtatagaatttgttttgaggttaacaggctcagacaacaccaagggaaacaactgcaaaatagcagtagatttgactagtttcatcccagattctaactttcattctctaacattttattttaaaaactaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaaggtgatagatgacccttcagtctacttttagaccagaaatttaatttttattctttaagttaacttatttttgttttgaacttatacttgctcgaaatattgtaatggcttaacaatctctttcattgttgacttttgcccaaggatgccatgttacaatatgataaagttcttttagagacacaactgatttttttttgctcatttgatgactctcagagataacttgttttagaatttatatatacacatatatgtacgtatatatgtgtatacacacacacagacagagggattaatgtaatgtgataggaattgatttctggtttaaagaaacaataaaggtattatgttgggctgaattctaaaattggtttttaaaagtttttatttctattattttttaaaatttttttgagatggagtttcactcttgtcgcccaggctggagtgtaatggcatgatcttggctcattgcatcctctgcccctccgggttcaagcgattctcctgcctcagcctcccaagtagctggaattacaggtgcctgccaccacgcctggctaatttttgtatttttagtggagacagggtttcaccaggttggccagactggtcttggactcctgacctcaggtgatgtgtctgcctcagcctccacaggtgctgggattacaggtgggaaccaccacgctggccaagttttttatttctaaaattatgtgaaaatgtaaaagtattcttttttttttttttttttttgagacagggtcttgctctgtcaccccaggctagagtgcagtggcgtggtctcgggttactgcatccgctgcctcccagttcaagtgattctcatgtctcagcctccctagtagctgggaccacaggcatgcactaccatgcctggcttatcttttgtattttagtagagatggggttttgccatgttgaccaggctggtcttaaactcctggcctcaagtgatccatctgccttgacacccataagtgctggaattataggcatgaatcatgtgcctaggaaaagtagttaacttttatgtttgtgtagtgaaacttacagtgtctcttttttttttcccagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtcagtactaagttgtgtttcatgctagcaagtttcagaatttgaggaacatcccttcagtgcagaatcatctgtttctcagcattatcaggagactctaacatgagccttgcatagattttagatctaataaataagtattagggaacagccattctgacccttgagggaaaagatactcgacttgcactctggggtcttaaaatatccttcctaatgtggataagaagataccgagaacaggccaggcacagtggctcatgcctgtaatttcagtactttgggaggccaaggcgggaggattgcttcagctcaggagtttgagaccagcctgggcaacatggtgaaaccccatctctacaaaaattagccgggtgtggtggcacatgcctgtagtcccagctgcttgggagactgagacaggaggatcccttgagtcctggaggcaggaggatcccttgagtcctgaaggtggggtttgcagtgagtcgtgatggcatcactgcaccgtagcctgggtgacagcagagcgagactgtgtctcaaaaaaaaaaaaaaaaaaaaactagcacagagggaagtgggtctcaacaggctgcgctttgcttgaagcgtgtggtcatgtccttaacgtgtgactccaggttagcactttctccagcagtctgttctgaagcttccagtgcaggatatgctcatctgtaaagctcattgtgtccactggcactgagggtgttgatttatttccctgacatttaaaagggtagcaatgtgattaagacatttatataattttcttaattgtttgcataaaatgcacagtctgttagtacataataaaggctgtaaagaactgaaggagttgggttccccacttcccacttttggttatgttacttggagtggatcatattctcatgcttaaaaggctttttttaagtgttcattttaattttacttccataggaattttccattcagtagtctaaatctatgtggtgattaaaggtatcaaaaacaatagtgttggccaggcacagtggctcacacctgtaatcccaacactttgggaagctgaggcgggtggatcatgaggtcaggaatttgagactatcctggccaacatgatgaaaccccgtctctactaaaaatacaaaaaaaaattagctgggcatggtgacgcgtgcttgtaatcccagcttctcaggaggctgaggcaggaaaattgcttgaaccagggagtcggaggttgcagtgagccaagattacaccactgcactccagcctggcgacagaatgagacgccgtctcaaaaaaaaaggaaaaaaagtctgtcttcaaaaaattttccatgaatctttaaccagcatgtattttgtggcaggcagtgtggcacaataaggagccatgagtagttcaggcagagatgcataaatgggtgactgtgagtattctaataaatctactggacatgatttttttgtccctatatgggatctggaaattctgccagagaaaggcatttgagtgatgccttcaagagtggctgggcgtggtggctcccgcctgtaatctcagcacattgggaggctaaggtgggcagatcacctgaggttaggagtttgaggctagtctggcctacatggtgaaaccttgtctctactaaaaatacaagaattagctgggcatggtggtgtgcgcttgtaatcccagctactcaggaggctgaggcaggagaatcacttgaaccgggaggccacagtgagctgaaatcatgccgctgcactccagcctgggtaatccttagggcttttctcaggaatgcaagggtgatttgatgttagaaagctattattgtgacttactgtgtaatgctcatctccatagagggagaaaaggcatttgataaaattcattgctttttttaattaagtaaacaccctgtatttatggggtatatgtgatatttggtacgtgcattaaagttcattgctttttctccttgggaggttgaggtgggaggattgcttgagcccaggagtgttgaggttgcagtgagctgtgattgtgccacagctttccagcttaggtgacagagtgagactctgtctcataaaaagaaaagaaaggccgagtgtggcagctcacacctgtcatcccagcactttgggagggtgaggcaggaggattgcttgagcccatgagtttgagaccagcctgggcaacatgaaaccctgtctctaaaaaaaaaaaaattttttttaattagccagatgtgatggcatgtgcctgtagtctcaactactcaggaggttgaggcaagaggattgctcgagtccagaagtttaaggctgtggtgaaccatgatcatgccattgcactctagtctgggccacagagtgagaccctgtcttaaacaaaaaaattattgcttattgataaaaggttagtaaaccaggaataaaagggaacttcctaaatctgtttaaggatatgtatcagaagctttcatcaaggatattacacatgaaactttagaagcattctccttaggccaggcatggtggctcacacctgtaatcccagcacttggggaggctgaggcgggtagatcacttgaggtcaggaattcaagaccagcctggccaacatggtgaaaccccgtctctaccaaaattataaaaaataagctgggcatggtggcgtgcgcctgtacttccggctatgtgggaggctgaggcaggagaattacttgaacccaagaggtggaggttgcagtgagccaagatcgtgccactgcactccagcctggcgacagagcgagactccgtctcaaattaaaaaaaaaaagcattctctttaaaatcatgaacgagggccaggcacaatggctcatatctgtaatcctagcattttgggaggctgagacaggtggatcaatgaaagctgggagtttgagaccagcatggccaacatggtgaaaccccgtctctactaaaaatacaaaattttaccagctgtggtggcgagcgcctgtaatcccagctacttgagaggttgagaaaggagaatcggttgaacctgggagacggaggttgcagcgagccaaaatcacgccaatgcactccagcctgggcaacacagcaagactctgtctcaaaaaaaaaaaaaaaaaaagaataagacaggaaaccatttttcaccatttaataaacgttgtacggaaaatagtagccaatattaggccgggcgcggtggctcacgcctgtaatcccaacactttggaggccgaggtgggtggattacttgaggttaggagttccagaccagcctggccaacatggtgaaatcccatctctactagaaatgaaaaaattagccaggcgtggtgatgcgcgcttgtaatcccagctactcaggaggccgaggcaagagaattgctggaacctggaggcagaggttgccgtgagctgagatcacactactgcactgcagcctagacaatagaatgagtcttcgtctccaagaaaatactagccagtattataaaggaataaataaagctgtcattgtttgcagaagtctatgtagaaaactcaagagaatgtacagaaaatcttttagaattaatagagttcaccaggatataaaattaacatacaagtgcagcatcaaagaggaaatgtaatgttaaaaaagataccattgataatagaaaccaaaatgtcaggtactgcggaatcaatattacgaaatatgcatgtaactttagagaaaaataactgatattttagcagacctcaataaagatgtatttatatataggaagattcaagcttctgaagttgtcaattctccctttaataatctataaattcagtataattctaataaaacttccaacaggaatttatttgccctttgtaagtggatgctgctgtggccacatttgaagagaggcttggcctgaggatttgctctaccagataggaagttatcttatttaaaatagcagtatttggccaggtgtggtggcttacgcctgtaatcccagcactttgggaggtcaaggcaggcggatcaccggaggtcaggagctccagactagcctggccaacatgatgaaaccttatctctactaaaaatatagaaattagttgggcatggtggcaggcgcctgtaatcccagctactcgggaggctgaggctggagaattgcttgaacctgataggcggaggttgcagtgagctgggattgtgccattgtactccagcctgggtgacagaacaagattctgtctcataaaaaataaaatagcagtattcacgcagggcagtgatatggcccaagacggggcccagaacaggctctcgagcatgtggacatggatgggaaagcgctgcaggccagttgcgtgggaggtctgcactggacgtggtgctgggaccactgtgatttatgaacttggccagcatgggagaggagctttgtcaccatgggagagggaaggatttcttaaataagccaaactaataacaggctataaaggctataaaactatgtatgttaaaatgaaaatctaggccaggcatggtgactcacgcctgtaatcccagtactttgggaggctgaagcgggaggattgcttgagccactgcaccacttcagcctgggtgacagagaccctggctcaaaaaaaaaaaaaaaaaaaaaattcttatgtgtcaaggacaccatcgacacagtgaaaggacaaattctgtaaagagccgaaacaattctgaaggagaagggcaagtttcttggagagccagtaagtgcatgaagagatgctgctcaactgcggccatgcccaggaagctgtatgttacgatcctggtgggatggtccttcacagtcatccttcacagtcatcaggtgagcagacatcaaactcagaacagccagggattgagaagatgagcaacagtgggactcctcatacaatgctggtgaaacatcatttattacacctgttttgagagaaatttggcaagatctagtgaaattgaagatgtgcctttttttctcttacagttttactcctagatatttaccctagagtaattttgcccttgcacgcagagagaccacagtgtccaaaaccaaaaagctacccagtgacagactatggtatgttcctacagtgtaactacacatcaattaaagtgaactcattggatgtcaaagcagaaacaaattgctgaagggtatgcagattctatcacttgtgtagtttgaaaagggccacatacccacaactgagtttaacttatccctttctctgcgtccatctaaaaagtgtaagtgggcagctgtgaaggtatgtgcctctctccaggagccaagaggtctatccaggcaggagccattaacacctggtggagtagctgtggtcattgttggatataaaatgatacaaagcaggccaggcgcaaggtgggaggatcacttgaatccaggagtttgagaccagcctgggcaacatagcaagatcttatctctaccaaaaataaaaataaaataaaatggtataaagtaatcagcaatgtgtgtacagccaccgtttcaggcatgttgggggagggtgcagtggcaagctctgaatggacactccagtgtttgacagctaggcctgcgcagggttggtgaggtgctgtatgctcttgggccctggaagcagggtaaggcggtgtcgggtgggaaccgccccgtcagccactctggtatgttgctcggctgtgtctctacaacctgttcactagtttggaattgtgaaaaaaatgggtacctgagaattgaagccactgtccaaagaccaccctattggctttttgggacccaaattgatctcagatggtccttctagtgctaagaaatgtgctaaaaatgaaagtctggattggcactatactaaaagtaatataaaaccaaactgaaggtatacagttaaaactgagttctgggcagagtgcagtggctcacacctgtaatcccagcaccttgggaggccgaggagggtaggatgcttgaggttggtagtttgagaacagcctgggcaacacagtgagactctcatctctacaaaaaaaaaaacaaaacaaaacaagaaaattaacggggcatgatggtgcacacttgtagtcttagttactcaggaagctgaggcaggaggaccacttgagcctggaaggtcgaggctgcagtgagccatcattgcgccactgcactccagtttggatgacagagcgagaccctgtcaaagcaaaaactacaaaaaattgagctctgtgttaatgtccaacactctgccctgcccacccctggttcctgatgtaaggcccatggggcctcccttccctcccctggactctggctgggtggttttgaagaattttctgttatcggaaaagcaatgactattaggatgctctttaactgttctgtaataagcaattctaaacttgaggaagctcctccctgcttccatctgtaacctaggtctttctacattgttttttatttttcgggagtgctggtgcacacaaggatggtttttgttggcttgtcagttaaccaatggccaacccttgagggatagagtcaggtggaacttccttgctgctttctgtgccttccttttctagggtccctagatgtaaggctgacttcaggactttttgttgctacttgctgactctttagaggtcattttctttttctttctttttttttttttttttttttttttttgagatggagttttgctttgtcacccaggctggagtgcgaaggcgccacctcggcccactgcaacctcctccccccgggttcaagcgattctcctgcctcagcctcccgagttgctgagaccacaggcacatgccaccacatccggctaatttttgtatttttagtagagatggggtttcattatgttggccaggctggtcttgaactcctgacctcaggtgatccacccgccttggcctcccaaagtcctgggattacaggcctgagccactgcacccagcctagaggtcactttctagcttcctttctccgtactagtgaagaaatgtacttctttttatatatctatatatatatatttttttgtttgtttgtttgtttgtttgtttttgtttttgtttttgagacagggtcttactctgtcgcccaggctggagtgcagtggtgcaatcatggcttgccacagccttgacctccctaggctcaagtgattctcccacctcagcctccctagtagctgggactacagccatgtgccaccacgcctggctaacttttctattttttatagggatgaggtcttgctatgttgcccaatctggactcaaactcctggccttaagcgatcctcctacctcagcctcccacagtgctgggattacagacatgagccagtgcacctggccggctccagtatgagcagcattttcactagcaggctttttgggcctgaatttttttttttttttttttttttaagacgtagtctcgcactgttgccaggctggagtgcagaggcatgatctcggctcactgcaacctccgtctcccaggttcaaacgattctcctgactcagcctcccgagtagctgggattacaggtgcccaccaccacgcccagctaatttttgtatttttagtagagccagggtttcaccatgttggccaggctggtctcaaactcctgacctcgtgatccgcctgcctcagcctcccaaagtgctgcgattacaggtgtgagccaccgtgcctggtttggcttgaatttttaattttttttatttttatttttgagacagggtctcactctgttgcccaggctggattgcagtggcacaatcacagctcactgcaacctccgccttccgggttcaagcgatcctcccccctcagccttcctagtagctgggactactggtgcacgccaccacacccagctaattgttgtatttttagtagagacagggtttcaccatattggctaggctggtctcaaacacctgacctcaggtgatctgcccacctcggcctccctaagtgctgggattataggtgtgagccattgcaccagcctgagtttttaatttttaaaggcttttctacctttcctgatcctaatttttacacatccattagattggaaccagtgctttatgtcagttctttttacatgccttggtattagttatctattgttgcataacatgttacctcaaaacttagtggctgaaaacaacaacatgcatttactgtctcacagtttctgtgggccaggaatttggcaaccgcttagcttagtggttctgccttagggtctcttgaagttgcatttaagatgttacctggggctacatcatcctaaggcttgactgatgctggaggatctgcttccagggtaccttctctcactcatgctgctggcaggaggcctcggtccttcaccatgtggccctctccacagggctgctggtgtgtcctcacaacatgatgggggctggctttctccagagtaagtgatccaagaaagagcaaggtggatatcttttatgccctacacttggagtcatatgcaaccatttctgcactatgttattgactacgccgtaagcagtagtgggggcttgagctctaggaggcagggctcacagaggggttgggggtcgtcttggagggtggatacctaaacattcttcgctgaatcctgaaagcaaaagaaaactctaaaaagatgttggggggagcacagtgcagtgcctcatgcctgtaatcccagcactttgggaggccatggcgggcagatcacttgaggtcaggagttcgagaccagcctggcccacatggtgaaacccccatctctactaaaaatacaaaaagtagccaggtgtggtggtgcatgcctataatcccagctactcaggaggctaaggtgggagaatcgcttgaacccaggaggcagaggttgcagtgagctgagatcacgtcactgcactccagcctgggccacaatgagactcttatctcagaaaaaaaaaaaaaaaaaaaaaaaaaaaaaagccttttggggagcagcaagtttaaggagggggattttatcttgaggactctatttgggggagtctccaattacgttggcaatgttttagtcagctgtgggattgtggaaatttggttttccatgtttttttggtatgttttaaatttttatttatttttgagacagaatcttactgtttcccaggctggaatgcagtggtgcaatcataggtcactgcagccctgagctccaaggctgcagtgatgcttccacctccacttcccaagtagctgtgactacaggcacttgccaccatacccaactaatttaaaaataatttctttttttttttttttcaaacacgatctttctctgttgcctaggctggtctcaaactcctggcctcaagtgatcttcccacttaggcctccgaaaatgttgggattataggcatgagccatgtgtccagcttgttttttgatatgttaagaataaagaagtggccactattgagtgcttatcacatgtcagataccttgccagtatgttattgtacaaaagtatatctagtactcctcagaatcaccttataaggtaaatataaattatctctgctttatagctggctaacctgagcttaaaagttgtaaggtttcagtgagatgatgcagtcaggaagtaggagaattgggacctgaccctaattgtgtgtgagcatgcgcttttgtgtttttagaactcgtaaccatcataccatacagtttcaccgtgaagctcggagacgttaatgaggagtcattgctctgttaacctcagatgatgatgacactttcctggcttccccgcagaagccgtctgtggtggctgtcttgtgaggcgtggtggctgtcttgtgaggcgaggtggctgcagggcgcttgtgactctgctttgacgaagcagtaaaggacactgttagcattcatcctaactgggggctctggagtcatggtgggtgatggggtgccaggggcagaggtgggtgggagggcagcaggcccgtgaaggaatgtgctgtgtttgaggaggtgagaggcagatgtgttgtggatccgaagccctgtgcagaaacttccactggttgaagagctgaggcccttggagcttgaagagttgggagtgagtgggctcatggagtgagtcatggcagcaatcagggtagggcctgctgggttgggaggggtgtggcaggagtaggcatatgcagggctggggacagggaccccacagggaacactggtggagtgctgggggtcagagccagacccagaactgcagaaggtgtcctcaaggtgggaggtcccaggcagttaggctgggggtgtctgcaggttgtctagagaggtggtgggtgggcattggtgggtgttggtgtccaggccagggtgaggacaagagggagtggagcacatgactcatccaggcaacaagagggcaacaagagcctcccatggtggggccatgggaggctataagaagccgtctgtggtgactgtcttgggaggaggggtttgggtttgggggcagaggttacctgtattggctgggcaggtggtaggtccaggtggtaatggtaaccaaccaacattaacctgatggttccttaccactgccaggtggagtgttactgcccccgtttcacagagtggaggcagagacagtgccttcacttgccgaagtccacagaactacccagtagaggagccagcatcagagctggttggtgccgagccagtcagcagactttccaaagggctggtgagcagtgagggctctgttctgactgctcagctctgctgttgtggcaggaagacagccatgggcagcatgggaacaaatgcatggggctgacatccagtaaaactttgtgggcactgttgtttgaatttcctgtaatttttgtgtcatgaaatattatgatgtttttcagacattgaacagaaacaggtggtgggttacacctggctggctggcattagtgtgtcagccctgtgccctgctctcgagatccgtggctctcggacttggggacacattagcaacccctgggaaacctttaactcactgaggccagacccggtgggttgggttgatcttgggtgggacctaagcaccataggatttcaaacccccaggttattaccaggtggagcgaagtccccaggatcagacttcggtgtgtctgcggatcatcctagagaccttgtgaaagtgcagattcctggtaggcaggttggggtggggcccgggagtctgcatttctagcatgctccgggtgctgatgctggcagccctggtgtggctggagggtagggaagcctcgtcttttggctgtgcaaggttgtctccgtgtgctggcctgggctgtgacagaagccagctcgcactccttggtgtgtgccttcacccctgcccagggcctgtacctgaaagacgagggtaggtgctgcccagtgaggacactgagctgagcccacctccatgttcaggggcagcgttcctgtggcactggctctacagctaatttttcaggggtgcctagaggctgggtcttaagtgagttagtggttttggaaaagtatatatatatttttatcatttatcatttccaacatttacagaagtagagttgaattgttttcactggcactattctaatttatgagttttcattgagtcacagcatcagttaagcactacttttctttgaagcttttatggacatagttccacgatgtgggaataaaaatgcgacacactaagttctaaagggccgtgcatttgatttcatgcaaaacaaaacccaatgagttttacggatttaacttctcattgcaccttctcccgttcccacaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaaacatagcattatgctgatgtcctctgcttgggttgatgtgtgtagtgtagcaagctgagctctgatcttggaaccgtagggaagtgtgtccactctccctgtttctgacccgtggggtttgggccagcggtccaagtgcgtgtggtcacagtaaaaacagcttctgccatctgcgtttactggcttatgagagctattcaatgtagtgccttctggcctgtggctcccttgctctcctacccaagttgagcagccactgtggtcactgctgctgatggggctgtgtgaagagaggacacaagaaggaaggggagggaaggtcgtctcttggattccaggcttacatgatgtggtagggtcagccttcaggcctgtgacttccgaggaggcagcacttttcttgcttctgagagcaatcctcctggtttcggctgtagtctgcaccttacaggggtccggagtgtgggcagctcctggcttgtttgcctgagagctcatagggcaagaagggtgactggactgaccttgaattcaggtatcctttggtccttcctaggccttcggcttaaaaaaaccaaaagtgctagtttgctttgggcagtggcaagaggagggagagctgacattgtaagatttgaagatgtgtaacagtggttagatttgtgataaatatgtgcttggatgtaaattgtggaaaactgagatttgaatgtaaaaataactgacatattagggtatcaatttaaaattaaaaaaaaaagtactgtatatctgaagagtcatcattgaggagctttggagagtccaaacataaagtgtttcaagactcacctaaagggaagtcggggcccagaagcgaaagggtctggccacatgtgcctgctgtcacctttctctttctcagatgttttcatcttgatttaggtgtttctagatctcttcatcagctatctcattaatcttgaatttgttcaacttcctcagtgttcattgcaaatactataatttagaatagcaaggatatttaggacttgtatattttctttaaaagaaaatatacctcactctatcagtacactaaatttagagacgtgttcctttaaatgactggcttattaaaaatgagcagctcttctgaagccagatcagctaccccgaagtgtaagcataattgatgtgtatatttgctgagtgcttagtggaagaagtgacagtgagttctgccacagtgtgtgtcaggtgttgcaggtcttgggtgcctttaatctgctttaggtaccctggtgctaacaactaggatggcgcaccacatcattgtcacgcgcccatgacctcagtgttagaaatctacacagatgtctgggcacggtggctcacacctgtaatcccagcactttgggaggccaaggtgggtggatcacttgaggccaggaattcaagaccagcctggccaacatggtgaaaccccatctctactaaaaatacaaaaaaattagccaggcctggtggtgcatgcctgtaatcccagctactcgggaggctgaggcacgagaatctcttgaacccgggaggcagaggttgcagtgaggcaagatcacgccactgcactccagccttggcgccagagcaagagtcaatctccaaaaaaaaaaaaaaaaaaaaattccagcccggcgcagtggctcccgcctgtaatcccagcactttgggaggccgaggtgggcagatcacctgaggtcgggagtttgagaccagcctgaccagcatggagaaaccccatctctactaaaaatacaaaattagccaggcgtggtggcacatgcctgtaatcccagctacttgggaggctgaggcaggagaatcgcttgaacctgggaggcggagattgcagtgagccgagatcgtgccattggattccagccaatggaatggccaacaggagcgaaactccatctcaaaaaaaatgaaaatccatacagatgcccctgttgcttgtttctgtaagaagcggctgctgcctcatcctggatgaatggagaggtgctcaggaggtgctgtgtcgaggatgtgctgtgtcaaggacctcgcctgtgggaaagcgaggcgcggggctggctttgtgctcacgaacgggtgttctgaaggcagacctgcctgaggggggcctcgagagtttggctggctgtgccatgtggtgcctatgcttggcagtgcctgagcaggtcctgctgccgagcattccacgggcttcttccccagactgcctttgcaccagcctgcagtggtgtggccaggagtgggcttcacgagggctgcttgcctggcccccatcacaccaggctggaactgcagctggtgagggcccccacgctttggctgctgactcttcttgcgcattgggctcaggcctagacctgaggtgaggctctgtgaatgcattggcagcagggcacggacacttacttgtacctctgcctgaggccttgctggaccctgtggagctgagcactcttttgctggtgtctcctgtcccaacagtagtgaggcttgagggtgacagcgtccttcagggcaacagtgtccttctgcaagatgttttttttctttgagttggagtcttgctctgtcgcccaggcggctggagtgcagtggcgcgatctcggctcactgcaagctccgcctggcgggttcatgccattctcctacctcagcctcccgagtagctgggactacaggcgcccgccaccatgaccagctaatttttttttttgtatttttagtagagacggggtttcactctgttagccaggatggtctcgatctcctgacctcgtgatccacccacctcggcctcccagagtgctgggattacaggtgtgagccaccgcgcccggccctgcaagatgttttatgaagagtccattaataaaaaccctgaacccctccgtaaagcagtcatgcaaatgataatattggatttatatttaaaataaacattggcatgttgaaattaatcatctctgtagaatttgcacttacaccttaccgtcttaggttgatattgtttggatgccttaggtcttggattaactgctattcctgggaacacctaacacatggaacagctgagcaaacatggaggaagcccttaatttgcatatataaatgttgtgttactacttaacatgtttaaggaaatgtttaaaaagtagcaagttgtttttttttttaagttcaacttaaattccacaagtctttgaatgttagtaaggaaaagattttttttttgtttttcgttttttttttagacagagtttcgttcttgttgcccaggctggagtgcaatggcacaatctcggctcactgcaacctccacctcctgggttcaagcgattcttctgcctcagcctcctgtgtagctgagattacagacatgtgccaccatgcctggctaattttgtatttttagtagagatggggttcctccatgttggtcaggctggtctcaaactcccgacctcaggtgatccgcccacctcagcctcccaaagtattgggattacaggcatgagccaccatgcccggcctaggaaaagatttttttaaaatactgggctatcaggaggcagaggttgcagtgagctgagattgtgccattacactccagcctgagctacaagagcgaaactccatctcaaaaataaataaatagataaaatactgggttatatttaaatttaatgctttaatacattaaattataattataaggccaggcgcggtggctcacgcctgtaatcccagcactttgggaggccgaggcaggcggatcacgaggacaggagttcgagaccagcctgaccaacatggtgaaaacccatctttactaaaaatataaaaattagctgggcgtggtggcacgtgcctgtaatcccagctactcaggaggctgaggcaggaggatggcttgaacccacgaggcggaggttgcagtgagctgagattgtgccactgccctccagcctgggtgacagagcgagactccatcttaaaaaaaaaaaaaaaaaaaaaaaaaaaaaaatatatatatatatatatatatatatatataaaaaacagataaaacagatgctaatataatccctaaggttagatatagtcaccagtttttttgttgtaaagagatttgatctgtaagacataagccctggaaatcagcagggttacaggaaacccatcatgggctggatctgtatgttgaatgccctgggtaggttctcacagtgcttcaaatgcagcttttggagtggttttcatgtacattttccccattccccattccaaggtaatgtaaatgggaaaaaaagaaaccacacaaagaggatacaggaccctacagaagatgctgaagctgaggacacacccaggaaaagactcaggacggacaagcacagtcttcggaaggtaattgtgttccaggtttgcttgacctgtcagagtgtatgctctgtgactcttggtgccactgtttccctgcatgggagcacacatgagatgcaggtgtcagtgcacccagctccttccaggctggtattcagcagaaggcttgcatttcttacagaaccccattgagaaaggctgcttgcaggttcttaccctccaggggtgttatcacagaaaccgatggtgtgttgctctgcaagaaaacagacatccaaatgctttgagtaatacttgttttttagattggacaaaattgtcactaaaaataacctctttggccgggtgtggtggcttacgtctctaatcccagcactttgggaggccgaggcaggtggattgcttgaggtcaggagttcgagaccagcctggccaagatggtaataccccgtctctactaaaaatacaaaaaattagctgggcatggtggcgtgcacctgtaatcccagctactcaagaggctgaggcaggagaattgcttgaacctgacaggcagaggttgctgtgagctgagatcatgccactgcactccagcctgggcgacacagcaagattctgtctcaaaaaaaaacaaacaaaaaaacccccaaacaccataacctctctatagggcttattattcaggatgtaagtaatgaactggcatcaaagtccattagagatatgtgttacatgtcaataaaaagtcaacagttcattaaaggcaatgaacctagattttatttagtttattagtaattcatgttattgtttactgaatgggaatactaaacaggctgtgcaggaaaagtgcagcatagatacaaagccagccccgggtccttgtgctcctcgcttactgccagcatgtgtccagggacagagtttgcctggtacctgcaggggagtgaaaccaaccaaggaaacaccgggttattctgtctagcgtatggtgcccatgcatgtagaagacgtgagcccttttcctagtgtatgaagtggtgccattcatttcaactgtctcagatgtccggttaactttttcatgaactgagactttaattagactttgtactttgtttgaatttctattttattcgataatagttctggccgggtgtggtagctcacacctgtaatcccagcactttgggaggctgaggcaggtggatcacctgaggtcaggagatcaagaccagtctggccaacatggtgaaaccccatctctactaataatacaaaaattagtcgggtgtggtggtgcatgcctgtaatctcagctactcgggatgaggcaggagaatcacttgaacctgggaggcggaggttgcagtgagctgagattgcgccactgcactccagcctgggtgacagaaggagactccatctcaaaaaaaaaaaaaaaaaaaaaagttctgacagagtagttgtatatttgtgattttgagtaaagcttcatcctgtttttcactgatctgagttaaaatgctctttttatttcaaagaatggaaaatacatctcacatattgctaaggtgtaaatatgtggacaccatatcatttaccttatttctttaaacttgtatttgtagttgagaggagcaggcaggccctgcgccatttttctggcccacagaacattcttctggggcacctgccataggtgaggttgttgagtgatcaagtgttcagcagtaagctaggtcagattcacctgtagtcactaaggtttgtagttaccaggaagcctgcacttaacatttgctctggtcacctaattttttttttttttgagagggagtctcacttcgtcacccaggctggagtgcagtggtgcaatcttcactcactgcaacctccgcctcctcgattcaagtgattctcctgcctcagactcccgagtagctgggattacaggtgcgtgccaccatgtccagctaatttttttgtatttttagtagagatggggtttcaccatgttggccaggctggtctcaaactcctgacctcaagtgatccgcccacctccacctcccaaagtgctgggattacaggtgtgagccactgcggctggccaggttaccttctattaaagcagccctttgctggcaatcatactgaaactggttgttttgaaatatttgtgtaaatgttatacctaaaaaatacatgaccctagacactcagaataccaaaattcacattaagtggctagtaatgttttattagctcctatctcaggagatagcacatgataaaaagaagtaatggtgtcttgtctcttcagatttgggttttataaacctgagccaaaccacatatgacacccaatgtgcactgagcacttctgacatgctaggcactgtcccaagtgcattctcctgtcgccttgtccatgatcctctggattccacctcaccgcatcctgtctcactggctctggttccaggcaggtgggtgagatggagtatgagtgcaggagtggcaagtcattccctgggcagcgctgctctagtgctatggggacaggacagttttcagccacacctttcagaatctcagcccttgagaaaagcttcatgatcccttctcccatttcttgcttttctcagttgtgacatgttttactgatgatctttgttcattaggtgtatctggtgtttgtctaaaaattggaaatcctcagtatagtgatactagtaatgttggtcctgacttagcagggctgagtctaacttgattgggcacctcttgaatggaaggatccatttttctcatgttcatcctctgctttgggttcagtggagagtctaggtgcatgttcaataagactcgtatcaggtgtcttaaccacatgactgcagcgggtcttggcgtggccccacccacctcgccctcctgacagatgcgagagcgggaggtgcgaagaaagaatcagtccagattgtgaaaaaagtctgagattgggcaaccatggatgacttatgtgtggaacacatttccaaaggaagaagtttctgccacgaaacttttcagcaacctgtgttcattcacatgaggagattttttttcctttcttttccttttgttgttctttttctttttttttcctttttttcttttcttttttttttctttctttttttttttttttttttttttttaaataatagagagacacaatcactgacaaaacggccagaacaagctcttacaaggccatggaggcagcctcctcgctcaagagccaggcaggtaatgtggtcagcgccctttccttcttggcttctgggtgcccaggctgggctgggtgggtgggctgagagtgtgaaaggggaaggctggggctggtgaaggggaacagggcaggggaggaatccacaattaagctaggagtgaaaaagaaggaaaggaggttctcctgtggttgaaaactaaactgttttaatgtgtatgttattttgaagggtttggctaaattttattgaagttactttttacttggctctattatttgcaatttaaaattttactagaaaagtgatttcaaccagaagttttcaggtttcttacttgatggtgccagttgctactgtaaattctgtcacccttcagtaccctgaccctctgcatgtaagctaacagtaagggctcgttatttatatttcacatgctaaagaaactagcttaaaacctttatgaaaaataattgtcaaaaaaataagaggggaaattacacttccttttaccttttagttatctttttgaaatacctgtttgatcccttattgaagaagtcataccttctccaactcttaattaaaaggaaaacaaaaccctggggaggagagtggcaatggctctgtttttcttgttttgcatgaggtgcttgactggcttttaaaaatcagttaaacagactttaaaaaaaaaaaaagacatgagcaattggacatttgaacgctagctgatgatataagagcattgttacttttaagtgtgggagtagcattgtggttatatgtaagactttatgtttagagatttgtgctaaacttcttatggatgaaatgatatgtctgggatttgcttcagaataatctggcagggggacgtggaaccaggtatggatagagccacgctggccccaggttgatgtttttgggggccaagtagcgaggacatggggttcattgtacagtttgtctgcttttgtttatgttcagatttttccatgatagaaagttaagccagaaggacaaaggaattcagaagattcatctttagaacttcacttatttgaggggtaatttttaagcagtaaaaagatcaagggtttatgatttgaaactttacaaaccaaaattattttacagcaacgaaaaatctgtctgatgcatgtaaaccactgaagaagcgaaatcgggcttccacggcagcatcttcagctcttgggtttagcaaaagttcatctccttctgcatccttaactgagaatgaggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtaagataactaatcaaggccatttaatccgtcacattcatctcataatagaaacacgttcatattccagtggtcaatgtagatttcaagttgaaaggcagtccctttagttgggggctgtccagagctgcagcagggctttgcacggaaggggtggccctgttagagttgcttctcctctagtttgtaacttactggacttttgtggaaaatatcagcgtcgctaccctcagaaacaaactaacagcacacgttaggaggagtcctcatcagctgttctcattgccagtgagatatattcagtattgtagatactacactaatttccaacataagaggcaggaagagttttgattctatccttttttactaaacagttttattatgacactagatacagtaaatttttagaaaaaaataccatttacagtattattgtgaaccatttaacccttttgatccaaggccccggaccaaggggatactgtaatcaggttatgtacaccaacctctgcatcagttgcttctatagagcatcagccctcatgtttcattgtcttaatgtcggggagcagcctggtgtcctgccccaggtgtccgcatttttgcatggtaaggaaaaggcttacttgcccttcagctcataaaagcagaaggtgtgctattcacagtaccatgcgagtagcccacagttaattcccggcagattctttggctgtgttttatctttaatgaacgtttctgactaatattttgttgtaaaccattaagtaatgtaacgcatgtaagatgcttagggtgcctggccaggactccgtggtttcctgttgtgacagtaataatggttataataataaaaatgataaaattgccatcattctatttttatccaaaagtataaattttgctttggcatgaaaagtggtcctcttgactgcattatgcatgcgaggatgaaataaacctagaagtggcagaacactggatttgtgtgtgtggcgctttagggtgctggactgtatggctgagggctggttgggttcctctattggctctgctcaaatgttgcaggatacatagccccaaagatggtctaggagcaatctaagctgtgttactccaaaggacatgaaaaagctcaagagtaaaattaaaattctcaaaaaaaaaccccacgaaatttaaagatggggaaaaaaagatggtataaaaatggctctggttcaataagcagtcacccaaagtaaagactctatcttgaaaggcttttggtgaaaatgaagggatttcatttgaaattacagcatgatgaattttgcatgggtggccagccagctagcccataactgatagatgcattagaagtcagccagcgcataggtgctccctctatattatggagaaagcaaaaccctgcaaatgaccaaatggtgtccaaagagcagcatgacattggcatcagctgaataaccaggggcacatgggggaacgtggatgggaatgatagtgtatctcagcggggggtggggtgacatcgttccctggggacattgggaaggtgggcaggggcaagtgaactcagcactctgcagtgagagggacagtcccatgtgtggcagcattgtcccacttcagatgccaggagtgggctcatcctagaggagcggagttttccgagaggaccatctcctggtttcctgaaggaggtgggtggaaacggctcttgtttgaaagaacttagggaggaccattggcttgccaagagtacagaaattcattatgctgctaatttaacgtggaattccttcatttcataagaacctcaaaataatggtgatacattctagccttaagacatttgaattgccggttgttgaggtgaattttgtttgtcatacatggaaccattttagtcccatttgactcacttcagaccatcttccacacactatgtctgtgcttggagaggggaggtggctctccagtgtaaaacttgaggcattcactagaggtgaaaacttgtcagaatatataaaagcttagattgtagctgttctaaaaacgtaagtactccattgtaatagggtggcatcttcaggtagtgcacatattggcaatagaggtcctgaattgtttttctaagactgatctgagagccattgggccatcaagcctttatatatctgcttctaaaattgccccacctgctctagatggatctttgggcctttcctcagtgttcatgcaaaaattaaatgtcttttttcagcatactgactccaggtgtagttacatctcagtgctgtcttgagtatatattttatctcttatacctgtatctcccaactagaaacagctccagtgtttttaagagaatgtttcttaaaaccaataggaaacttaagcgaggtttcatgacacaacctttcatgtcgtgaaaggcagagggtgactgtgtgtgatgtgcagagtccttggacaggagtcgggggctcctctgtcccactgctgcttcttgagtgggtggagtggtgcttagaggatctccgagaggtccccgcagctctagggagatctgattttgtgttttttgtttaagtacttcacacagaagcctaggtagatttaaaatggggtgctcagggactggggaacaagacggggtggggtggggagatgggcatttggagagtctcatgtagctggagacgttaagagctgagcacaccacaggaaaggagggaggatgctgtgtgagagccatgctgtcaggagcaagcttgctgctcctgtgctgccctggccctggccttgcttgcccatggtgtgtgtgtccagaggtgtgtgtgaggctgccagaacaagtgctgggtctgtcacagagaagtttaaaaaagaaaactaagattataaattagcatctagttccaaaaccaaaaaaagtgcctgtggatgtatataaaattaagatgataagaaagtgctcctgagaaggctcttgccagaagcctgatgtgagtgtgtggcacctgtgatggcagggctgtgagctgggcttctgtcctcctctgtgtcccggcatggaagccagtataagcatttccaaatgagggaaaagtccttggctcgtttgatccagttgagttgaaagggttgccttggcagcagaggctcctctgatggctgacatcagtcactgcgtctgggcctgagacgtgcatggagggctgtaaagccacggattcccctcgctggagaggctcctgtctgatagcggtagatgaaaaataaggtcgttatgactttggcaacttgcttcatttctttttcatttgacttacaacacacttctctaacatctagcccttttaaatttttaattaatttcaaagcttcctctggccaggtagacttttgtatacagaccaggtgagagcccttttgccttagtgtgaaaatgtaacattttatgcttttaaaatcaatagattcatcaccttagttttttaaaaaaaatctataaatagggtaattgctgaggtgtgcggtttatctttgagatgataaagctaaattatagtcttttgccagagaaactgaggtaactgtcattagaaaaggtttcttaaaatactcacaaagctgttattggcttcttaacttctaaaatttggggggtcttgcatttatttattatttatttatttatttatttagagacagagtctcaccctgttggccaggctggagtgcagtaagtggcacaatctcggctcactgcaacctccgcctccttggttccagcaattcttctgcctcagcctcccgagtagctgggactacaagcggctgccaccacacctggctatttttttttgtatttttagtagagacagggtttcgccatattggccaggctggtcttgaactcctgacctcgtgatccacccgcctcaccctcccaaaatgctgggattacaggcgtaagccactgcacctggcggggtcttgcttattttaaaagaaatattctgattcatattttaggactttttgtcaacgaaattggttttgatccctttgggtaccatttttattgttttatgtagaatgttagaaattaccactaatttacctggcagtgatgtcaaattgactgtaattagcaggtagaaaattatttgtattatattcatctgattcctatactggatgagcaaggagcatgcttcctttgggacattcttacagcagggtgtctctccaacagcccgacaggcctcatctttttggttggatacctttgaactccatggttacgtgttaggtccacatttgtgtttttttctagcctacctatagttgttggcctttttgcatataactctcgggtaatattttgaagcatgctgaccatccaggcatatagtattttcaagaaatgactgaggtaggggtgggggtcctggtccggctgatgggggtttgctcagcactgtgccagtggaagcaggtgtattgtgggcagttttgtcattgtcctcaagtccttcgcagacagtgcacagcctgctgtctgcagtcggccagaccaggctcctccccagcacactccctgtgggatggccgctgctcaggacacagtgggacaaagttgggttgataggatattttagattcattttacctttgacaagggcaggccttgaattgggagcagcagccacctggcctcactctggccacaggtgacacttggtccttgctgccacctgcttggggctatgtggctacggctacacaaaagcctgtgcaggttagaagacgactgtggtgtgcagtggtgctctgggagtggagacttcctctgttctcagagactcacccccagccctgaccctagaatttagggatagccaggaagtttctagtttgtgtaacctagaagggtcactttaataaaaattgttatgaactatagtattttagatgatgagtgacttattttaattccactttaacattttactgtgctgttaacttggaagacctgtttgaaattagtcttgatttcacactcatttaatctgctgagcacagggctgttgtcatttgtaaacgcaaacactgtggaggtacttctcgccatcagcttccttctttacaaaaccatcatttcaacatgaaaattatgtcagtttatagaaatatttattgttcaaggtctgtaattgtatttcaaaaacgatgtcgtattcaagttgtgaagggatttgttttgtcaaaaaattaaaaactcaatgtgtatgacgccactctgaagagtaggtgagcgctttgcagtcacagaaggtggcatctgactgcggctcatacaggtcaccctgaagggccacgtgcttttagcagttggctggaatgtgttcactaggttccgttatgtttggtaatatcatcttgaaaagtccctgtaatagatcaaggagactgcattccctgccctgaaggaatgtatttctaaggcaaataggcaacttggtactatcttattctgagtagagagtggagaaagtattttcagactgaagaaaactttgaaaagtcaggagctaagctgctcggagctcagtgccgcagcatggctgtggtggacgcgggaaacaacgggaaagttcttgacagagtctgtgtccgctcagtccctgcacttttcctttccaaatgcatctcgttggatatggaatagatcgtagatgttgtagactgagatttgggactatgttgggaccgtacaggtgaatgtgccacctccacaaatggcttctccgagtgagtcacgtcacctggtgcgtggaggtggagcctgcggctggagtaaggcttgctgtgggacgccctcgtactttgctctccttgcgggtggttgccgagccgagagcattggatcctccccgactgtggctagttgtctgtccggtggctgggagggggtgtggtgggaaaaagtcggaatctctgcaatctgtgtcatggactgtactattgtaaggtctatattctgtatgtgggtcccagaccctgatcaggaaatgagcctcatgtgtgtcgttaacatttatatatttccattcaaaatatgtattcagtgtttatttcctcaaaacagactttgttaatgtaggaaatctctccaagtggaaacgtgctaactttttctgtaaatctgaaataaaaggtgctgttccttcctctgacccaggactgctttgtgttttctgtctttctctccatgcattttttttctcatttttaaagctttttaagtttgttccaccacgttaagggaagagcatgggttggtggatagcgctggggctctctcccctgagccatgcagaaggcccctttctctgggccttggttcccccatcagatgggtcagcttgggcgactgtgtgggtgactctctgagtggggccccagacagtgtggccactgcttccccatgccctgtgctcccctggctccccctccagtctcatctcagaagtgctcaggtctccactgctgagtccatatctgatgcgcttgttaaattggaggtttgaactcagagcacgtcaagtggccctttgtgggtgttaaagaacaggatgtgcgctgtggctcttgcagggccctcctggcagcctcacagtgacagagccttaaagtgtgcactgctctgattagtgttcatgacgctagtccatcttcctggaaaaggtgaggaaaccaagattaagaggctgcgttttctttagactttgtgctgtcaggagatgtatctagtgagaagagaagagtggctcacatctgtcaccacccacagtcaccagtcagaggcgacggaagcccttggaaaaagcccactctggctgggtgcggtggctcatgcctgtaatcccagcactttgggaggccaaggcgggtggatcacgaggtcaggagttcaagaccagcctggccaacatggtgaaaccccatctctactaaaaatacaaaaaatttagccggacttgttggcaggtgcctgtaatacccagctactcaggagactgaggcaggagaatcacttgaacccaggaggcggagtttgcagtgagctgagattgtaccactgcactccagcctgggcgacagagcaagactctgtctcgagaaaaaaaaaaaaaaagcccactctaacactactctgaagtcagcaaacacttctgtgttagtttttaatttgtttttcttccaccgctccctgcaatgtcagctaaatgtggaaaagctcactgataaggtcacaggattggtcaagagtccctggtggggttggcttttattttttaatatggcccaattccaatttctgacttcgtgttcattggcaaacagcaagccgataacataattacttgtttttgtgatgattgaggtgtacaggaaatgtagtttatgcttttgctctgtttcatctccaaaattcagtgttcaacacttatttacctaacatcaaataaaaaccaaattttttaaacacttgatttgacagacaagaagattctctattttattcatttaaatatttgttgatgttgcttgtcaggtgagggtgaaatgctgtgtatgtgagggtgaggctgaggctgtattcagcctggtcttcagtgatttctattaaatgaaggggagagagaggcagaagagatacaacctgcgagcaattccactcgctcagggattccatgcctttatcccaggccttttacctagactcagatgtgaatcaagtaggtagattttaccttgcctttgcccacctcacttctctggtggggagaacaagtgaactgtgaaatatcaggacaaataggcaatgggaggaagaagagaaaccgaacggtcagcctgtggtgtgagtccggaagactctcctgactctgcacccccgcgtaggcacatacttctgaaaggacgcgtggtctccaccccggcggcagctggactgcacggtcacctgatgaggctgacacttacttcatctgtggttcctttacacattcgtttggtgttagcatgtttctcccaccttagagtagtagaacctgaacagactaggtaagaagggccaagattcttgttccaaaaagcctgtcttagttcacctactagagcaaattggatgttcataacacttccttcattttaaggaatatgcctcttatatgcatatatatgctaaatactaggtagaataaagtccgtttttgaattttctacatagcctaattgacgggttatattatcacaaaaaccagttgatgatggttccactgtgaaatcactggcggtacaggaccagtgctgagaaagactggtgggtggtggggtggggcgggacgagcctgcctgcagggcatggccacccgctgtgttctgcgactagtgaactgtcatccgcctccttcatctctaggtctcggacagcccgggagacgagccctcggagtccccatacgaaagtgcagacgaaacacaaactgaagtatctgtctcatccaaaaagtctgagcgaggagtgactgccaaaaaggagtatgtgtgccaggtgaggagaaggcagcatccgctatgtccgtgctggtgtctgactggggccccggtacgcagagcgaatttgtagtgtcttttcccttcccaccagaccccttccccaatctcaccgtcactcactcatctctgttttgaaggggtcagactgactctcagtggaatcctgggattgagttgtctccattaacatccataattcacatgtaggatgagatttgtatacacatcatgtatccacacacacacacacacacacacacacacacacacacacacacacacacacacacacacacacacacacacaaagttcctgttggaaaaggtgaggtgctaggcctgttttagcttcactgatgacatgcacactggacaggccaggctgtgggctgagggggccatcactagacctgtgtgtgcccacaggaccccagccaggccacctacactctgtgcttcagtcccgccccatctgtcagctggagatggcatgggagcttccatgccaggcagtcgatgcatgggaagtgtgaatactgcctgccgtcagcgtggcacctgccatctggattagggtgcctttgatttctgttgattttcaaatctgatttgaaatatcttggatgtatccttcagggttgtgatcctgttacttcctttgccattgctgaggactggcctctttctgtaacagtcatctggttttaatctgattctgtatttgtacgttctgtttgggccagacgtttgcccatgcatgttattatatatccttgagtagcaaaatgggattttctgccactggagacagaagcagacggcttcccttgtgggtaagaggtgcagaagggactgccgggcgctgcttacccgcctgctctgcccccgcagctgtgtgagaagccgggcagcctcctgctctgtgaaggaccctgctgcggagctttccacctcgcctgccttgggctttcccggaggccagaagggaggttcacctgcagcgagtgtgcctcaggcaagttcccacgggcgggcagctctgcagcctggccggccacctgctcctgcaaccccctgcaccaagtcctgccctgagctgcctgcagaggacaagccccctccccacccccaccgcctggccctctctggagcttgtagcccacagctggcaggtgtacccacctctcagtagctgcagggtttgctctgatttcagtcgtatgtgcccccttggtacctttccatcaggtggcgggcagggtggcgggatgacaggtcatgggcttttcatcccgtgggctggcctgagcctgtgctatgtgtgaggcggccaccacagggcactgccgctcagacagtgcagcattaagggtacaggtaacctggttggtcaccgaacactgaagtccataggaacatggagttctttatgaagacacagtgtcaccttgagcctcagtttcaacagaaagaacagctccaggcttgtcctgggttgtcagtgctgttgttctgcctccatgttactgcatcaggtgtcgcccggcacagtctggggtctgtgaggatgatgagaggacacctgcacagccgtggcccttcctgcctactcaccgggcccaaggagtctcctatctcacgtcagaacacttcctgggtcaggaagacacctggagagtctcccaggccatggcagccccacagcagcacctcacttatgggagtgtctgtctgcctgcccagaatgataagtgactgctccaccactggccagctgctctcaaggaggaaaggcctcttttcataggagccccttctttcaagcttcttgccagttagactgggcctccccagccaggctgcctagtaagattctcctgtatttcaggtgaagctggagctcagatcgcagcaaggtaatccttgatggctggatctttttgctggagaatgcttggactagtgagcaaggttggaaacagggccaggtgctttagcagcgtggctgcctctgaagaggagttgcttgattttagtggctcagaactgcaatttaattcttgttctttgcacctctctctccaccccttctttaactttttgttagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtacaggtgcacctgcgcagccttgctgtgggttcagatgcaggccagacgcaggcccatgggcgcttgggaaggtgggctgttgggattgtcaccaaagagcattaattatcttgagtgactaactggacatcggctgggttgggttttctttgacaaaggacctgtctcccttttccttctttccatcctaaatatcaccctaaagatgcttaactataggagaggggcaacctttggaccatttgatagattttgtttaccctggcttttttttttttctttatagagatagagtcttgctctgttacccaggctggagtgcagtgcagtcacagctcactgcatccttgacctcctgggctcaagctgtcctctcgggctcaagctgtcctcctgcctcagcctcctgagtagctggaactacaggcacatgccaccacacctggctgatttttgtaaatttttttttttttggagaaaaaaaatctccctctgttgcccaggctggagtgcagtggcacgatctcagctcactgcaacctctgcctcccaggttcaagcgatcctcctgcctcatcccttcagtagctgggattacaggcacgtgccaccatacctacctaatttttgtatttttagtagagacggggtttcatcatgttggtcaggctggtcttgaactcctgacctcaggtgatccacccgcctcagcctcccaaagtgctgggattacaggtatgagccaccacgccttgccaatttttgtatttttttgtagagatgaggtttcaccatgttgcccaggctggtcttgaactattaggccactgctctgacctcttttcttttttttgagacagggtctccttccgttgctcaagctagaatgcagtggtgtgatcatggctcactgtagccttgacctcccaggctcaggtgatcctcccacctaagcctctcaagtagctgtgaccacgacgcctggctaattttgtttatttttttgtagagacgaggtctcactgttgtgttgcccaagctggtcttcaactcttgggttcaaagaatcctcccacctgagcctcccaaagtgttgggattacaggcatgagccaccacacccagcctgtttgctctggttttaatggcccattatatgtaagaaaacatctttaaatcaaattacatttggattttctaatgttaggtgtgtgggatgagggtggcaggttttctgtacttcttgacaccagtggttctttatcgggcaattttgtcctccaggggacatttggcaatgtctggggatattttggggatgtgctcctggcatctagtgagtagaggccagggatgctgctccacactgcacaatgcccaggtcggctgcccacgtgccccaggtgcctgcagtgcccaggctgagacacgcggcattttagatgtatgaccattttctcaaacatggttttgaagcacctttgctctgaaagctttttttaaatcaaatacctccatttcattttagcattaacttttcaaattcatggaggctgagtaattattagttgctcttttcactatgactggagtcagtgtttggggtccttagggtgtgtttctttgccttcaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggtgaggggcctgggggtgtctgcggcacacgcctctcacactcccaggagccacatatcaaggcaggctcattccttgtctgcgctgtgttcattgatgttgacagtgttctgtgcgtcttcacgttaatagtatatcacagtagctctaaattaattgtaatcatttcgcaaacatacaggaaattatttgtggtgaaaatgacatttgctctcgtgctgatgtacagatcgctgttttaaaactgatgtttataagttaaggctgtaataagtgtagactgtgaagcactgaatctgggctgagccatagcagacaggctaagcctggccgcctcgccctcctcttgcaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacaggtgtgagacatagaatcgtatgcttttatgtcttttctgttcacatgtgttcgctttacagtacttaaagtattgaaattattatcgctgtctctgaggagtctgtgaatcctgtttttaatatttataatagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacggtacggagatattcagatagagagtgagacagcactctcgtgcattttcttacccctaatttctattttttaaaatttgatctttatagaaaatactggactaagcattcaatctgtttttttaaattaggaaaatgtttgcagtctggtttatttgttgagcatagaataagatacactgataacttttgtaacattggtttgtgattaatttcattaaaattctgtaaacctattattcagaaattatttttagtactaatttacagaaatgttccatggcttgcctttatgtaaaatgcagatctgaaggaagggtcctgttgtctcgaccttgtgcagcaggctcttgggggctcgctttacctttcagtgcatgaggaatcaggggtggtcaagcagacaaggtgcttggcctctgattccccagctggggtgggaggcaggagcaacgatgtggcatggctggctgatgacccacgtttgagggaggcaggatggggatgtgacccttcactggaggaactggaggaactggtatttatgatcggtcaagagagaatgaggccagtagagaaaacccgaggtgtgtgcatgtggctcgttcagggagaagcacacgctgtgttgcagccgggtcagtgctggctcctgtgtgactgcaggcggggacccgcgtatttaaagcttggttagctccatgctgccagaagctttgcaggctgcactgagtggtaggagtgcatggtgggcattcagagatctcataaagaatgggtaggcattgaaagattttaaaaaattattaagagggcgagacgaaattgagaggtggacttatgtgtttgctgcgactgtcggcaaagtctcctaactgtggatgcaggtgtcctgtagagccagaaacctttgtggctgacttggggctgcaaaaacagggcagaccacaggacacgtctagggttgacatggggctggcctccttcttgggacggattgtaggggtgtgtgtttcctcggttcttgcttgagcctatggttaatctctcagaaccccttttgtttcgagaggagctcagctgcatgtttttttgtttttgtttttttttttttgagactgagtcttgctctgttgcccaggctggagtgcaatggtgtgatctcggctcactgcaacctccacctcctgggttcaagcaattctcctgcctcagtctcccaagtagctgggaccatacgcacctgccatcatgcctggctaatttttttttttttttttgtagagaatggggtttcagcatgttggccaggctggtcttgaactcctgacctcaggtgatccgcctgcctcggcctcccaaagtgcttcgattacaggcgtgagccactgcacccggcctcaggtgcatttttattttctgtctgagaacagcaagtcccaggctttgaccctggtgctttgtccttaggccatagtggaggacagggagctcccgacagaactctgccctgggcctgtcttgtagagaggtgatggctgttctctgagcactcctttgcctcacacacttggccgcatttaaaaatacctgcccactgacagttgttcatagactctagttttatgggaaccagaaactatacttaacattgaaagtttagagtgaactataaaaatatggagcttgaaaggtagttacctgtatttactaaaatctttactcctatttcattgactttttagcactgcaagaagctgaagctcgttttcgtgaaattaagcttcagagggaagcccgagaaacacaggagagcgagcgcaagcccccaccatacaagcacatcaaggtggcgtgtgggagctgcgtgcacgcgtgtggagggagtcttccccgagggccgtgagaggttcttaggcacacccaggctatggctggggagaggactgtcaccagccaggatctgtggtgcctggcatggatggccacacaagagaccatgagcaaatggcatggggggatctgcatgggggttcttggatccgccttggagtgtgaggcttggcttggtagcttagagaagggttggggtgacagtcctgaccgggctgcttggagcaggaggagctgagggatgagcctcccacctgcaccaggctgttgccaagtgctgggagtcagtcacatacggccagggctcagtgactgagccccaaacacgtagatcctgtacctcagagagcaagatggcggggcggcaggggagcttgccagttctgtgtttattccagtgagctcgagagccccagcaggaggaagtgcagccagggcagggctctgtgagagctccaggcccctcagggctgcctgcgctcagagctggtgcggcaagccgcatccccaggagcctcgtggccgttcctgacgagtgtttgtgataagtgtgtgccggaggtcaggtgctctgcctttgcttgtaaaatgtgggctgcagtcaatatctttgtatgtaaagaaagtgctctgtattcatctttatataatattttctttgggatggattcccagaaacagaatcacagggtcagagagtatgaaatgtttagattcttggggaatattcccagattgttctccaaaatgtacagtttgtcataccacagcagtgaaaagagtgtctttcgccacctcttccctaagattatgcatttctaccccagctgattttcagctgtctctactgctttgttatttggttgcttgtctttcactaatagtaaaccacaaggtcatgagagcagaggctatgccctcctgcctagcactgctcctcctggggtggactcccatgtggcttgctgctggtgcttggtaaaggaagagtcagagagatgggtcgggaagctgctcagaagagctcttaccagcgtttgctggacaccctgcagtgtactaagcaatcaacacgctttttctctcttcatcttacaatggcctggctggatacgtgtcagctcttgttcatcagcgatgtgcacagacactaagataaaataatgtgagggggcgttgtgttgccctgcctgcctcttgtgctaagaaggcagaggagagctcctctgggatctggggagggctgttctgagtagtgtgtcctagccaggactctgaagctttctaaaaggccacctggaggctgggtaaggagaggcagtggtgggtatgcaagggtattcggaaggctctcatgtgtggaccaagacagcttactccttccctgcaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaaggtatgtgtcgttatcccctcccctgcttttgagaaattacggttcactgggtaattaggcctaggtttgcttgtggtggttttgtagtcatgtgagaatggtattttttggaaaaaaaattttttttgtttttgttttgagacagggtctcactctgtcatctaggctggagggcagtggcatgattgtagttcactgcagcctcagaatcctgggctcaagccatcctcccaccttagcttcccaagcagctgggactacaggcgtgtttgaccatgccctaataattttatttttttttggagatggggtcttgctgtgttgcccaggctcatttcgaactcctggccccaaaccatcctcctgcctaggcctcccaaagcaatgggattttaggcaagagcctctgtgcctgacctgaaatatttttttgaattgaattattacaattgaatattttaaaatgttacatgaaaggtatctgctataactcacacattcccttaaaacatgccttatgtcagaattctgatggttatttttatgaaatggaagatctgtgaagtgacccactttcctctgggctagtagccaggtgcttgggagcactcaccagcaggcgtaaggagattgctcttgtgaggggtggtcctggcacagtctaggaccaagtcgttggtagacaccaggacagttgacctcctgcctctgctcccagactgtgtcccaaggacatccagggactgagagacatgtagaactgctgaccctgatgtattttggcatgacccaggtccataccagggctgacccagcacagagagttcataagcctggtgccagttccagcaacagcacaaaaggttgcttagaaacacctccccagcacccttgttcctcgcctgcctgactgctgattcacccagactcttgctttacatcctgtcagatactttgtagccattttctctgttgtggggatcaccgtgtaaagtgggttatgtagaagcttggttatcagacagcgctcctgagacaaggtcgtgtaggaagcaagggttggcatattgccacttcgtgaatacttaatacatttttcattggcaacctttacatacagatatgtctgagatcctttgaatttaatttatggagactttgtacacgccctccacggaggtatgctgatgtgtgtggtgcccgttctaagtgatcatgatggggagtcttgagccccgacactgaggattggtcagcacgctttttgtcatggccacatgcttgtgatttccagggagaatttgttaacgagtacgttggggagctgatcgacgaggaggagtgcatggcgagaatcaagcacgcacacgagaacgacatcacccacttctacatgctcactatagacaaggtaatgcggaactccactgtgagcttctgcagtgtgctggacctggagccctgatggtcacctgtagaactggactttgccctgtggcagcgccagcatttgtctccttagctgcttattttcaaacatctgcacattttcttctgaggtgcagcgtgtctttcagctgcgccggagggctagagctaaccacctctcagcacccaggcaccctgaggttctgcttgtccgggtgtgcatgcagagcgttcccagcagccttagtacagggcagggaagtagagaggacacagatgaggaagtctcagcatcttcttttgtttttaaaaagtgattgtattttattttttaattttcagtgctctttgggtaaggtctcagcatcttctctgttgtgtagcagaatcgtttttgcttggttgttgcttgtatgcagcccatatttctaaccattttggaacctaggtgctagagggatcaatgttctgaggaaaaggaggataggaagatttgtgtaaaagtgggcatggataaaagacagtacatctggagtgctcagctctgggcctgatgcccaatcctgacaggtgttgccgggcccttccagggcggctccttcaatggccacagccctgtgggggtgcgtgtcatcccttccctcacacggcaggcttttggcttctggatgacttcagctggggaagtgtggcctccttagtgcctgagtggtctttgaaaggaagggagatagaatacatgtttctgccttttgttgcccttaagctcatcatctagcaggaaagtctggctatttttaaaagagtagattaatagtagtgcttgaaaaccagatagaaaatgatcaccgataaaaaaatgttgaacaattcatggaagacagatgtgatgagacctagagagaaagggctgctatggaaataagaatggttccaggaaccttgtcaggtggcccctggggaagctatatcccctacccctgcagtagtggggcagcagtggccagtggagcctgctccgggggagcactgggctctgtgtcaatcacaggtcgtggggcttacacctttcaaagaagtcagtgtcatgaaggacaaaaagaatcctgggttaaaagagactaaagaagtacccagaggaggtgtgtgcttcttgatcagagcctgaatctgggatgaggagctataaagtatgcttttgggggcagtgggaaaaattttaatttggacaggaggctgttcttcatgctaaatttcataggtatggaaagtgttgtggctgcgcaagagaatgacttgtgatgtgtttagggtcagatgtcagatattcgtaacttactttcaaaggatcgggaaaaaatttgtgtgtgtatacatatatccataaatagaaaaagcaaatgtggtaaaacgttaatactgaatgagtgaagggtatactgatgttcgttatagtattcttccatttttttcttaggtttgaaatttttttactcctaggttttgttgttatttttcttttttgagacagggtctctatcacccagggtggagtgcagtagcacagtcatagttcactgcagcctcgatctcctgggcctaagcaatcctctcaccttggcctcctgagtatctgggactacaggaacatgccaccacacctggctgatgaaatttttttaaataaaagaattgtcttgaaatagccctagagctagagaggtgggtagcgcttcctcctacatgctctgtcagggcgcaccacccaggggataagctagcagcacattcctctcagggccctgtcaacacaggtcttctctaggaggtgggctctggcataccctatgacattggaacagggattctgaagtgcaaaatgaacagaaaaccaagaatacacaacgagagagaaagaacaagccccagtgactcttcagcaacaccctcataggatgacagataaggggcctgagcttgctaagtaaataggaaagctttgcagggctggagcaaaaaggcaagatgggaagcaggtccataagggcgagagtgggtttgtacacagcgcctctaggaccatggcgtgtagagcaggcaggagcttgtgttttaaccctcatgtggggaccagtgataagtcttgctcaaaggcttggtggccaactggagttgagtaccctgtgtagacccctgggagggttttagccctagggaagggactaataaacttgccccaagaggcagcaaatatgcttctctgttgtatctggggaggagggcagggaggttatttgttagacatcgaagccctaggtctgtgccttatgttttggagtctaaatgtaaactacttatgtgctgtaagaaatgccaagtggatactgcagtttgcttttgattagtaaaaaagaaatgccaggttgagcatttaatccacaagttggttcctgacatggtaatccacctgaggtacctgattgaggcaaagataaagcctgtgacacatgagagacatttaagcaattcatacctcatatatttcctatgaaaacaaaaaacaagctgggcacagtggcccacgcctgtaatcccagcactttggaaggccgagttgggagggtcacttgaagccaggagtttgagaccagcctgggtaacacagaccctcatctctacaaaaaagaaaaaaaattagccgtgcctgtgattccagctactcaggaggctgaggcaggaggactgcttgagcccaggagtttaagactgctgtgaactatgatcatgtcaatatattccagcctgggggacggaatgggaacccggtctctaaacaaaacaaaaatttgaaaaggagccctacttaaacgtttacaaagcgcaatagaaggtgaccctcgtgagcagaccttcctaatggaaggctttgcttttagcgaggacctgaggtaacaagactacatttaaaggagaatgtgaactaagtgtattagaaatggttaaagccatgaatagagctttagacgccacaagaaaagaatgagatatggagggtaaatcagacaaatacgaacaaacagcagcggaggttaaaatagagtcattgagaggatcctgggataatggcagagcaggaagctgtgtccccacctagaccacagttgcaccagaaggacctgtctgatgtaaccattttggaactctggaagctactgaaggcttgcaacttccaggggaggcttggatggcaaattggggttaattttggtttcagctcttggcacagcagcggctacccatgccccacagacagccatgcacatgttcttggagcacctcgcacacagcttgaggggttcagggtgagcaagaaggatccttttctccaaatagtgggtatctgtgctcaggatccctgattgctgcttctgatcacagaggtgcagacaaagaggtgcgctgcgctgccgttgttatcacacctccctcagtcgttacaagcccctccccctccagctgaagtatcttcaagagtatttaaagggccagcaccaattgcccccctctttcatttttctctttttccccttttgggagccagacattaaaagactaggaaattcaaaaacaactatggggaaaataagaaaatttagaaaattagacagtgactgcatgctcagggaaaggtacagctcaaaaaagatctggaaagaccttaaatttccatcttgggttgatcctctgcacagaaacagcctgcaacaatcaaaacaagaacaataaataaaaataacaaaaacagcaaacctagggcaaggggaggaagaatctaatttctagagttaccacattattagacttaacatgtccagtgttcagcaaaaaaaaaaaaaaaaaaaaaaaaagcctacaaagagacaggaaaatatggccatttaaagggaaaacaaaatcagcagaaactatccctaaaagaaaggccagatgatagatctactagacagagactctaaaacatctgccttaaagatgctgagaaaactaaaggaaaacctgcagaaagtcaagaaaatcatgcatgaacaaaatggcagtatcaatgaagagatagaaaacctataaagagaaacaaacaaaaaaaggaattgttgagcctgagaaacagaaaagaagattgaagaaaagtgaacggatcataaggggtatgtgggctaccaccaagcagaccaatatatctattgtgggagtcccagatggtgaagagagaaagaggcagagacaactttgaaaaaataatggctgaaaaattcccaggtttgatgaaacacacaaatataaacatctaaagaagctcaataaactccagatgatcaaactttcgaaaaccagaaaaagaatcttgaaaaccgcaagaggaaagctactcattacatgcaaggtgtattagtctatttttacactgctctagagatactacccaagactgggtaatttataaaggaaagaggtttaattgatgactcacagttccacataacaggggaggcctcaagaaacttaccatcacggtgaaggtgaagggtacctttgcacatggcggcaggagagagaagtgtgtgagagcccaggaaaaactaccatttataaaaccatcagatcttgagagaactcactcactgtcatgagatggcatggaggaaaccctcccataatccagtcacttcccaccaggttcctcccttaacacctgaggattacaattcaagatgcgatttgggtggggacacaaagctaaatcatatcacaagggattctcaatgagattatcagcaaatttctcatcaggaattttgaaggcctacaggcagtgggccaatgctaaaagaagaaaaaaaaatgttaaccaagacttgtatgcagtaaaactgtctttcaaagataagggtgaaattaagacattcccagataaacaaaagctgaagaagttttttagcactagacctgccttgcaagtaatggtcaagagaggtaatggagagaagtcttgtaggttgaaatgaaaggataccatacagtcactacaagttgtatgaagaagaaagatctcaaagtaaatacatggtcagctataaaagtttgtattgttgtaaccgtggtttataactccatttgtttgtttgttgtctgcatgattgaagagacgtacatttagggctgggcatggtggctcacgcctgtaattccagcgctttgggaggctgagatgggtggatcaccaggtcaggagatcgagatcatcctggttaacacggtgaaaccccatctctactaaaaatacaaaaaaattagccgggcgtggtggcaggcgcctgtaatcccagctactagggaggctgaggcaggagaatggcgtgaacccgggaggcggaacttgcagtgagccaagatcgtgccagtgcactccagcctgggtgacagagcaagactctgtctcaaaaaaaaaaaaaaaaagagacatacatttaaaaaacaattactagtttaaaagctggtattgtaatttagtttgtaaattctaacattttgttttctatataatttaagctactcatgtattactagttttactcatgaattactggcttgtgttttagggcactcaatacataaagatgtgattttgtgatatgagcaactgaaaaggatggggacagagctgtaaaggggcagggtttttatgttattgaagttaaacttaatataatcaagttataacattatatagagaattggaaaactggagaaaatcaatgaaaccaaaagtttgttttttaaaaagatcaataaaattgacaaacctttaactagatggactaggaaaaaaagagaaaagactcacataactaaaatcagaactgggtgtgtgaagacattattactgcttctacagaaataaaaaaggattataagacagtactgtgaacaactgtactccagtaaattggataactgagatgaaatagacaaattcctagaaacacaaactaccaagactaaatcatgaaaaaaatggaaaatctgaatagacttataactagtagagagattgactcagtaattaaaaatctcctgagaggccgggcacggtggctcatgcctgtaatcccagcactttgggaggccgaggccggcagatcacaaggtcaggagttcgagaccagcctggccaatatggtgaaaccctgtctctactaaaaatacaaaaattagctgggcgtggtggcgggcgcccataatcccagctactcagtaggctgaggcaggagaatcgcttgaacctgggaggcagaggtttcagtgagccgagatcatgctgttgcactccagcccaggcaacagagcgagactttgtctcaaaaaaaaaaaaaaagatatttccaacttaacagtgggtttactgggacatagccccattgtaagagtgttgccagacactgaggtttcagcctaggtctgctttctcgctgcagggaaagcccatctctgacacagtcagtgttgccagagaagaaaggctttcatgtgggtgacatcagacgagaccagcctcaaatccatcttcccagccaactcaagtggttatacaggagttggtcaacaggcagcaggtggttggatgaggggtctggcatctcattgtaaccatgtgtgggaaaacaggaattagggagggataaggaaagggagttggtcaacaggcagcacgtggtcagtctggtgtcttattgtcaagatgggttatctgggaaatttcagttctttgatactatctgggagagaaattgggccaggttcaagtggagcatctgtacttgcaaaccaaattggcagcatattaaaagaattacacaccagggaaaataaccctagaccttgcattctagtgctctgcttatctgtgacttcagacaaagatggagagagctgaccatcagtataatttagctgaatgaaataatgagatattttaggaagaagaacattgaatgtcagaagttaaatgtgagatccaagaagtaacagtgaacagacaagtttgtgggtatgtggatatgtcttaaataagtcaggttgtgtcaaattatgatggatgatgatgactgcgaggcaggaaggaagatgaaaaggaggaggcattgaacactaatggtcacagggagcaccgggagcgtggtgacgccagggtgagctgcttgttctgtgagggtggagggaagagatttattaaccttagactttgttaaagtatacatgtgacgtctacatgggaaactgctaaatgaatagaagtggaaggtgtaacttccacaccattaaagggtaaaaaggagaatgaagaaaagtcaatttagtagaacctgcgggaggaagatgggggaaggagaaataatagtaattagaaagcacagattaaaaaaaaatcaaaatgtcaataatcacaatatatgtaagtggtttaaatgtataagttaagactaagattcacattagggtcagtacatagtaacaacaaggaaaggctcccacaggccttaatgtttgtagttattggggtggaggagacacaggagacagcatggagaggaagaactagattagatgcacgtccgacagttggaaagatcctaaaggtagtgttcaaagaaaaaactaagagaatgtgattcacagccaaacaaatctatacataggattctggtagcagatggcagctgctcacttccagaacaaaaaatgtacacaaagtacatcttcactgaaactgtgggacaaacagacccatccactgaaagtccaacaggcagaggaaagtactggagacctgcagtgtcacccggacacagggggtgcagagacacgggagtgcggcctggcaggcagagccagcacctggggcctgcccccagcggcgctgagagttgaaagggagcagtgggaaaagaaggcatggggagctcctgggaagaagagatgacacatctttgaaaggatcaccttccaaaaggaaggcaacatgctggaaggcagagagaaagggacctgaggctctgagggcccacagagacttgggttctgtggtgaggagacctccatcaagccgacagcagtgagacaaacctgggacccagccagtacccgctccaagaaatccgacttcttcagaaaacaatgaaaaggttatgtaagaaaaccccagccaggtgcaatggcgtgtgcctataatcccagcactttgggaggccgaggcaggagaaccgcttgagcccagcctggagtttgagaccagcctgggcaacacagcaaggccttgtctctactaaaaaaaaaaaaaaaaatagctgggcacagtggcatgtgcctgttgtcccagctactcaggaggctgaggtgggagtatcgcttgagcccaggaggccaaggcgcgcagtaagccaaggtcctgtacaattgtgctccagcctgggcaacagattctgtctctaaaacaaacaaaaacaaaatcctgacccaaaacagcagaacttccttacagatggagaaaagccacttagaaaaatttttatcacaaagtagataaaagttatactctaatattcacagattttttgaatatgaggattcagagatagccaggcagaaaggagagctaggattgggaacttgtagaactcaggagtgaaacaaggaaaagaaaattattttctaagcaaagcctaaacctcaaggaacacactagagagtaggaaccacaagaacggcacgaaggtggatgtggggagtgagcagagtgcagctgaaagaacctgggaaagagagaaagaaggaatgtaggaaagaaagagaaggatgcgagtgacgccttgggcaggggctgctgaggagaggcactgtgcattcaagcaggccagaggatggttcagcggggctgagtcacattgggcgacgtcgtaagtaggattactggacgcaaccaagaatcctgtagatacccaggcaaaaaaacaaaacaaaaagcctaaattgcttctaaggggagaaatagggccaagtggaggctgttcacagcaggacccagtgctcgggacagggtgggctcctcagaacgagccaggggtgtctatccaggcatgtggctctctgggtgtaacagctacagagatgcaggttggagcatagagaattaaaggaacatgtccttcctgagtcagctgctgagagatgagctccaggcctccagcagaatcaggtgaagctccagcaacaagttgggcagtggcagctgccgggggtgagtgtgccagaaggagtgatgcgtactcagaatgttgcccccaccagaaggggcagtgggaggagcagggagaaaggagggtaagttcacccccaacaccggcgagccagagccgctgagtcaggtgggagcagaagctgaggtgtgttcaggagcaaaggagagcatgaagataatgctactgatgagagctgggctctaggggcggttgagggagggggtccaggctgatttcagtgtgcacaagcagggacatgtaatgtccgggacattacatgtgggcatgcaggctgacgggtcacataaagggccgccaacaggacaggacggagtccccaacagcaggaaatcaagcagctcctctgcctcacagtgaaaggctgaaagcccatagaaacaagcaagacatgaatgtgttctgactgtggccagcatatctggaaagaggaaaatgggctcgcttactttttaaaggacttccagattggatcataaaaccgaattctctgcagcatgcaaggaacaaagagattctggaaggttaaaaataaaattgtgggcaggccgggtgcagtggctcatgccagtaatcccagcactttgggaggctgaggcgggtggattgcttgagctctggagttcgagaccagcctgggcaacatagggagaccctgtctcaattaaaaaaaaattgtggccaaaggtatgccaaggtgaagtcgaagaaaggagttgttctcagacaaggcagaattcaggccctaccactttcagtgacacagaagaaggcttttttgacaccagagccaccactggggatgagatgcaccctaaatttagggccttcccactggcctatgggatccaggagaaaggccagtgaatacagctgacggtgagttcacctcttaattgaaggcagagatcctggacagatgatgagcatgaattcagcactgtcgaaaagaaggacagaatacactggaggaagtgtttagagaccaagcagagacttagagaacagaaacaatagaaataaataaatctcttcttacgagcccacaatagtgccgtgtacttttcagaggcacatgtactgaggcgtgaggtccgagccagggcgtggacctgtatgtgaacatgggaggaggggacctgggacctgtgagggtgtgtgccagccggtggggtgcacctgaaaagcatggagagcagttccttgtgaccgagtggggtttaccccaggactgcaaggagggcttaacaaccctatcaggtaaaggaggaaaacaaatccagagtcattttcatgaacaccagaaaatcatttgagaaaattcaaacctattcctgatgaaaacttcccaagaaaccaggactacaagtatgcttagcttgctaaaagacatcagcggctgccagctgatgctcagtgagccagacacttgtggccggttcagaaataaggcaggacgctcacgccgctcctgtacccccaaggctgcgggtgctgggtgatgcaggcagggcagaaacagcagagcagcaagaggcaaacagtgtctctcggagaatgtgacggctgtgtttggtgatggccttatgtgaactgtagtgacaacagtgagaggccaggtccacaggttttcccctgccctcctcatgtatgcagagccacaaagagcattgatgcgtgtattgaatggagcaggcttctgtggaaagttcggcagtgtcactgacggacacaagagatgatatggatgagtggcggtacaggctatgtctcagctgggaaaggagaggctgtgagggtggaaatcttccccagtgcaagctcgttgtaggtgcgataaaaatagcaaaaacgtttaaatatacctggacaggcaatttcaaagtccatgtagaaggaaagatctgcaggtctagccagtgctttatcttgaagccttactgtgggaagggtgggcgtgtcctgggggtgacagtgttccccatggcattcctgtgactccagcggggcccaaacccaggcggatggccagggggagtggggccaaagccagggccgggcagcccacgtaccacgcactgatgcctcccctcacaccacttataaaggccaattccagatggattgaacagctaggagtgggggagatgcattttataatctgtgtggtgggaaaagctgcatgcaactactcagcaaaccgaaaacgcatgaagcaaaagggtaaaatagttgcataaggcggaggcagctttgtgagaaaagacattgtgcacggaagattccattgggagctgggaagctatgggaaagtttttgacacatttttttttctttttggagacggagtctcactctgtcgcctaggctggagttcagtggcacaatctcagctcactgcaccctctgcctcacaggttcaagccattctcctgcctcagcctcccgagtaactgggattaccggtgcccaccaccatagctggataattttttgtatttttattagagacagtttcaccatgttggccaggctggtttcgaactcctggcctcaagtgatccttggcctcccaaagtactgggattataggtgtgagccaccgcgcccggccgacatattgttataaaggggtctgatgtttggaatatctagggaacatctgtaagtcagttaagataaataaaacagggtcaagacatggcgggcaacccacagatgaaaactggcccgataagaaggaagtggcactgggccccgctggtaatggtaggaatgtaggttagacacggtgctgccaggcgtcagaggctgggttgtcctgttggcattggtggcatgtcccatgtgcatgccccgtgctgtcctcgtccccagggccctgcagaagtggtgtgcatgccaacgtgcacatcagcaccgcggctcagcgcgtcatgacaaagcatctgcagagggcagatgagcacccccacttctgtgttgaagagtggcactctgggttgattagtgcattttattattgtgaaaagcatcttgcagagaaccacattctggtaccatttctggttttaaagggtggcctgtgtgggtatgtagaaaggacacggggccagcggtcccagacaggggcaccctgggagattgcaccagggctgggtgcgtgggcagttgtgtcagaggccgcgtgtgaatagtgactccgaagcctgccgcttcctgggaccatgtttatcccagtgtttatccctgttcacacacgtggttttgtttgaacacgtgactgttacgctttatgtggccttttgatttctccccacgcggttgtgcggtggatctggcggctcctcaggtggaggccggggccgtccattccctgctgctgggtggagatgttgtctccagttcctgcctttggcctccaggcacctggatttgagtgggtcagttctaggccacatcgtgcttgcatttgtgattcccgtggcccttatcaggttgctgcctcgaaagccttcctgccggccctgcagccacccctcatctcagccaacgccacatcagcgccatgggtgcaaagtcagagctcactgtcactcggatctgcatttctccacctctgcctggatttgctctttgggaattgtttctttgcatcctttgctggttttcggttgggtgagtcttttttttttttgagacggagttttgcttttgttgcccaggctggagtgcagtggcgcgatctccactctctgtaacctccgcctcccgggttcaagtgattctcctgcctcagcctcccgagtagctgagattacaggcagccaccaccacgcccagctaattttttttgtatttttagtagagatgggggttcaccatgttggctagtctggtctcaaattcctgacctcaggtgatctgcctgcttcagcctcccaaagtgctgggattacaggcgtgagccactgcgcccagccagggtgagtcttgttcttgtccttgagtgccacttggctaggctgttgctgctgaccttagctcccttgtttgccatcatggaggatgctgggagctccagctccctgtcctgtcctccccggcgctcactaaggctcggtcctctccacgtggtcctgacctgtcctctgtgagcaagagaaacaggactggtttgggggtgtcctgtctcagtggacacaggacaccacggttttcagtacaacaaggaacacaacttgttcaatgtgctttatgatggtgaaaattccctttaaaaataacatgcgattgctaacacttgaccgaatatatcacttgaccttacaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcaggtacaagctctggggaccctgcatggggctcctggctatgggggcagagtggccatcgctgagggctgcgtggggctggactggaaaggctctgggggaggtgggtgctgatgtggagtctcttttggtttgaatatctcttttaccaagcaaaattgaaaggccatgggtcaagccagtacagatacaaaaataataagagtatttttgttgacctaatacacgccccttagcttttgaagagaaaggcaggtgtttccaatttggtgtctgtctcctcttctcccagggacggagctgacttttaactacaacctcgattgtctgggcaatgaaaaaacggtctgccggtgtggagcctccaattgcagtggattcctcggggatagaccaaaggtaaggctgtggcgccctccttccccccaggctctgtgttggcattttgcactcctggagacctgtgtcccccgtgaacagcggcttcctccaggctggcttgttgccgggacaggtgggagcaagttccctgctgtgggctggggaggatggctctcaacaaaggccagtggttaagagttcctcactgaacgtgtttcctggggctgccagaacaatgcctcacagacgcgtggtttcgcagttctgggtgtgggcagggccgtgcgccctctgaaggttccttgggaggctctttcccaggcctgtctcccgttcctggtggcggccacagtccttgctgctccttggcttgtagcagcaccgcccaaccattctccctgcgaacatgactgttgacttgcccttcttataagagcactggtcctgttgacttagcgcctgccctgctaccgtgtgaccccatcttaacagatctcattgacaatgaccctatttccaaatacagtcaccttccaaggttccaggaaggacagagatttgggggggcactcttgcaccccttccctgtgctgtgtagaacctggtcctgaaagcctggcggtggcaccagctcggccctgagccggtgtctgtcctcagccgtgttgctgaggatggtcactgccctcaggtcactgccgcccacctgtgcccacgttcctgtggaatttcctaatgaggagaccctgggtggcgggcgggagctgttctgcctgtggtggcctcctttgccagtgggtcccatcagcagatcctggagctgtgtgtctgctgagatgctgctgagatgcgtcattgcaggcttccgacaaagctcactctagtcgtagtctttgttcagctttttcacgctgagtcgagtgagtctaaggatgtctggggagcacgaggaggacactcctctcctctcctcttagtgttgggcacctgcagagatctctgaagttcctggagtgtagctcgctcttctgccctatttgcttcagcctgtgtaattctttccggtgatctgtgcttaattcttgactctagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcggtgggtgtgcagcctcgcggtggcttgcagctgtgtctgtgtggcaggctcctgatggcggctgctgccgctcttcctgctgaccgggcctcatctgggtgcaggcacatcaggcgctcatgcagcgaaggccctgatccagggtggcagagcctttctttgttccaccagccgcacattctagatctctgcatcgagcagagaagatatgtggtgacggggtagcccctggaacctccaggagggattcaggcagcccaaggcccagctgcagaattggggccctcatccatgctgtgggggcggggcggccaggaaggaggcgacgctgggaactaaagcccctcctaggagaaaggcctctacaacagtgtctccctggcagcccagaggggcctggcctggctgcactacagtgggaatggaggggcccagagcccctgtcctggatgtgcagggcaggctgtccccagagatggtgctgtgcaccaggaggctccgccggttgacgaaggagctgcagctctggctctgtttgagggaaagtagagtgggctccaccttccagcacccgcatttcagagatgacaggcgccagtgggaaaacagtagcgtcttgttccacttggtgatgagacagtctgagaaatgggtcgtgagatgactctggcggtgcgcagacatcatggctcacacctaagggtgcagccacctccgttacaatcttgcagtgtgtcgccatgaggctcttgactgtgtggaatcacagaagaaaaattaaatggcccttacccaaaacaagaaacccaaaagaggccaggtgcgggggctcatgcctgtaatcccagtactttgggaggccaaggtgagcagatcacctgaggtcaggagttcgagaccagtctgaccaacatggtgaaaccccgtctctactaaaaatacaaaaattagactggtgtggtggcatgcacctgtaatcccagctattcgggaggctgaggcaggagaaatgcttgaacccgggaggcggaggttgcagtgagccaagattgcagaaagctgagatagcaccattgcactccagcctgggcgacagagcaagactccactcaaaaaaaaaaaaaaccaaacaaacaaaaaacaaaactataaaaagaaaatccaggccaggcacggtggctcatgcctctaatcccagcacttctgagaggccaaggtggatggatcacttgaggtcaggaattcgagagcagcctggccaacatggtgaaacctcatctctactgaacatagaaaaattagctggtcgtggtggcgggcgcctgtaatcctggctactcggaagggtgaggcagcagaatcacttgaacccaagagacggaggctgcagtgagccaagattgcgccactgctctccagcctgggcgacagagctagactccatctcaaaaaaaaaagaattcagatatttgtgtaaaaacatttttgtacggtaaagatgacacacgatagagaaaagtgttggccatgggtgcgagagggtggtccctaacgtgacagagcttttacagagtcatgccagaaagatgaatacccaagttgaaaatcagtcccttgggagagggcaggtcacatggaaatcagcacagcagcccctgcctgtccacgccgcgctgggggacactcctgcacccggcacagctcctctcagttgccgaaacataaagagacgctaacaggtggtccttaggggcctggcaggtactgtggagtcaacaggccctgccagggagcccgcccgggctgtggtagacagtttgtctgcccgtcctgttcgctggagccagcactattttgtgttcatttgacctgacagttgtaagtcatcttcaaccacgataatgttgaagtcgtgattccatcacttctgtgtgctcacatcttgtgttctgttgcagggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaacttattttatatgggattgtttgattttttttccagttactttgaattgcaaagcatcgggtgtggcactgatgcctccgatgggtggggctccctgtcctgactgtgtcattttgcctttgacctgacccgctggggagaggcagtgccaccttgggaagtataacaacaaatactggaaatagcaggcataactgactgactttggaaaaatgctttcttcttctttcagaaataatttgcttcccaaattcccattaagggtgaaatggtctagagagaaggaagcactgctgtcccccagccctgcagtcggctgagccgggtggtccccaggcccacagccaagtaagtcaagggagtaccccgagggctgatcctacctgttccccaccctgtgggccagggtgtcctaggaagcccccagccctggcccaccccgtcctgatggccgcctagggagggactgggtccccggagcagggaggacaagctggccccaaacacagctatggtggctttctttagaaaagctcgactttaatggttcagatagttttacaatgaaaataggtacccaaagactgtctgtcttaaatgtccacaactatacaaaagatgaatacaaaactcccaggcaggcacaggcaggggacaaggcccaccgtctcccacgctctggtgtggtcgggtgtccctgccgcacccccagtaccaccgtgccaccttggtcccctcaaccctgggggtaggagggcactgccccagcgagggaaaatagaaaagattttaaaaagtaagagtctaacaaacaggcagagctgtcactaaaattaggaagttgtaacttttttggttaatttacttactacattcaaaaatgtaacgttgagtccaaaaagtgtcttaaatcacacaaaaaagaacccatattaaaattttaaaaataagccccaaataccccagagaaatgcatccagaacttaaaacaggctgggtcagcagcagggcggcggccgggggacctcgggggccaggtgtccgccatccggttactttaagctggcaaagccatcgtcccgtggacccccacaagtgacggccagctgtgaggcaggtggttctaggacacattggtcatgggcttgtacttcttgaagcgcgtccactggcccgtggcatagttcatctcaaacactgtgtccaccagcatggttgtgctaccctggccgtccgccttgggcaggtcctccgtgtgctcgctcagcttgatctggatcacgtccccctgctcctggcacgggttctctgcagagagcaggagctgctgggtgggtgtctgggggcacccgcccccaacccggcccggtgcacccccaggccctgccttatgaacatacctcgggagccggccatgaagcccaggatgagggccttctcgggccgcgtgactttgttggccgtcttgaacatctcctgggcagcgaacatctgctctctctacagcggggagaggggtgtgggtgccagggccccgccaggaccacctcctgcatccccctgcaggcaccgtggcacccccacgctaggggaggtggccagggccgtaccacctacctggtggcctgtgggccctaccagtgtacacctaccgtgagggacaggttcttcttaggctgctgctgagcaggggcctgggtctgcggggccaccatggcaaccgggggtgtctgagtggtaggggcgacagccggaggtgtggtgggtgtcagaggcgaggtgggcgccgcaggcgtgggtgtggcagggctcaggccgctgttgtacatgggcgcccgctgcttgaactgcgctggcaacgtggggctcggggcgctgggctcctctggtgggcggctggcttcccgggaagatggggctgcaagtagaccggggcctggtgagggggctggacccccaccctgttcccaaaccctagtgctcctggaggtgacaggctc

SEQ ID NO: 14168 - DNA, 21490 bp, Human
tttaacattttgtaataaaattatgcgtatcaaaaaaacaaagaaattccgtgtgtagttcacactcacagcacatctccgtccaggcacttgagagaatgactaggaggggttcttggaggaggtggtctttgaacggagaatccatcttcaaggattctgtctgtaatggtcaccaagtatttcctgagtcacttccatgtgtcctgcagttctctgaaggggcgtgggacctaccgatgccaattatccagcattatctccagattccaagaagttggggtgtgagccagcaatcagtacagaaaagagataccaaaataagtttgagttggggagtgttccttcaacttcagttttctggaagagatcttttttttttttttgagacagagtttcgctcttattgcccaagctggagtgcagtggcacgatctcggctcaccgcaacctcctcctcccgggttcaagcgattctcctccctcagccttctgagtagctgggattacagacatgcacctgtaatttctactaaaaatacaaaaattagccgggcgtggtggcgcacgcctgtaatctcagctactggggaggctgaggcaggagaatcgcttgaaaccaggaggcggagattgtaccaagatagtttgttccagctaaacaacctggcgctagtgcaggaaaaggtggaaggcacggggctagcacaggagggttcaatattttcaaccttatcaagccatattttggcaactcttgtttttcacgagaagcccccgctgggcttgtcccagcgctgtcctgaggcttcccccatgagttccgatagggcagaggccgccctgagcgtttctctttcccctggtccaagagtggctcaaaagaaggatttttgactggaattggccactttgtgttactttttgacccttgacctcgccccaaagggggatgcgggggaggggctctggtaggggtggccccgctccttccaggtccgcaagcccaggttcccgcccaccgggctcagcccaccctgcggccgttcagggaggccgttggcacccgtgacctacgacccccttcccgagccccaccgaggtcacagccgtggcctcgtctccccatgcctgcttcccgccccctgcccgtgacgggcgtctccgaggaccaatgagcgcgctgtatccacccctcgggcggggccaagcgccgaccaatcgccgctcgggcgcccggccgggtccaaacgctccaatcgtcagcggcggcggggcgggcagagggccggggatggcaggttcaaccaacgggtgggcacgtcgtcctcgcgaggaggcgtgccctgcggccgggcgtgcggtgtccgcggcggcgcagggagggggagggaggtaaacaagatggcggcggcgtgtcgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagggcactcggggcggggcgcgcgctcgggcagacgtttgcggggaggggggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtaagtatggcttgctggggtcggggccgggccgggccagtcacggtgctgatggttctgtcttccttccttctctcctccctccctcccttacttcctcttaacaccctgagctggacccgtctggcgcctgtgtcctccgtgccagggagagcgtggttgggggcctgcgttacggactttcactcaggcaaggccagttgtcgcagcggggcgtgcgtttgcatgggctcttggactccagttaaaatgccctggtagcgaaaccctcctgagaagggagcggcccccaatcccctaagactagccccttggctcccccagctgtccaaggagcagaggcgcccagtggaatcagcctgtgtttgtttgggccccgagagtttgtgtgcggccgccaacacgttttctgcgcagtgtgtggccgttaccggggccaggcgaaatgtgatttgtttatcctgtcagaggggaaccctgggctgccaaaaataactgtttgcaccggcttatcagtcagcaggagggaaacgtagcctttcctcatttgccagggatgtgacgctggaagcatccctggcccccggggctggaagccctgcccgagggggactgtgcctccctcccgaattgcatccggaagaccttacttttccaactgacttcttcaggcacggggctgccgctgggcatcccggacgcctctgcatctgtgcgcggagaagctcctacctagggcagcactggccggcctgagcctctcccagctggtgggggtggccgggggtgtccctgccttatcgcagccagacacgctgcacctgccgccgcctggcgggccctgcccaggccgtgctcctttcccagccctcttaactttcaaaactttgcctcctgtttccaagaaaggaccttatctgctgggctaggcctcgagggactggcaaggacaccctgcgcagggcaccatgaccttggaaggaggtccggggaggggctgctgcggtgtctgctctcaccttcctcctgctcaggggccctggggctcctgccgtgtctgctctcacctctctcctgctcaggggctctggggctcacgtacatttttttttttttttttttgagacggagtctcgctctgttccccaggctggagtgcagtggcgcgaactgggctcactgcaagctccgcctcccgggttcatgccattctcctgcctcagcctcccgagtagctgggactacaggcacccgccaccacgcccggccaattttttgtatttttcagtagagacggggtttcaccgtgttagccaggatggtctcaatctcctgacctcgtgatccgcccgcctcggcctcccaaagtgctggtactacaggcgtgagtcaacgcgtgcggcctttttttttttttttttttttttttttgagacggagtttcactcttgttgctcaggctggagtgcagtggagtggtcttggctcactgcaatctccgccccctgggttcaagtgattctcgtgcctcagcctcccgagtagctgggattacaggtgcctgccacagtgcccagctaattttttttttttttttttagtagagacggggtttcaccatcttggccaggttggtcttgaacttctgacctcgtgatccacctgcctcagcctcccaaagtgctgggattaaaggcgtgagccaccgcgcccggccagcacgcttcttaatcagcatgcaggctgtgacatgcggaaaccaggggcacaggctctgaagtttgtactctggagctggagcagtcagggttaaatgggagcggctgggaagggtgtgtttccacgaggcctttctgatgtctcagtgcccagtctggacccgggtagaaggtgtggccagtgccttgagtcagtggagcagttgcctgtgcctggtctctgtgagatgggttggtcaggggctaggcagagcctgtgcctggtctctgtgagatgggttggtcaggggctaggcagagcctgtgctgggggtagcaggtgccctctaaaggggccagtgacagtctctctcccagcagtgagaaacccacgcttaggggccgggcgcggtggctcacgcctgtaatcccagcactttgggaggctgaggtgggtggatcgcctgaggtcaggagttcgagaccagcctggccaacatggtgaaaccccatctctactaaaaatacaaaagttagccgagtgtggtggcgtgtgcctgtaatcccagctactcgggaggctgaggcagaacattgctggagcctgggaggcggagcttgcggtgacccgagatcgcaccattgcgctccagcctgggcgacacagcgagactctgtctcaaaaataaataaataaataaataaataaataaataaataaataaatctggcttgagttttgacaaatgtatatgcagggtcaatgggaagacagacgctggagggtggaagcctgactgtgagagtgagccccctgctttcctgaacagtcagtggaggaggtcctgggagctcaggtgagcacctgaacggtagggcagagcctgagggtcttggtggagacaggcaagaaggttgcaggaacctagtctggcccagtgcctgggagaacgggagggaacacggaggcagggaggcagaggggttggcaggacctggactggactgtgcgtcgcagctacccacagcttgaccccactgccttgaagtgagtgatgcaccctcactagtgttcagcgtccaatttcatcctggccctgagtgtgtaacggctttgcccttgcggggccccctgggatgaggggtgagccctgtcccttcctggtcactgtctgccatcaggagctgccccgcttacagctgtgattcaggagccactgcatttcctccagccccctgggtgctgccagggggtcctcctattctgggagctggtgtgttctgactggaggctgccatgtgcagagtgctgtcaaggagaaggggtgtccactgcccagccctgaggcccaaggccttggccagccttgctgccagcgctgcagggaaaaagcctcctttgtgtgtgggaagtttaataaactccgctcagattgtgtctcgcagcgagtgtctggaaccttccagacaagcctcaggcgtccggtcctccagttggtgtggaaagcgtgggcgatcaccaaggggggtgggttggggcagatggagccggcgtgagtcccgtctcttcccttccttcccagaaaggcagccctggagtccatgccttgtcccgctctcaccggcaaaaagtataatcttattagaaataggaaagttccaaaaagcatcaatgagttaaaaagagggctgggcatgttcggtcatgcctgtaatcccagcactttgggaggccaaggcgggtggatcacccgaggttgggagttagcctgaccaacatggtgaaaccctgtctctactaaaaatacaaaattagctgagtgtggtggcgcacgcctgtaatcccagctactctggaggctgaggcaggagaatcacttgaacccgggaagcagaggttgcggtgagccaagaccatgccattgcactccagcctgggtaacaagagtgaaactccgtctcgaaaaaaaaaagggctggggccgggcgtggtggctcacgcctgtaatcccagcactttgggaggccgaggcggtttgatcacaaggtcagaagtttgagaccagcgtggccaacatggtgaaaccctctctctactaaaaatagaaaaactagccaggtgtggtggcacatgccaataatcccagctacttcatctgaggtcaggagttcaagaccagcctggccaatatggcgaaactccgtctctactacaaatacaaaaattagccaggcgtggtggcgcgcgcctgtagtccagctactggggaagctgaagcaaggagaatcgcttgaacctgggaggcggaggttgcggtgagccgagatcgcatcattgcattccaggctgggcaagcctaggagagaagagcgaaattgtgtctcaaaaaaacaattaattaaaataaaatcagtgccataggctgtttctggtaggcagtgggttcctagggtggagcagggaagggctggaaagggtcgcctgtgcccagcccgactccccgtgcttctcgggggacagcacggctagctgctgctgcggagcccacagtggggttctgggggggggggtgcaggcagaaggccgccatgcctccctccccctttccaccccagtgagagtgggctcgaaggcagggagtctgcccgccttgtggagcctccgcagaggcacccagggctgccgtgagcgcacagcctggcggtgtcccacggccctgccctttcctgtcacttccacctgttgcaaaacactgtgctttcgtatcttttctttctacctgtttggaaatgtgaaaatcactgctgccgtaggaaacgggcccagatccgggctgtggctctcccatccgcaccgcccccgcggtgtccagccaggaggtgggaggtgggcggcactcagtgtgcctggttgcggcgatgattggcagatgcttggacctatggtaaagaggattttcgcgagctgggagtcagtcctggactttgtaggtctttacatcccaggcggcctttatggggttccagcatctgctgaggcccctgcgccagccatgtgaggcctgggtgtcctcgaggcctctgtttgtgcccctctctgggcagcgggagggagagctctgagacccagagggagctcaggggctgggcagccgcagaacagcgggggtaatgggtccactgggggttctgggctgtgcacacagtgggcttccggtgcccagccagctggggcaggcctggaatgttggttcctctctcaggatctggggcgctgctgtagctgtcggggaatcagtgaggcggctggacggcccgtatatcccacaaacgccaccgtattgctcaaactggactcaattttcttaacacctttttttttttttttttttttttttttggagacagggtctcactgtatcgccgaggctggagtgcagtggcgcaatcatagctctgggctcaggtgaccctcctgcccccaaggtagctgggactgcagatgtgcaccaccacacccgactagttttttgtagagatggggtttcgccatgttgtccaggctggtctcaaactcctagactcaagctatccgcctgcctgggcctcccagagtgctgggattacaggtatgagccactgcttcgccacgttcacctttatttacttatttatttatttttgagacggagtctcgctctgtcccccaggctggagtgctgtggcacgatcttggctcactgcaagctccgcttcagcctcccaagtaagctggaactacaggtgcctgccaccaagcctggctaattttgtttttgtatttttagtagagacggggtttcaccgtgttagccagtatggtctcgatctcctgaccttgtgatccgcccgcctcggcctcccaaagtcctgggattacaggcttgagtcactgtgcccggcccacctttttattttttattttatagagacaagggcttgctgtgttgcccaggctggtcttgaacccctgaccttaagtaatcctctctggcctcccaaagtgctgggattacaggtgtaagccatagtactgggcctaaagttcaccttttttttttttttttttttttttgagatggagtctcgctctgtcacccaggctggagtgcagtggcgtgatcttggctcactgcaagctctgcctcccgggttcacaccattctcctgcctcagcctcccgaatagctgggactacaggcgcctgccaccatgcccggctaatttttttgtatttttagtagagatggggtttcactgtgttagccaggatggtctcgatctcctgacctcgtgatctgcctgcctcggcctcccaaagtgctggggttacaggtgtgagccaccgcacccggcaaagttcacctttttaaagtgtgtaattcagtggcatatagtacattgacagagttgcacaactatcacctctatcagcttccagaacattcttgttaccccagaaggaaaccccgtctctgtcagccatcactccccattccctccccagtcccggcacccacgcattcccttcctgcctctggattggcctgtcctgaacatttcacacgagtggtgtcacacaccgcgtggccttttgcgtccggcttgtctcacggagtgtgctgtcctcaaggggcatccgcgccgtggcctgggtccgaacctctctgctgttcacggctgcgtcactttccagtgtgtggagggccacgctgcgtttgactgctcatctgtggctggacacttgggctgctcccgcctctgcctgtgaattgtggctgctttggtgcacgtgtgctcagccggcgtccctctagaatccttgagggccttgtttcagccacatcaggagggattcagggaccagggcacgcgggtctggagctgggtgttcctgggtctccatgtgcctcccagtcctgctctgagccgtgggaggccggggcgagggccaggcccatctcttccctgtatgatctgtttctaggcagacggaggctcctagccccacctctctgtgagcttgagtggcgtttatgactctccttcctatttcctgtcctgctaatcaacaagtcagctaaacagtccatgctgcctgggcaagcccagtaggcccctaacgtggcacctcggagcggctggcgatgccccaagagccgggcttccccctcctggaggctcttcctgttcctcgccaagctcttaggtttcgctgggcctcctcttctgctctttttctggctggagacgtcagaggaagcctggcgatctagagaagctgatgtgcacccatcatcccggaggtgactgccaccaggcgggggtggctccacccccactcctcccctggcataaatcgggggacgcacgtgcctgcgcagaatgccttggtcccttttaattaaacagacaacccagtgtcccttggtctatgctgacctgctcaggagtgcctgggctcttccacgtttcagctgctgtgtgtcctgctgctgtgaagtgtccccgttgaggtggaggcagggcagggcgccttcggtgagggcgagtcctcctgtgcccgtttccccatctgtagaatgatggctcatggaggagacatggtgtcggcaggtggtggccggcgcagggaggtttccaggagggagtcctccaccctcatttgcttttagggccgtgcagcctcccgagcggcccccacgaggctctgaggctgcatgcaggttgagctcctggcctcactgcccctcctcagggttaggactgtgctggagcctgggtgggtgtggggtggtccctgcacaggcagcaggaggtgggccagagcggtgctggacctgaaggcccgtggctccctcagctccactgaggaggctggaatagtgtcctgggccaccttccctgccggtagccggctcctgctgagggagggggtgctttcgcctcctggtggagcatcaggctcttggggcctgtgcgtccgagcatctggcctctgctgtctgaaaacagcaccttccccgccccccggccaccgcatctcctctgaatagaaggcaagtcttgcctcccaggaatggcctgtgaccttcatcagcgggggaggttaggggcacacagagccctggggaacaaggggatctggggctgagccgggcctctcgggcccaccccgagctctcctgagcagcctggcaggcaggaaggcgctgggccccggggcctttgccgagcccagcctcaccctcagcgtccccctcaatgccctgggtgcctgccaggctgtggacacaggccctggccagttctataaataaccttgccgggccctgctgggaattggtgccaccaccacatagcccagagagaacggaaacacagggcttctcagcgagcagaccaggcctgcggtgaccagtggaagtgggggacgctttcagggctgggcagcccgacagggcaccgggcacagccaggggccggaaccagttgctcactggctccgcttctgggggactgtgtccctctgtgccccgtccccatcacaccttgctttcccttcatcctgctctcctagcccctccccagactggcggccccttgtccaggcccagccccagcacagcctgcagccctggcagagctcaggccttggccttctgaggttgccctgagggcagtgagcaatgagccctgggactggtgcactgggagggaaaggtgagccaaggcttcctgcaagaggcagccctgagctgggggtggggaaggctgggtcgtgggatacccctgacaccccaagttttttttttgagatggagtcttgctctgtcacccaggctggagtgcagtggtgagatctcgactctctgcaacctccgcctcccaggttcaagcgattctcctgcctcagcctcctgagtagctgggattacaggcgcccatcaccacgcccggctaatttttgtatttttagtagagacaaggtttcaccatgttggccaggctggtttcgaactcctgacctcaggtgatccacctcggcctcccatagtgtcgggattacaggcgtgagtcaccgcgcctggccccccagctgttttttatgctccatgcttgggcttcctgttaagaattaaaaaagaaaaaaaaaactatggagatggaatttacatactgtacaactcattcgttcacagtgtacaattcagtggcattaagtacattcacacggctgtgcaaccactacttctaattccagaacgttcggtcaccccaaaagcaagccccattcccattgtgtcactctccatcccctccaccagctcctggccactctgaatccacttcctggctctggattggcttgtcctggatattgcatagaaatgggatcctgtcggccgggcgcggtgactcacgagagcaagagatccagaccatcctggccaacatggtgaaaccccatctctactaaaaatacaaaaattagctgggcgtggttgcgggcacctgtagtcccagcgactcaggggctgagtcaggagaaatcgcttgaacccgggaggcagaggttgcagtgagctgagatcatgccattgcactctggcctggcgacagagtgagactccgtctccaaaaaaaaaaaaacaagaaatgggatcctgtcatcccagcgttttccgaggccgaggtgggcagatgacttgagcctagtagttcaaacgagaccagcctgggcagcacggtgaaactgtctctactaaaatacaaaaattagctgggcatggtagcacacgtctgtagtcccagctacttgcggggctgagatgggaggatcgcttgagcctgggaggtgcactccagcctgggcgacagggaaaccctgtctcaaaaaaaaaaaaaaaagtgcatcacacactgtgtgtcctttagtgtctcactgtgacatcctcaaggtgcagctaggctgtggctcgagtcagagcctcactggtttttgtggctgagtcttgttgagtgcgtggatgggctgtgctgatcctcgtctgtggaagggcccctgggtggttccacatctcggctgctgtgcgtcctgctgctgtgagcatctcgtgctccgtttctgcgtggcgtgtactgttcctcagggtgtgtacctgggagtggagctgctggctcacagggtaacagacctttggagaagctgcagacgcttccacgcccacccactgggtgtgaggaccttgctcctcgtcatttttgtttttgtttaattttttcttttatgagacagggtcttattctgttgtccaggctggagtgcagtagcacgatcacaggtaactacaggctcaagtgatcctcccacctgagcctcccgagtagctaggacttgaggcacgtacctccacacctggctaatttttgtatttttagtagagacagggtttcgccgtgttgctcaggctggtctcgaactcctgagctcaggtgatccacccgcctcggcctcctatagtgctgggagaaatgaagtgtctgcgacagggcggcagctgcagagggggctgtgctctctggcctgttgtgccccacccttgtgacaggcaggtgggcgtggccaactgggcggcagctgcagagggggcagtgacaggcgggtgggtgtggcaggaccccacaatgtctctttctgtggcgtctccttcttcgcctgccccttcctatgggccatccttccagctcacctgcggcccaccctccaaggagtgggaccctcggagttgggagcccttggctgcgtgggactgtactgtgtgacggagccatcaccagggctccaactcaccctggctcctgccacagtctgggctccatctgtgctaccattgcagtagtctggtttctaggaagcaaaactgttactgagttacaaagctcaattaagagtgtcctttgggaggccgaggcgggcggatcacaaggtcaggagatcgagaccatcctggccaacatggtgaaaccctgtctgtactaaaatacaaaaaaattagccggctgtggtgacacgtgcctgtagtcccagctactcgggaggctgaggcagggaaatcacttgaacctgggaggcagaggttgcagtgagctgagatcgggccaccgtgctccagcctagggacagagcaagactctgtctcagaaaaaaaaaaaagtgtcctaactgtgtcctccaaagccctcgccggccgatgacagactagagggcgctgtgctcccaccccctaccgccctgagcctggacgcgtggcccctgcagggccctttcccacagcactgtgaactcacagcttctctctagggaagggaggaggtacgccacttccacagggagatggggaggccgactccagggatccaggccatcatcctgacgttgggtcggctgatacacccctgtcctctctgtcccagggaaattcaactactgaggaggttacggcacaaaaatgtcatccagctggtggatgtgttatacaacgaagagaagcagaaaatatatcctttccggtgttgggaccgcggggcctccgtgggaggggctggggccctgggtccgcctgcctcgaggcctgctcctcttcccgtctccttgaaggagactggcacacgagggccgtggccttccctggttccccggaagtcagccattgtggcaatggctgcgcagcttgctgaaaggggccctgagccctggcccctgtgtcttgggcccgtggggtgtcaagtcccttttttctcagagtctcctcccaggctaaccaggggtgtagccacggtctgcctgagacaggccacgcgggctgaccgttgtgggccattttggtcgtggctgggcgtgtcctcgtgtcatctgtggacacccccatgggtcttacgggcacagcctccctacggggactttgcttcctaaggccctgtgcccagagcaagagccagaagtggtcctgaggctggggctgtgttccctgagccacgcggtcaggggccctgggaccgtcctgcatgggcccgagcctgcttgggggggcgtccaggaggcaccatcccccgcccatgggcagggtgggggacgtgagccccgcaggaacgctgccccaagagtcagccctgtcctccccttccccgtaggctccttcctcctgggacgctggggcccctgggccttttcagaggggtggctgagggcagggtgggccctggtcccgaggaggggcaaggtgggtgcagagggtccctccagagccccttttctggcccccgtgctccctgggcctgtgagtggggccgccccctgagctgtgtgtccttagcgccccacgtatatggtgatggagtactgcgtgtgtggcatgcaggaaatgctggacagcgtgccggagaagcgtttcccagtgtgccaggcccacgggtgcgtgcgcggggcaggggccagggtggggcgggggccgggggccaggcagggcaggctcctttccgtgaggccacactgcttgtcctgatattcattgacatgaaggcccaagtttttttgtttttttgtttttttgtgttttttttcgagatggagtctcactctgtcgcccaggctggagtgcaatggtgcgatctcggctcactgcaagctccgcctccgaggttcacgccattcttctgcctcagcttcccgagtagctgggattacaggcgcccgccaccacgcccggctaattttttgtatttttagtagagacggggtttcaccgtgttagccaggatggtctcaaactcctgacctcgtgatccgcctgcctcagcctcccaaagtgctgggattacaggcatgagctaccacgcccggccttgtaaaggcccaagtttttaaaaacagttttggggtcccccatgtgtggcatccacaggcagggctgctgccaacctcccgcctccatctttgctgggcctgctgcctgaggccagtggcctgcttccagcccatcgctggcagccgcctgccctgaccagatctcctggatgcaggtctgtggcctcagagtcagggccccttgctgctgcaggaccacaggggcagggaggggcctgctgttccagcaagactttggggtgcagccggcctgtggcccacaggaaaatgagacctgtggacatccggggccctgccagacgtggctcggccggacgagggtggccactgcaggcgcaggtgtggctccctgctggacctagcctttcctctgtcctgtgtgcctggacttctgtgacttcccagctgggcctgtggtgtttgggaggctcccaggcagctgcaaaggggacccctgtgaggggcagggaggcctcggccccaggacgggtgtgtgctgcccgcaggtacttctgtcagctgattgacggcctggagtacctgcatagccagggcattgtgcacaaggacatcaagccggggaacctgctgctcaccaccggtggcaccctcaaaatctccgacctgggcgtggccgaggtaggcacgtgctagggggggccctggggcgccccctcccgggcactccctgagggctgcacggcaccgccacaggcactgcacccgttcgcggcggacgacacctgccggaccagccagggctccccggctttccagccgcccgagattgccaacggcctggacaccttctccggcttcaaggtggacatctggtcggctggggtcaccctgtaagtgccccgcccccccgggcactcaccacacgcacactccgaggggcctctgcgtcttgggcagctgccggcctgtgggcgcagggcgtggccaccggcccagaccctctctggccacagccgctagggggtgcttactttatggaaatgtaactcatacggcagatggtggttcacccgtgtgaagtgcagcctggcccgtcagggatcttcacagagtggcacggccgaccctcctcccagagccccacagggaagctgggcgggtgacagcagctccaggccccttccccgggtgggtccagaggacactcccctcctaccccgtagcctccactagtggaaggtggtgaagacagaggtgtccttgagtccacagggcctctggtccagcagccacgggacgcctctgtccctggggtagagctggggctcctagggcgtcaaccaccttgactgaccacgcctttcttccctcccctcgaaatgaagctacaacatcaccacgggtctgtaccccttcgaaggggacaacatctacaagttgtttgagaacatcgggaaggggagctacgccatcccgggcgactgtggccccccgctctctgacctgctgaaaggtgggagcctcatccctctgcccgcagccccagggaggcggggcttttgtgcagaaatgtagggttgggggtgtcaggtggggggctattggccccgagaccccagcaggcattgagaggactgagtggagaggccgacctccccgcagggcctggtttgccaggtccctcagctccaccctgcttctgggccctgttcaccctccgaactcccaccccagagggcagtgctgccctgcgcctcccccagccccaccctcgggggctccctggcttgcagggtctgtcagggttgtcctgctgcacttcctacgcatggcagcaggtggcactggccgtccgtccatctgcccagtggccttgggagaacggaaccgccctggccgtccagcccagccctgtctccctgccagccgcgcacaggctgtccccggcatgtcccaggagtggagtggcctctgtcagggagaccgcctgtgcgcggggtcccccttaggagcgtccaggtatcacccagggcctgacaacagaggctgggcaggcggggacggttggtggggtctcaggcctgtgcccagctgacaggctcctcgccggcttctcctcagggatgcttgagtacgaaccggccaagaggttctccatccggcagatccggcagcacaggtgagcggcccctgggggcagtggggccgaggctgcagggaggccggccatgtgggcagctggttgagcgggcgctagagcagggcgtggtgggggtgccaggctgggctggggccagaccccgtgcagcgcccgcagttctcggggcccgagtggggtctctgggcagtgtcctgttaccggccagacccaggcgccttgtccgaactggggtctgagtgaggacatgcgtccgtccctgccctaggcatggagatgcgccaggaagggcacagctggtcccaaacactggcgagagcctctctttttcccctcctcctggggctcccagcagcagggtgtggctgggatccagcccagggcccccagctccatgacagggaagacagagcagcggacggggtcagcaggccccacagtgccgcctccctcacttcgtgggctctgctcctctgcaccagcccctggaggcccttgagccgtctgctggagcccctccgagccccgaggccacccactgagaccggctctgggagtgggagtgtccggacccctgaggcgctggtgctgattgtgccttgggggtctctgcacagctcgggtcatctgggcgcctggcggggactggggctgccccccgatagcctcctgggctgggatgtgctcagggccccccagacccccttctggcctttgctggctttgcagccagcatccatctggtgggtgctggcttctgagtgccacctgggacacaggcctcagggtggaggggacatctgtcaggcttggagtcaggtcagcctgcctgctcctagaggacatggctgagcttctgtggtcacagccaccccttgcacggcctggtcccagctcctgagtgtgtggcaggtaccctgggcccagaggagctgggtcggaaaactggaccgccctggtgccagcctgacaggcgccactgcttctgggcgtttgcagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggtgagtctggcgggggcccctgcccggctctgctgactcggccaggatgtcccacgggagcagggtgcctgcctgtctgcaacaaggacagcttctgccctctggtggccaatcccacgtccccaaagcctccagcccacctgcaggctgcctccgccctgcgggccgctgggacatggctgaaaggtgtggggtcagcgggggcaccagcccaggcctgtctggccaggagggttcctcaggcgtctctccgggtgctgcccagccaggcaccacccaccggccttggcctgagtcccagcaggagcaggcgggggagccccagggtcgggggagggtaggtgagagtcagggtgcagggtggcccctcagacagctggcatgagagagggtccagtggccctccctcccgtcgtccctgaggcctgcccgctggccctgatgccggccgcccttcttccctaggtggcgaggaggcgtctgaggcagggcttagagcggagcgcggcttgcagaagagcgagggctcagacctttcaggagaggaagcctctcggccggcgccgcagtagtgcctgaggaggagctcagggccttagcgtaggggcggcccacattggcagccagcccctccccgccatgctcccggcttggctgtgttcggcccagggctgggccgtgtcataaagagttttgcagtgtatctgcagggtggatgcttgctgcgctcgggctggagcctgagggggctttctgctttactgtttcagcgggaagtggtgggcaggggccggcctgagaaggggggtacgccaggcaggttgggatgtgaggacccagtgcacagggtccacccccgggcccgagggtcccagaatagtgggggccctgcagagagccccccattaggtccctcagcactcctgggcccctcatcaaacccctaggctcagctcagtagctggtccccaggagagtacagtgtgggggcccccgagagcacagtgtatgggggtccccggggggtacagtgtctgggggccccccaggaggatgcagcatgtgggggccccccaggagggtacagcgtgtgtggggcccccaggatcacagggtctcagctcctgggctcttggatttgcagcaccacgaccatcgcgtctggtctgttggaacgggaggtgctgctgggtaccctggtcactagggtgtgctgggaggtgggggcccctcatggtgcccatccttggggcctggctgcaatttgaccccaggcccagggtcttctgcctttcagagccctggtgccctgagacgggcagccaggcaaatcccaggcaggagggccagttagggcagggccagcccaggcaggttgcgagagtccctactgggacgtggaccacacgctgacccccacggccgcccctgcaggccaggatccctgagccaggacccggcactggcttccctcctggggaccctcaggcctgtgtgagacctgggctgccctggggtgaggtgcctgggaggagagcaggggctgggccacctttttcatgaccctgctaagcccactgtgggtggtgaggaggagtacccagcagggggaagggccgccagaccactcggcatggctgaggcctcagtactcagtactgggtactcaggtggacgcccctcccactgctcagatgctggggacaggctcaacttcaggcttcagcgtgagccccgtccctgacctgcagagcccccttgcgttggggcaggacagcccggcgccctcgggtcaggccatcctctgcgctctgccggggctgctgcatcggcctctgcgtgcctccactttggcctcacgtgtccctacccaggatgcgggtcctgctgccaacacccagatcccagggaaggggcttgggctagatcctgggcaccagtgcagacaggagtgtggggtggggcaagggcccagtggcggctgtgcccgctgatgcagagctggggcaccttgtccacagggtctgccccaccagagacgggctgggcccaagctcagacctatgggtgcaattggtgcctcctcaccaaggtcttttttatctttttttttttttggagacagagtcttgctctgtcgcccaggctggagtgctgtggtgcgatctcggctcactgcaacctccacctcccggattcaagcaattctgcctcagcctcctgagtagctgggattacaagtgcgcgccagcatgcccggctaatttttgtatgtttagtagagacgggggtttcaccatgttggtcaggctggtctcaaactcctaacctcatgatctgcccacctcggcctcccaaagtgctgggattacaagcgtgagccaccgcgaccggcccaaggtgcttttttaaagctagtgacttcctgtgcacatggggtgggtgtgtggcaagttctggaagctgctgagtcagccactggtccattctcggagctggggctctgcactgggcacatgagctctggggcagcccggggcggcctcccactgacttcgcccgggaggggcctcggggatggctcggcagccagtgtgttcgcggagtcctcgccaaccaccacggctcctcgcagggacagtacgtgggcagcttcctgcactttcccctgccattgtgagaacagtgtccacctgggcaggg

SEQ ID NO: 14169 - DNA, 109159 bp, Human
ctgcaccttgacacacagacccgggcacaggcctatattcacacgcaagcacactggcccattccacaaatacagggaagaagtgccttgaaaccttccaggcagaggacagctagtgacgaatgaatggatgaatatgcaatatacctaatatatatgtgtgtgtgttatacgtgtgtatgcataagtgtatatgatacaaatacatgtatatatacacacagagaatatatatccacctatggaggtcaaagcaggccaggtccccagcaaggctggtgatgtaagggggttgctgtcttccctgggcacacatgctatggcttaaagcttgatctcccaatctctcccgggggagggccccataacttgggccaggcaaagtaccccggtgtcccccttccaattcgaaagctacttggcatctgtcttctcagttagagagagtatgagctcaacaagtttttcatcagggcccccattcccagaaggcccccccaaaatctgatgagccccttgtgctaggagagtggggagaggagggagatctgtcacatgctgcaaggggcaaaggtcacaggtgaggcgaaggggagggatggggacaccctggggccagccagcggtgagcgccccaggctaagacaaggctgaccccactgccgagagagggcgggcagggggtgagattgagggctgggttcattttattgtattttgcctccagcgtggggccagagacgctctttcccccgggagacaaaaggcctgcagttgtggcgtcctgccccgctgggagggcgtttcgcccccaggactcggtgtcccgaggttgaggctactggtcaccctggcttcagaaagcgaagaattcaggaacctctgatcaccccaccctgactcctgatcattcagttggggcgtcccctcaaacccaccagcaaggagctcagagttggtgagttcagagctgtatcaagtcttgacgggctccctccctcccatttcccacctctttgggcccccagatcctcacaccagcaccaactccctgtaaacccaactacctgctggaaaggagttataggcccggcctgggggcctgaggaggacggcggcggctggagacgtctgcacggggcggaactggaaggggaggaagaaacctgtgcctagcacttggcagacccactttgccaagcctcggaaccagatacggttactgggggcttctcagagcggcaggaaggtagagtaagaaccggacaccggggctctgacattacacagaaaaggtcagaattcctcccttcaagtcaccctaggccggttcccggggagcctcactggaggaatttcagagggtgtaagacgagggagaagatgagaaatagggcggactctggccctcggaggccagagaaaaggcgagactccagagaggcgccggacccgaggcagacattcccatacagccgggactccgagagcagccgtgggcgacctgggggccggggactcggcggatccggcccattcatcaaaggaaggcactgggacaaagttggccccctccccttctcccccagcccccaactcgccgggatcggctccctctcttttcacggcggttcaaattctcccccaaaacgaggtcgagccggggattagaaaagagggaaaaaaatattcgttggcgatttcttttcgttattggtcctccgctcccttgcgccctggcccccttccctcctcatgaataaaagaaaagtccgaacctatcagatcgcgctcactgcctcctcctcctcctcctcctcctcctcctcgtacttcggtgaacacttttgcacaacttacccagctgatcactcgcgccccctcgcttttccatttctctttccccaaccccgtcaccccctgtctcctccgtccagccctgaaacccgaggaggctccttcttccgtctgtccccgggtctcctaggggacggggctgtgaaagctggtgtggagggagaagcgagtgtggtccggagaaagaaggcgtggagaagagggagggagcgagagcgagagaataaatatataaataaatacgagaacgaaatccactccgcagtctccgggctcggaaactttggccccgagcgccagagcgccagagcgcgagagcgcggcgctcgccactctgaggctggcggcctcgattccggccgcgttcccccggcccccctccgccgcggggcctggtctccgggttctgccaggcgcatcagcccgcacaacttctggccgaggccagccggcagaggcggacttggggttggagtgtttgtttgtttgaacttcctcgtcgtcgccaccttccctccccccaacctccaccccacctcacccccctccccagcttctggacgcgtttgactgcagccaggggtggggggtgggggtagggagtgtgtgtggaggggagggagaagaggttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaaggtaagaacgcccaggctggcctcgccgcgactccgccgcccggaactcggggtccttggagaggctgcggtctccaggggacggtggcggcgccggcgatagcagagggatcccgttctcttctgggtcccagtccgggcgcggaacccagggagtttctgggacccatacttgtccgcttctgcgtgggtttcactgcccggcggccttcgtttcgcaggtcgctagctgccggtctttacccgcagggctgaaattctggtagatttggactcctagtaaatatcaggtcctggtgaatttcagctctttccactatttccagacacttcttccctgacagtttctcggctctcctggctcgctggctgccagctttctactcttgttttgaattattttttccacccccgggattggtcttccagtcctttatttcgaaccacctaccatgggtgatactttatatgcctcaactaccacggctatccatttcttccgaagccacagtcaaacactcctgcttttccgcctggaaacaaactaattggaaataataattagtaatgattttccccctaaaactttttactcgggcttccgcactctggaaatctcccgggagagaacctctaaacggcgaggtttagagaacctctaaacggcgagaggggcacggcaatgtccaaacgagaagaaagagctgattttgtaaagcgtccttcctaaacatccagcgcccgcccggggagacccgataggacgggcggcggcgaaccgggtcctggctggagaaaaggctgggagcgcacagcggagagacccgctcctgtgtttttgttctgttttctttttaaactaatggaaggcctcaacctgtcactgagggatcatttggcttctgagggtaggtagcctagggtgtcacagagaagtcattagaaatatgtgcgactttttttttttaaattactcttcctgtgatcgtttgagtccctggcgcgtgaggaaggggagaggaggcagggagggggtgggtgggctggcagcctgcgatccgggaggagctcccttgggcagcgagacggcgccgggtccctgaattagacagaggcgaagagagcggctccgtgatcaagtgcgcgccggcagccacgcaggcgggagagcgcgcaaacccggggatttgcagtggcactctcctgtagcgaatgcaagtaaaacaggcggctgaggacgcgcggcggattagaacaatatttgcccaacatgacgcagaatactgaggagagccgagtgccggtcgctaaagaggctcttgaatataaagttgggcgctcgagagctcttgagcgctaatggcatatcccgccacggagaccgagtgactccgactttgcgacgcacgatttctgattaaatccgagagtggcttcagacaccgacttttacaaagagaggtggggggaccgggagagcgagggagggggcggtaggaacggcccagcagcggagcctcttctcgcctcctccctttcaattacagtcagctccctccactcccgcggctgtgaaatcgttctaatcttccagatctccgcagccgctgagtccccaaattggggggatcgaggccggattagtgcgctgggtgtccccccaatcttctgtgaggaaattgtgtagactttgcattaaggcaaccaggcgttctcccctccccagcacacaccagtgatgcctgtcttcccggttcccaaagtcacccccacccggggggactgtgtcccatctgcctaccagcctcgcagagcctgcaggcacagttcatggatttgtgaggccaagtcgactatttaatttaggagctttggggcagtagtgtcctaaaattgtcccaaaacgaaattaggacttcgagggtggttagaagcaaggagagtcacccaagggacaaccaggtgcccttggaggcagcagccaacagcatatgtcacccgtccctcggctgtgcctcagctgttccctgggacagttccacggctctagccagagctgtaaatgtagtaatcagccaggcctttctagcccccaacaaactggatcattcatgactaccaggagcgtagaactgagcagatgagccacatcacacccgttattggcctctccaagacgcaggcaggcctgcagcccaagcttcggcctgagggacagatagtcattggtcccaagatctctaaggctctaccagcctggtggctctgtctgcagtctcatcttcatctctctccctccccttcttagcagcattcgaatcccccaggtgtgtcctcatccctcgtagtgtggcaggagttgggggacacagcatctggggagactcttgcagctgtgactcctctatccatctctgcaggagatttcctagatttatgacagttgtttctcaaactacctacctaccgaagccccagtgtgaggaccaccgggattgctgtctgaggtcttggggctcaaacaaacaaaactggagtcagggagtgtactcagtgtctgctctccatcctcaccctgcacctctctccttctgcatctcccctcccttctccagtgtccaccccgcttggccaaggccgggtcaatcagctgggaggggtcttcatcaatgggcgacccctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccagagtgagtgtctttgccacagaggctggcagctggcttcctatagtcgggggctcctggttgtggcccctcttactacctcgtggcaccaggctgtaggaaagtacagctggagggtgtcttctactcccagatgtcctcccattgttttcctattatttgaatttctcagagatggagctaagtgaggtctaggttgtgcaagaccttgaggccaatgagccattcctggactgtccccacatttgcctcaacccctgtcaccttccaagaccagaagacatcttctctcagtctttcctgagataatgacggggaccctgggggtcctaattagagttttttattgcctatccatgtcccaccccaccccacctggccagacccccagctgccttcctgggagccaggaaccggtttcttgaaaggataaagccaatctcttgggggatggggggacacaaggtaaccagaaccaccagcctggtctggggctcttaagaggtgatattaaaagtattttcctccccccatcccatctttccactcctactctcccacctccacctctgaagcaggtggcgactccggatgtagagaaaaagattgaggagtacaagagggaaaacccaggcatgttcagctgggagatccgggacaggctgctgaaggatgggcactgtgaccgaagcactgtgccctcaggtgagaaggcagctgagccggcagagctggcccagagtgtggccaggggtccagtgtggagggctggaggtgggagagaggggagaggagatgatggctgactgtgaacttactgagaagttgggaggaaaggagtacagaaaggcagagttaaggcataggagtaaatcaaaacagaatggaataagatggaaagaaggaatagggaaagaaaaaaagttaagaaaggagagagaaataagaaagggaggaagaaggaaggaaggaaggtaggaaggaaggaaggaaagaaggaaggaaggaaggaaagcaggcaggcaggtgggcaggcaggaatgggcaaaaagttaacctagaaagctggatgataagagagcccccctggaggctttttcggagaaaatggcttcaatagatggatctgtcctaggagggtggatgcccatgggcttccctagaccaccgtctcagagttatgatttctgctgtcgccaacaccagccatttgagtcctaaatttggaggtcccaaaccatactgcctgtgagagagaaagtgatctgttgtgtgtgtgtgtgtatgtgtgtgtgtgtgtgtacatgtgcattcaggcacgcagggccagaatgcacacctgagtgtgggagtggcagcaggagctggagagactccagagaggccctgggacctctcgggggtgtgggtggaagtgcacctaggcaggtgttagtgtaaggcacgaatgcatgcaagcatctgcatagaaatgcacagtctaaccaccctgtgagtgcccggggtgtgagtcaggcttctccaagtggatgctggttatggagtacgtgtcaatgcctaaatgcctgtgtgtggaagagggatgaatggatatctgtaaggaagcagggggcttcctgactttctcccaggggcccaggccaccgctcgctcctctgctccaacaacttatacttgctcttttgcctttgaatttctgaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaaggtagggaacttccctgggctgcgaggccccagcccgggttttcccacgctccggtgtgcgggccagtggttcgctcccgccgccggagcaggcgaccagaactccagcggagaaactctcatgctgcggggcagctgggagccgctcaggctttgccgacagcgccccctcggtgcgcaccccggatgccggctagatgcgaagcccgcgccttctttgcgctatggaggccgggcacggacggcctgtgagtcccgggagagcccggctgcggggctgcgcgcctggtctaccccaatactgcggggagtgcgtcctcccgggctggcgttttggctgctactctcggcgtcgatcaattatttataggaaacttgggcaagggggcgggggacgggagggagggagagaggaaggaggagccggcccgcggctccctaaatgaatttgttaaccagacccccacacgctctctaaacggtcccttgaaaccccgcctgacagttgactgaccgctgcaatcaataaaaattagccagggccgccgcctgactcagccccgcgttgccagggcggactgggggacagagagtgccttcctctgtggcgtgcgccggcagggctgggagtggaggccaagttcccagatgcccagggtcggaggatcgcagtgggggagagacccaggctccacacaccctctccccattcttagcacggcttccgcgggcaggctggagtctgagtcctgcgccatgctttttctcaggatcagctaaggagggcgtttagttttcaagcgcccggaagcccgggaaaggggattgtgcttttgtttcttgacgggaggaagtttcgagagaaggaagggaaagtttttcctcattaccccctccccttcctcattgccctcataattcccctcctaagtctctttgagacttggtaagtgcacgttaaggggcgacagggagagaaacagaaatggaagacccagagtcacaaagactgacagttaaagaaaaggccccaaacacatacgcggagaggcggcaggctgagggaatcggaaagacagtggccatgggaacccgcagactgatggctttggaaaaagtggcgagtgccctggaacctgaaagcttgcaaaaagccagtgttgtttcagtctcccttcagaggtttctcccagcacccctctcctcacgacccaagcactcctagcccaggtctctctccagttctcagaagaccctcccaaccttgaagatgaacttcacagacaaagccggcttactaagacaactcccatctacgcccagcccccacaggcgtggtccgaggaggaaggatgggtggccgggcagccccgtgtgacagcggcctggagcgaagggaaggggcggccattgacagacagggcccctagtgatgccgcagtcccgcccgggacaaaagggcgagggaagaaagggagccagctgtgccgggcgccccgctgtgcccggcctgccgaggggccacgggtctgcggcgggaggcagccctgcactgccaagcggtccttggctaggccagtcggcccagagccctgggacacctgccgggggacccagtccttatttcagttcccattggaaggagactagatggactttttgtgggttgtggaggggaggcatagaactcgaataatctttcctggacaaataatctttcctgcacaacaaacaactcttctgaggttatcccagggagaagcagaggaggtttggttttccttggagagactttaattgtgtttgcacgcagggagtatatccagttcaatctgtgaggaagcacaaataggtaaatttcctctgagaaaaaagggaagggaaggaaaggaagaggatggaaagatcgtgcggtttggaggattcctctgattccagggaatgcggggcgttccatgctggcctgtgctcaccacaccagctaacaagccactttgctggatagaggttttccctgcagcagaaccaggaagaaccacgtctccaagggtttaaagtggagcctgtgccagatgggggaggctgaggacacaggtgctaagtctagaggagctgaagaaatgaaatgatcttatgcagtgagcctggtctccagaaagtcccgcagtttttgcgtgacagtgggtgtgctgggtgcgctgattgtgctttgaatggctgtgtaagcgcaagcatctcttagtgtgactgtttacccacgggccttctgatctgaatgctgtaggccatatatctgtgcaaatgggattcagcatagatgtgcagggagtgtgtagatgggtgtgaatgggcaatatgatggtgcagatgagagagggccatctatccatctgtgagcaaattgtatccgtttcctatttgagttcctgggctggtcggcaggcacccctgtgaacccctcatctctcttccaggccccagacatcagtttcatgtccaagttaaaggtgaaaagaccttccaatctccatccgagtaatccaggtagggagaggcagagatgccccatggccagagcagggggagttgtgcacacccacaactttgttttggcttcttgctcttgaaaaatgctttctctgggggagttgcccctctcatggcagggagccaccaaagaaggggtttaagagctctcctctttaagcactaaagagagatccctccctgagtccgttttttcctatcgtccgcttggcatttaataatgttaagacttattagagctggtaatgaaaactgggactgctgaataggaaactgtgttggagaggggtgtaatagcttccaggcatggtaagaaactatttatccgcaatcagttctcactctcagagtttgaagcacaaacgttaagttgaagggttttaaagcagattaaattgagcttttatttctgtgcactttcatctctgaacagctcactcctgctccccttgggctgatattcatgaggctgttcatatttttttttttgctcttatccttgttaagactgagttattaggattgttggtggtgagtattctcagaccgttgccgataggtgcttgccccagtcaagcttggctcacctggaaagggaagtggacagttccttgcccccatgcacttagactccctcctcttcacccctttctccgaggatcaggggatagacaggccggggacccaacagggaggggatttgaggagagaagagaaaggaaaagattttcatagaatctgagctcagagagattcttgtggggaatttgataggggtttgcaatgggtcaaaccgttcctcagtgggagctgagggagtgagtgtgaagaaataagcaatagtataaaaaacaataacagcagtgacaaacaataagaacaccaaagccgcatgcatctgacagtgcaccagtttaagccaaaactgaccggatcagaccaggggctccgctttgttctctaggatggaaaggccaatgaggttacaattaatatgaaatatagggaaaagttacaagattagaaaaaagaagtagtagtagtggaggtagcatttttctccaggggacggggcgggggggaaatcctgggggtgtcaaagtccaggtggagaatttgcagacttcctgggtgtgaaagaccatctgaggtggggggaggattggcgaggacggcgagtgaggcagatttgtttctctttgtatttttcctttatttatttttaaggcagcaaacttacaggtgtggagtgggaaatgacggggaaggatcggaaaggaggggagagcccggagtgtcggttttagacacttgtaaaaggaggtgggaaacaatttaatttggcagcagcgatagctgctaatgcggttttcggtcgtttgctacactggaggaagctgttttgattgtgtgtacaaggacctgccaaatttaattaggctccgggggagcgagtgaataggggaaggggggcacggctcccctcagcccacaccattttttcggcttcacacctggaagggacattgtttacgggatcttcgaaaaccaggaaggggcgggggcggagagggacaggagccttggaagcgggggcgagggaggggacgaggatagtccatttatcacgaaacaatctgcattgatttaaaccaacaagttccctcctctgtaaatgtgtgtttagagaaaggtaattgacactccaccaaatcaaaggattaccccgggttggcaatctaatcaaacagagtccaggcgggatttgaagctgttcagagtgggatcagcttcgcataatgggggctcggaggaagatgggagggtgtcaggcaattcccggctttaggcagcgctcggcggtggatatccagtgcgaccagagggagagagggagggggcgctggaggggcgcgccgggccgggggctgggggggatggggcgagcggagaggggcgtgcggagctgggaacgtcccggcggagggggctcccggcggagggggctcccggcgaggggccgagcccacactgggctgacaaggctccccttttcttccctccatccccccaaccgaagaagagagagggggaggcgggagcagagactaacgagaaacaacaatgaggagataactattacaaaggcaaacactggcgctcgcgcgctcgcagccccagaacccgcggtaaataaacaaagtctgcaaactgtttgctagataaactcgtgcctaaattgagtgtgacgagcaaggagagaagagacagaaggagataaggttggagggggatgaatgagcataatctaatagaagacatttagaaaacaaactttaaacaagggagaacaggcgagcggagggcaattatccgccccagagagcgggggaagccgtcggaggtctgggaaggggtggaagggaggggactgggagctgcggaagagctgagtgttggggggtgcctttgggactccgtggggagccaagaggggctccccagggcgcgcaagaaaagaggctcggttcccggattgagtgaggttcccgtgctcagccggtcttggaacgcaggcacgtctgaaccgggtggggtcccccgctgcgagggcgtgcgggttttgtgttcccctcggggcacgcaccgccacacttgggctgtttcaaggcgtttgtacctaaaagactagtgtgcacggcgcagcggttaaaggaattagatatttaccagtttgaaataagcctggctaagaagaagagagaagagagacattgaaaagacgaggctgggggaagacttcaaacgaattcatcatttggaatggtggaggggagatttaccagacagtattgggaagttatttagatattaataacacattttcctgaggcgcgaccacagcagccatctgcgctgctctcggagctatttggctgggtaaaatatgggcgtctcaaatgttgggaagagataacgcaatcaggctaaccctggtcctgagactgcatcgcagcgttaaacccggattaacctccccccccccaactcccgcggccccctcccctttcacagctttccaaattttcagtggaatttacatggaaggatttaaaagcacatataacagtagccttaaagcagtaaggtgattatttgggcttttttttttaagaatgtctttctgaaaatgatagttgtcacacattacattatatataaataatattatataaaacatatttttatataggaaaagagggctgagcaaatgagatttcattccaggttacctctttggagtttctatttgccatcattctatcaccatcaacaaagttgatgaggcttcattctgtactgtgaggcaagagcacctaaggatataaacatgtaatgtacaaggtcctggccgtggccctggaagctcatagtctaagactagacagaactcacacccctgaaaagacaatgcctggttgagggaagggttcctgcacagaggagagacccccaaagaaaggttctctagaggctctggggccttgaaggccatgactaaggggggaggacacattccagaaattccagaaaaatagctcttctctccctcccattgcagactaaaggggtaattagcaaacaggatgagggttagaggcgctgggaagattaggatgcccccctcagtttttgctgtccggggccttccctcttcttttccccttcccccaactctggctgaaagaggaaaaggtggaaatggggtcagcgctttctgacctgctctggagcgattggccccggctggggtggagcagggggagggagggagggaactcgccttcccaaatcgaatcaaggcagaacggtgacctaagggggaaacttcgccattagtagatagatgtctccaaaacttcaaacgaagtggggtgggggagaggtgaggcggggaaggagtccagtgagagcgcagggggaactaccagcatgggaaggggaggggcctggaggaggaagagacggggtcgagggcaaaggggaggcgggggccaaaggaaagggtgtggggaggggatgcgaagggagggggtcggctgcacttggaacttcaacctcctgggagaggaaaagcgtctgcgggtcgctacagcctcgggaggggtgaagggaagttgtgtgcgccccaagtccagctcaaaagaggccccgagggcattctagggcgccttgggcacgcgtgccaggcccccggtttggcagccgagctgagcgagggtggattgcgaggggcactggggccgccgcggagctctgcgtgtcggctgccagtgaattggccgatttccccagtctgagggtcagcgaacggacctttccatggcttggtcgccctggtcctggaggtgcgctgggcccgagctccggtggagaccaagggaggggtggggagaggcagcggagacagagagccacagaggaggagagagctagaaaattcagagtgagaaagtctgagcgcagcagaagagaatcttgcgcacagtttgaggacgctggaaaatgcggaggcgccgagggaggcgccgagcagcaggaagaaagacaaagagatgcagaatcaccgagagactggccctgggacaggcggatcaggagagccagcgggacctagagacagcccgcgggagagcacgggccgagagggcgagtgctcaaagccgggcagcggctaggggaagataggaggcgggcgagccgcggccgcccttttgatccttcgtggcttcgccttatcagaagcgctttcggtgacatccgcacaaaggcagttcatcatattacagcacgtcccggcggctcgctgcgatcctgccgcttaattagaggcgagcgagctgggccggcagggcgggagggaggccgaccccgaggcgggaggccgggttctgcgctccaacccggggcgctgggcaggggccagcccgcgtgcctggcggtgttgggacgtggagagagggagaggccgggaactgcattcagagcgttgctaaattaacaggccggcccgggcttcactgcccggagagtgaagctcgccgccttccaatttagccgccgccccttctaagttcttgggaagggatggcgctccggccactttcccctcttccaggctgcgaacgctgcggactggagggcgagtaatggggaggcaacccagggcgagctgaaggcttagtgcaactccgggtccaggtcgcacccaccagccccccgcggctgtgttccatcccctcctccgaccgccttgctctccatccgaacccaggtgtgccaggctggagcaatctgagaggggcaaagtgcatcgtggtcgaggttctactgtccatcccacccgcaactcactagcgatatcactctagacaacccattcaacttctttgggcctcagtttccttccatgaaaaaagagaattagctaagacaaatgttgttatccttttaggggatcctggatccctttaagaataggctaaaaccgaaaaaataattctaaaaccttgccatttacatacttatatactttcatacaggcagaatttttcatctagtataaaggggtctttggggcttctagaggccacaccccattcagaacctcacatctgcgtgcttcctgatgacttcagtattctccagggagcttctgattccagcatcaggaagctcaaaatgaggacatggggcggaggggcactgagatcctgcccttggtctggtccttgctgcttcctcccctctccaaaacagagcggagagcttctcctccaccccacttggtattggaagggtcctttgggaagtgtttatatgctgatataagcacgtgtactatgctcccccttttacctataccacccaaaagagaaattttcctctggagtgtatgtgtgtgaatgtcttcattcattctgcaaaaatttttggagcacctactaggtgccaggcgttgtgttaagtgacctcaagaaggtccctgccctcatggagttctgagccaggcggtggagacagaaaataaacaagcccgcaaataaacagatgtgtctcgttatgtgtttgttgtgtgtttacctggatagctttgtgggcttccctcttcgcaagactgtcttgtgtctgggtgtttgtgaatggtgtgtgagtgtgtgtgcgcgcgcgcgcgtgcgtgcgcacgacagcagagtgtgtttgcggggctggggctgaatttggcagccagcccccaagctgacctctggagtggcccgcgtcggcgggctgggccttgcttcgccacgggttcgagggagaggcggagggaggagcggctgggctgcggagcctcttgccttcactgcactctttgtctgacaccacgaaaagaccgaagatcaaagaggcccccgagcgggacagaaaaaggggtggggcggcgggcgcgataagtagctcggaaaactccaccctaaacttttctgggtcctttccatgggacccagaccctacagaacctcacccaagtgggcgagtgggcggccggccgtgggttctctacagtcccaagcctccgcgagggcgacaggtggagagggacagctacggctgcgggctccaattcaggccgaggtctttcggtgactggagaaggtggagacagagcaacattcagaagttttgtgaggcgtgtgtgtgtttgtgcggtgtgttctgaacacttttgcagggagattgtgagtctggatcaagcctcctggtttcctgaaaacttgccttaagtctgctctggctttacctgggctgcagacttgggagttggaaggagtcaggaggagtcctaaggaagcttctggaacctcttgttcccagtggaagcctgcagaagcacctccgtctcccgcactttcttgtaaccacagccctaactcaggaagctggtctctaagccacctggcaaggcgctttcccccgcctcccgcggtcctcaccctgcagctctccttcccgcctggacttcttgagttcgaattcacccttccgagggtctaaaaatatggtagaaaaataaagtccaatgtggggggatataccccatcctccattctcctccctcccgctgcctgcaaatgccaaaattcaaaatgcccacccgttctaccttttccatgggggaagattctgaatgattgcagaatcccagcatgtccgggatttgtcggaggtcctcggagtgaaccctaagaaaagaggccttggaactttctttaataaatggggctgaacctccctctctcttcaaattaggttctggttgggactttttctctggtggcctggtggcccatacaggggacacagagaggtttgcccagagctgcctgttacaggcaattactgctgtaaatggccccctttgcgtcgaccctcttccccaaaaacccggtcttttccgtctcggcggtacctgagcctcagtttccctatctgattagtgaggataagagccgctcctggcctccccaggcagcaggaaattagggccgggaaagcggtttggaaactggtcagcgggtgcaggcgggcagagggtgggaggcgtcaggagttcgtcctcctccccggggcgccccctccccgccgccctctcggcacagtccccgctcgcgcctcaatggccactttagaaatacaaacaactttagaaataaagtaaccaaacccccgaaagcggctttgaagaggcgaatgcctggtggcgctttactatggtgtgggccgaggccccggcctaatcccgctttcatttccaccgacggccgcgggggaagcgctcccggcctcccggcccctcaggaggctgattaggccacaaagagcccccattatcccgagaagaaaaccggggggcggcgcggggcggcgcggcgcggggggagcggcccgcccgcgcccgggctattgacttagtggatgaagtcaagagcgggcacgctgggagcccgggggtggggtgggggggagggctggggccttgggcggggatcccggaggtggggtgggggaagggctggagggggaggggcgacccgcgcgggaaggggcgggggacggaacaaaacagaacgcacaaaacccacaacaaaaccgagctccgggcgaggggagccgggccctggtgcagggcctcgtctgctgagcttggctgggtcagctgcccgcgccggccagcggaggggaggggggcaaaggacctgggctccgccgccactgccgcctgggctgggttgcttacttgggacggggtggtggaggaaaggagaaagttgcagccgttggacagtctgtcgctaagtgctacatggcttgggcacgcggctctgtggctcaggctctctagtcctcctctgtgaccccagggagctgggtacagaggtctccaaaagtcatccccgctgtggtggcctgcgaatctgtggtcacagctatagtggatgctgtagaggagatgcctgaattgggcggggtggggggggagaggagaaggaggcaggagattgaaggagaaagaggaggaccctggattctgaaagatctgggtaattttgagtgaagcattctgagatcctagatgtcctcttctgcaaaatgggtccatggacacaacctcaaagtaggctaggaagcgtaaatgctataattacgtaaagtacagggcaaactgggaggctggagaaatatcactcccccatcctctcctgcctcctcatttcctccaaggcttctttcagtcactcccctatgacttgagaaataataggggccttggaagaaacgggctgtgaatccataagtgatcaccaaatgtgggcgcaggtggggtgggggcagatgctcagccaagtgcaaataaatagtatccctcctgatctacagttctagacagaagaaatagacctgctctgtgggcagctcctcattcagcagaaggtcaagagaagaaggtagaaacgcacagagccagttcctggagcccagtagacactgttctgtgtgtggagggacttccctcccctgatggcttctgtccccacaggcagaggctgggcagccttgactgacagggtagggaggtgtgggtgagtgctctggtttgaggagatggtgaaaacatcctccaggtataaaggaggtaggtgagggtatgtgacacaggctcctacctgactggcccccagtcacctcccctccccaaccacagctgttttccccacccccagccatctcccagaaaaggggccctgactccagtgatttggaagttctttgaaggcaatgtcactcttcatccattcactctactactttatttttgtctttttttttttttttttttgagactgggtcttgctctgtcacccaggctggaatgcagtggtgtgatcactgctcagtgtagccacaacctcccaggctcaagcgattctctcacctctgcctcccgagtagctgggactacaggcacgcaccaccacacctggctagtttttgtgtctttttgtagaaacaggattttgccacgttgcctgggctgttctggaactcttggactcaagcgatcctcccatcttggcctcccaaagtgctgggattatagtgatgagccgccatgcccagccattccactactatttatcaaaccctaggttgtgtgggatgtgctggggaggataacccccactgccggtccagactcatcaaaggctaagttaaggaggtaggacttattccaagggcagcggggagccatggaggatatttcagtaggggactgatggattcaccgagccgagaatgtaccggaagatgtggagataccagctaggaggtcaaggctgtgggaaaggagcagagaggtgcagaggggctggagagcagaggatgcaaggagacatggttaggagaggactgccccagctggaggtggaagaggaggaaagcagcccattcccagactcccgccactgatgcccaagggtactgagcccgtgactggctgctaggttcattcaagggaacttggaattcctctgcaggctgagattacaaagggtggagtcagactcaaacaggccttagaggtcatctggccattttacagatggaaaagctcaggtccagagggagtgacatgagtgaggccaatggaggggaaggccactctggtctgctgacagttatgtgcgggtacaggagcaaaacggactggtggaagctttgctcccaggaattaggaaggcatgggataaggacagccatgggaatgaggcctttccccatgctggcagttcatcgcccttcgtgtttaatgtgacacatgccttaaagttctgattcacagagggggagactgaggcacagagagttgattagcccaaggaagtaaggggaggagggtccccttctaacaggctctgcaggactctgacacctttgccctaagaagcctgaagggcagcaagaatctcctcttcttaccccatctggacaattgcagcccccatccccctcccccgttcttcataaaccccagattctcaggtccaggggagactgtggttcaagccattgccacacccaccccaccccgctatcacccacactcccagcacccataagcacctactgggatctcaagccctgctagatgccacaaacttggcctgctgaagggttagtctgtccaccatccggggaactgtcctttcaacagcaagggaaaataaagcccagagggaaaagaatcacagattgtggttagggttggaattcagatcctcatgtaaatggccccatgcagaggccctagcctgagcactaactgctgtgtcattctggaagagccgcttcatgtctctggcccctggtccttttgtctgaacaatggcaaggcaggatccacctagtggttttcaaactgtgttccatggagtcctgggattctcagcctcaggggccatcctttgagctgtaatactctgggcgtgtgtttagtggaggggaagcagtgaaaaaacagcctgtttccccatggatagaggaaactccggggaggcagggctttgtcctgggaagagcaaggaccacttcccatccaaggctactctggaggagggtgaggggaagaagctctgtatactcctggaatcagagccctcaggctgtggttattggtcttcagagataaggtgataactgcttatctggtgacaaatgattatcctcctcttctattcctctgattagggaactttctctcctggctgggaggtctctttggaaaaagggcagggctggtcaagagacactgacatctgcctcttcagtccctgcccggcttgctgtgtgaccagaaagcagttacacactctgtgcttcattttggggcctggtggagcagctggcttgcaatgccatcctgggatggtgctggaaggaggattcaatgcagcctgtgggggatggaaggagcaggagggcagagggcggaggacagagggctgtgccccggagtcacccaggtgcttttgcaagacatacacacctgggtactttcttgatttgggacatctgagtacagtggctttggagcaatctgtcccgatcattctgatggcctccccagcaagagccactggtctcatgcaacacctttttttatagatggagaaactgaagcccaaagaagggaagagaattgttacctgttgcatagcaaacggagaggagtcagaagagagacccagtccccaaagtattatgccaggcaccatgaagggaacattcttccaaagtttctgggtccctcagcttttgttacggtcacctgtccctactgagggtcccatctgccagggtaccatgctgggaacaatggggctggcagggcaagacctctgctttgtcctactgtccccaactcctgcttgtgccatggatggtctcccagacactcactgtcatctcagctctgggctctgagcccttatatccacaggcagcttcagtgcacggaaggacccctggacttggaatcagtaagacccaggttcctccccattgctgcccccaccatgtcccctgagctgtggcttcccctctctcagccttagttttctcatccagacaatgggagcaaatgaattaaaacacagaaaagctatgtggcacataggaagtacatgcttaaaatgagatgaaagacctgaaagtgatttgtgtgaaatacatgatccctaaaagtctatatgctgagaatttcccaagtcaaaagcgcattgtctcatcggtggctctaaaatgtatatgcatatatttttataggtttttgaaagatttattgcaaaagtaatatgtacttgtaaaatttcgcatcgtaaaaaagtatataaaataaaaattaacaatccttctctatccctagcaacagctttgttgagttgggatataactgtctagatttatacagtgatatctagatacgtctctctatctagatctacctatccatctatctgttcagatgcagatatatatttgaaggaaagtggtgtcacatctgcttaacttgggggcaatagaagcttcaaggggtgactgtgaatccgcagaattaatttatcagtggtgggtatgagtctggagagagattccgagtgttccagagctcagggtcccccaaaggttaagcatcctgagttggaagatttgcaggtgtttgtcctctcaaagttccgtccctccccaacaccctccctccaggcttcacagtgccacccctccccctctcccctccccgccccccccaccccaccgcctcttcatgcacctgctgaggcttccggcctctgctgcttcaaagaggcaggctgggctttacctgcctgccttggagaaaagcagcctggtttgaaaggggaagtggcatttcaggcacttaattagacccgggacaagaatggaagttggctctcaggtcaggccaggggggattgttgggggattaacactcaggtaaacccatcaaggctcaccggccccctggcaggaggcagcaagagaatcccgggcagcagcggaaaggctgggccggctgggcccacagcctgggaatcacattccagagtggggtagtgggggtgtgcagagccggtagagggtgggaggggaagggtgggccactggctgcctccacccttaacctcaactggcccccttctcttccccgcccccccattgccccaggaaggtagagttagaactaccattttattcctgcagcaaaatgtattgagaacccactatgtgccaggcgctattcctaggagcacagccagcaatagcgcaaggtcccggctgcacagagctcacacactgggggaagagcaggttcaccaatacggaaaggctttcagaaggtagataagggcttgacaaatataaagcagaattgtgatagaaagggactgacagaggagtgatgtttattaatagttgggctatcagggaggcctgccaccagaagaggtgatatttgacctgaaacctggatggaaggaaagaggtaaccatttatggaaaacatctactacttaggacaatggccagttgagagctgactgcatatgtgttaagtgctttacattaatgaattcatcagatcctcccaagaatacctcaaaggagagattattaattaagaagcccattagtagatacagaaattgaggcatacagagaggtgcctcagctctttgggtccagatgggcagggccatctcactggacacctgtgccctccccctgcccacctcttgctatgtgccagaaactgagccaggtgctctatacacctcccttaactccccagccatgccccgtgggtatctgttttcccagttttgtagatgaaagcacagctcagagaggtttactcagttgcctggagtcacacagtcaacaagtggagagccagtcattgaatctggtaccacaaactcttcctgctgcaacagctgtgcttttgcaggcactgactttggaataccctcagctgattcacagggtcctttgtcctggggaatggccttccctgtctccttcagggaaagggtttcatccttcagggaagattcattgaatcaggatttgctgggtttttttcatttttttttttcatttcttttttttttacacgaatgggcttcctggcccgcattttgatttgcgcttgggtttatgaattgaggaatcacagtcagccttgggaattagttgcaagataaatattgcaatcctggttaaggacttaagaattgtcacttgtgtgtgtatattgttgttgttgttgcaacggtgctgtgtacgcacggttacagtggatcaaatttggggagttaggaagtggcgttggtttgtggttagacttgggggaggtgtcgctttcggttgttggtgtgctggtggctgtgttcctgtgatatggaatgtactgtctgagaatgtgttcaggggtctgtggttatgtggatatgggtgtgtagctgctgatgacatggatggagggatgtatctgggtgtgtttctgcagaacaagtgatacctgtaccatgtgactttgtcagttccaccatgtccaggcacaggtcgggggggttgtccatggttctgaacgtatctgcccccattttacagataggaaaccaagacttagagaggccaagtcatctgcttgaagtcatctagctgagaagcggctgagcctgaagggaaaccagggctgccttcagagtccagcctcttttccctgctccccaggaaaggttttagtaacaataaaaggtttaaatgccagcaaaaggtctaaacgccagcgtcggtcatggggcctggcagacgtgtgtgcggtcacatgcatgtccccattctcgttctggtgtctcagctcctgcccattctatgggcccccagcccagccctgtcgcaggagagcctttctttctcgggactgcaaatacgccaaagatgaacgccgcccgcagctggctggctgcagccctgaacaatggcaagacctaggaagtgaagaaattgcccgaggagcacagcagcccagtccagagaggcagttcacagagtctgcctgctggctctggctcgaatgcagtgagccctccccccacccgccagctccacactcctggctgaaaggataaacagtctgcaaagaaattttccctagaaagaacacttcgctcaagtgcaagtccaccaccttagaccagtgattaggggagagttaaagaaggggaggggtgtcccctctcagggggaaatatgcaataaataatcacaggtgggagagcgtgaagtggaggggctggaatcccagctgcatgctgaacccagctccaacaccgttctccagaatggatgacaaaatgcaacacagtaaaacaaatctggtgctcatgtgcaatgccttcctccttcctaaatctccactcacccacttcttcccagcgagtggcaaggtggcaggtgccatctgagaactatctagggtagcagaggaaaaaaaccacaacagcgggtgggctgcaaggtagcttgtacaaatttgccaggccgtaataattagagatgaacagagcatgctcacgtccagttgggagggagctctggaaagcaaacttggaattctggaggatttaccatgagctagacacagctcctttaatcagcacagccctatgaacttcacaggttttactaatcccattttacagatgagggaactgaggctcagtgaggtaaagtcacttgcctgagatcacagggctgaagaaagaggcaagaggaagcatttgaatccaggcctctcaggctttgggcctggggcctcctatcacccctggggtggcaagggaggagccgatcaaaggaagaactaatcttgcttggcacgtgcctacaatgccaccgtgatattagttcctgggccagaaccatatatgcattcctttaatttgggcatcattgttatcatttaattttaactctgctattttgtctggagctagtcaggtttcacaaactccttcccaattcatctcattactgcaaaaaataaagactgttattttcaatgaagacaatgtgactcctttccaggggccagaagctggtctccctggattccagtttccacggtcagaaacaagggctgcggccggtcccagcccatgactacagagcttagaaatgcaggtggcacgtcccctccgtagatgaagccacttaattaccatgcaatcaatatgcaaacaagtgccaaactgggtttgaatcaaatttctcattggggactcagtgggggaggaaagtccagccgaagggggccaaccgggatgagctggcagggagggggctgcaggatgaagagatgggcttcagctgggacccaggcacctgagggttgctcagacaccctccacagtccccagtgtctggcacggggcctcgctcccattgaggggagccggggcctgtggctcagggctgcagtcggcgggagggtttccaggcctgtcagctgaagtctggcggcctccgctaattcatttgactcggaaatctcaacttgaccaggttccccctcccttctttaaaacaaactcattaaacttgtcaacactcattaggcctgtaaaacattgaactagagccactggggagacttggagagggtgtgtgtgtgtgtgtgtgtgtgtgtgtgtgtgtgtgtgtctgggagtgtgtgctccaaagctgaaccaggccctgggagacccatctcctaggctttgcaggggcagaagtcacattcgtttgttcatctacttccttccttcctgcatctgtgtttcatcaaaggcggaacagcttgggggtttgcagcatcagacttgagctggaatcggcctttaccctcctggcactccaatgcagccctctccttagccttgccagtgtatcagtttaacccatctgcgatatgggtattgtcataacggacccatttcactgggctgttgggaaaataatgcatctaatgcgcttataacaatgcctggtgcattttaagagtgcaatgactggtagctattattcttgttgctgtgattgatgatctaaaatgtaagaggcaagtccgggcgcagtggctcacgcctgtaatcccagcactttgggaggccgaggcaggtggatcacttgaggtcaggagttcgagaccagcctggacaacatggtgaagccctgtctctattaaaaatacaaaaaacaaattagccaggtgaggtggtgcacacctgtaatcccagctactcgggaggctgaggcacgagaatcactcgaacctgggagggcagaggttgcagcgagccgagataccgccactgcactgcagcctgggtgacagagtgacgctgtctcaaacaaataaataaataaaatgtaacaggcggcttcatttagcactttgaaatttggatttggaaagattcaagtttggatttggaaagattcaagtttgaatttcagcttcctggtatgagactctagatcacagaccatttccctgagttttagtttcccaaagtaaaatgagtaaaataaatgcatgcataaaaaaaagggggggataatgaggcgagacgtggtggctcatgcctgtaatcccagcactttgggaagctgaggcaggaggattgcatgagcccaggagttagagagcagcctgggtgacacgaaccctctctctaccaaaaaataaaaaaattagccgggcatggtggggcacgcctgtggtcacagctactcgggaggctgaggagggaggattgcctgagcctgggaggtcgaggttgcagtgagccgtgatcacaccactgcactgcagccttgacaacagagcaaaaccctgtctcaaaaaataaataaagaaaaaataggatcatgtcaagaagtgagttaacacatatggaatcaaaactagtatggtgtctgttgctgtaggaatatcaggaatgtccttttttctttatttccctccctattcaacccacgaccccaccttaccaggcagcgcacaatcagggggacaggttgagatcccattgctttggcatggagcatgggggtgataagaggctacaccttcttatgacctaatccaaaagtgaggcagatatgggctcccaggagaggggctggggattgaaactccacccccagcctaagggtggaggtccctctgatctgagaagcagaagcctcatgtggagaggaaaaagtgctcagaggaggaaaaactggccccatcgcctccaccttccatgaaaaaaaaaaagcctgcagtttttaaaaactgcctgatggcaaagagaccaaatgaccccagatctagaaagagaaaccagaggaagggttcctggctgctcttgctttctgtcactctttcctcctaagaagctcctcttcttagcccgcactctctgagctagagacctggtctcctctgcctcctccaggctgccagcaggacccagctccgctaggcccagggacacttaaagggaagcagaattcaggggcccgatgaatagcggttttgtctgggctgccttttaggatctgcgactgcagtggtggtgtgttctttttccctttaaagcggagtgtctgctggctctctctctcctctctctctccccttccccttcttattgagaatgccccctaaaaaaaaagacgccagccttctgctatttttcttctctctctgaaaatgagaacatcagctattgaagcggattgatgaactcttcccaaaagtttattaagggaaggttagacaaaggccccagggcccgcaggcgactgagcagtcagtatatatactgggcccttttgtccccccagggccgacgcatgaatacctctcaatggccctctttagagtgacaagatcaagccagacaacagcttgttaaaaggaactgcgagctgtttctctttttccagcccaaagctccgtccatcacttctcctgcattaatgtacatctgcagcgggaggaataatcggctggaattctgtcggttttgtgtgggtttttcttttttcttaaatacacccttctcctcctcttccctgcccccacctgcccctcctcgctcctgccctccccctccccccacaaaggtcctggagccatatgttactgagcccatcctggctgtgtcttcgagggaccccagggtgggtatttctggaagacagcaagagaagggggttctgaagcttctgttccttccagtgcatgcttataataatcaccccgtttccgaacacttactgtgtagcaggggctggactagggacccaggtgtaccatcgcctctgcagactttttcatcaaggtaggtgttattggccccacatgatggaagggaaagtgaggcaagagagaagtaactttctcagggaatcatctgggatgcaactctaggcctggcccactcttgggggctcaccctgattttcagctgctgcatgcaggacaggggttaaagccaaaagcaaatcttagccccagttctatggcaggcttctgcccggctgactatggctcaggcagctcagagagaatgtgttctgcaaggaaggtttgctggtagaagcctgaccccaaggacacgtggctgggcaaggttgtaggagagctggctggggttgacatttcataaacatgaagttgccttgggagaaacctttcttcattatcaatgctaagggaacccttgctcaaacaagccagggttatgcaaaactccaaaatttccttcatttgagctggagagtgtgtgtgcatatgtgtgtgtgcatgcacgtatatgtgtgtgtgtacacatatgtatgtgtgtgttgtgtgtgcatgcatgtgtaatgtgtgcatgcctgtatgtatatgtgtgtgcatatgtatttgtgtgcatgcatgtgactgtgtgcacataagcatgtgtgtgacatgtgtgtgtatgtgtgtgtctgtgtgtgtactgcagattcactgtcctagtgagttttgttctgtgttttcagctcctgcaccagattaggaccttctttgagagcaaggaccagtcaactacattttattctgctttgatctcacctatttagtgccagtgcaataccatatgcagaacaggtgctcaataaatgctccctaacttgagaacttctctgagacacctgagcaggaaaggggagggggcagccaggcctctgctgagaattgaaggcaaggctttccctccccctcctttccacttctcttcctccctctctcccaatcccacatctgtcttaatttgggtgctactgagggggcctgaaaagggagtgtccctaatgatcatggtgtagagaattccacccatgccatttaccttcaccttctaaggagcttccctgctagcagggccagggaggtcatttgtactcaccttccctggtggtttttcccctggggaaagagagagtggaaaggaaaggaccttaggcaagtagccaggtggagggaaaactgctcttgcctgagaggtgggaaccctgcctctgagtcctggtagcaggcaactgtcccatttggcctgggactttcctggttttcccactgagggtcccacattccagaaaagccttcagtcccaggcagactgggattgttgctcaccctaccccctggcgtgtaaggatcaatcccgtaggtccgtggggctcaggtacctgtcacaaggaacggcctcaacctcctcccacctttgttaaggaatgggttggaagggaagagtgactgcaaaagaattgggaaaagcccagcgggccatgtgctcgaggaccttacccttcggcatctgccccttgcgtggggtggttgaggggaagcatggatgtaggaggtcggaattcgtccacgtttgtgggtagaattggagcccagtggctggagcctggggtgtcctccttatcaacgctcccaaattggagcctctgtcaggggaggggcccctaggatagggccaaatgggcctcccatttggagcttggctctttgacttagaccaactcaagttcgaatcctggctctgccacttgctggctgggaggttttggccaagtcatccccctacctgtggaagacaggtgacaccactccaacccaactctgcccaggacacagcaggcctctgacacacgccacattcttctcttcctttctgctcttctcttcccctagacaccttattttttctggcttaaggacaaaattaggagggaggaaaacggaaaatccagatgccaagtccttccagggaaaccaaagtgggggatgattgaggcctgggaggtggagggagggttgttgtggagtcatcataatttaagaaatctgcctcccttccacgccccaagatgagcattactatttcatggatgattcaagtctaacttccccctaggaagggctgtgacccctgacccctgcaacctgtatttaccacgttcaaaagcccctactagccccagagagctgacctgagctgggaccaaggcaccaggactggcagggctataaacaagcctgcctccttgggctcaggaatcctgagtgaaaaaacagaagggggctcagaggtggggcccagtcctggcctgtgagccagcggctaaagggaggggagagaggactcacgggggtgggggacctggaggatgagttaggggagaaatgggcacataaggagctatttcctccccttgaccctcggttttcttggctgtaaaatggagcaaaagctactttgctcgttagggttttgtaaggctgaagtgaaatagtgagtgtaagggcttcagagtgctagaggggaaagtaaaaagcacacacgcatgctagagcagggggcatagaatagggagggggccaaagcatggaggattagacagttgacacgtggttgttagatgatcagtaaatctctgttgagaaataaatacccagagcttggctgaaacagaacaacgtgggtccatccctgccctcagaggcccccttgcttggtggggtagacaggcaaacagatatccctcccttcagtgtaagggttgccatgaggagtagggggcataggggctgtgggagagtcccgctttggggtccatgaggtggaaatgaattcgtctttattttttcaaactcacatttcctgtgcctctttgcagaaactttctgatctctcctcccaccccaaacttgcctttggtgtgtccacgtctcttggattagactttaatcctcctccagctccttgatgggcatgcagaggctgagaggatcgaactggcctttcccagcacttgctctgggactatctggaagcctgcacgctaactcagcccactgccccgccctgtaactgcagacaagaaatgacctccatgagcctcagtgttctcatctgtaaaatagggctaacaacacccacctcacagtgtcggacaaagccacgtgtggtgcctggcacacagtaggtgctcagagtatgggcctggagcccatgctggctttctggctgcagcacacaagagcctgggctccctcggccaactgggcctggcctttgaagcttagtgtggctccttattatggcaattaattacccagggacaatggagcacagccctgccctctgcccgcgccttccagtgacagggggtgggcggagggcgccgggagggggaagttaagcggctgcctgtttgtttatgggcacaggaagctttattggttttacactccagcctgttctgaaatcaaagacgatttccagggagcaggtgggagtcagccacttggagctcagagagtggctttgtttattttgggggccctgactgagcacaacctggtctctgcctgcaccagtgtcctagagacctgctctggggttgggcaacaggagttggtgcttcgctgggggtagggtgggtgctggggggttgaggggggcgaggaggcagctcctcctgcaggcctgggaggagagggagctttggtttcccaaagcctggggtgagtgctgctgaagttatgtgacccggccttggccaagctactcctgctctctgagctttggtgatcttgccttcaaaacgggcctaaagatgacccctgccccggcagtcttggagaatgcgcggggcaatgctcattggtgtggttccatgaggcgacctttctgcagtcctggaatttgcagtgctcctttgttccttctttagttcattcattcattcattcattcattcactcattctctcatcctgtaagagagcctgtagattcacacttctacttggaattagagaaaagaaagctggtttctcaaattcaaaaacattgtattagttctagttttttgtttgtttgtttgttttgttttgtttttgttttgagacagagtctcactctgtcacccaggctgaagtgcagtggcacaatctaagctcgctgcagcctccgcctcctgagttcaaccagttctcctgcctcagcctcccgagtagctggggttacagggacacgccatcatgctcagttaaatttttttgtacttttagtagagatggggtttcaccatgttggccaggatggtctaaatgtctgacctcaggtgatcctcctgccttggactcccaaagtcctgggattacaggcatgagccaccacacccagcctgtaagttctttatattgaaggaatcacatattattgtgaagaaaaaaaaaaaacctcaaacactaaaagaatatagaaagtaaaaaagcttgtcagcctctgcttcctactctccagagttaaatacaatgaataacttgggagtctgatcttctagatgtttctccacagagaaacggcacatctatacatatgtttattttgacaaagtgggattgtgcaacagacactgctctggacttaatcagttaataatgtgtccaggacatcattttccggaggctggttccttctcgacacctcgccagtgatgggttttacccattgttttatcaccttcaacctgatggtagctgagccctgggctcatcacttccacctgttaactgaggagccattgctgtccccattgtacagatgataagactgagggccagagaagctggatgatttcttcaggtctcctgctagaaagcagatgaactggaatttgtggggtttgttttgttttgttctgttttgtttttgagacagagtcttgctctgttacccaggctggagtgcagtggcatgatctcagctcattgcaacctctgcctcccatgttcaaacgattcttgtgcctcagcctctcgagtagctgggattacagccatgtgccaccatgcccagctaatttttatattttcaatagaggtggggtttcgccatgttggccagctggtctgaaactcctggcttcaagtgatccacccgtctcggcctcccaaagtgctgggcttacaggcgtgagccaccacagccagcctgagctggaatttgaatttgggttttctgactctcaatcctctaggataatttggggtacgtggaggaactggccgtatcctaagttcagaagacagactccagacaagaagtataacagcctgtggtgaaagatacgtggtattgacatcttcccacaggtcaggaacagttatcactttaacatagccttgaagttcaggccagctgctaccagcccatgccagatggcttcttagtgccacagtcttcccttttccctcccagtgagaaagcacagaggtgaaatgggggcttagaaagcccccaccccacccactggccttaataaagtgggattccagggctgcaattcacttttccaatccaggatcttgaaactcacagctctcccagatcgttgtaccaagattgggacctggagctgaaagagcttctccagcagacactcctcagatgtcagctctggaagcatccagtctgaccctctcactttcacagatggatgggcagaggccccaggaaggttaagtgacttgcccaaggtcacacagctaatcagtggcagagctgggacagattcccttttgttggaaagatgatctcgtgcctctgaggcggtagtgacctctctcctggcccctgtcagcctatggccacatctgagtttttccttcccaactgttgaaagtcttccaaacctcggggaggccgggaggcgtaacaaatggggagctggtgacctggaagagggaacaccatgcctggggaaggggagggaggagggcgaggcagccacacgaaagtccagttaccaggctgtcacagcactctcatttggtcagcactttacagtttatgaagcttgtcccaagctgtgatcctcacagccctctatgaactagccttgtcatccctattttccacatggggaaatcgagaggctcagaggatgacatccgttgctcagagtcccacagtaagtgatggaatgtcagatctggggtgaggcaggggcagcttgggaccatctagtcctatccccccattttacagatcaggaaggtgagcccccgagaaggggaggctaggagctccctgttgtaatgctcatttccctagacatatgctggcctcctgggcatatgatggtaaaccccaaatcctgaagggagactggatgatgtgttccctttccagggagcgtgcttcttgacagggcctagtgggagacattaccctttggttccagtgattctaaacctggcagtgtagtgtggtggctaatcttgagtcagctggacccaagctccagtcctgactctgctgtgtgtccttaggaagatgacatctctctgtgcctcagtctgctcacgtgcaatatagagctccattacagggtggttgagtgggttagatgatgtgatgtgtgcacacagcttagcagcgagcctgggcacagtaagtgctcagtaaaggttagcagcttattattatttcttaaatcagggcctagtgagaggggtggaggatgtcccagctctcaacctcaatggccttaacaacacacctatggcacatgaccttcacaggtctctagccaacctgtgaaggtgagcaatgaggcgggcttgtgcctggaactagagagatatggcatgagcgggctcgggtggcattgcttttttttcctttttctttctcttttgtttttgagacagagtctcactctgtcaccaggctggagtgcagtggcacgatctcggctcaccgcaacctccacctccctagttcaagcaattctcctgcctcagcttcccgagtagctgggactataggcacgtgccaccacacccagctaatttttgtatgtttagtagagatggggcttaccatgttggccaggatggtctccatctcttgacctcgtgatccacctgcctcaccctcccaaagtgctgggattacaggcgtgagccactgcgcccagccttttttttttttttttgaaacagagtcttgctttgttgcccaggctggagtacatggcataatcttggttcactgcatactctgcctcccatgttcaagagattctcctgcctcagcctccccagtagctgggactacaggcgtgcaccaccatgcctgactgatttttttgtattttaaatagagacaaagtttcgccacgttgtccaggctggtctcaaactcctgacctctggtgatccgcctgcttcagcctcccaaagtgctgggattacaggcatgagccaccatgcccggctggggtggcatttcagctgcagaaatggtgaagttttcctgtagaaaaaagaaagaggctgggcattgtggctccagcctgtaatcctagcacctcaggaggctgaggcaggaggatcgcttgggcccaggagtttgaaaccagtctgggcagcgtagctccgtctcaataaaataagactgcatctcaataaaaataaaagaaaggtggtagttcatttgcacctcctttccccaggctgtgcccatctaattcattctgtttcaaaatcatcatttaatttagaggggaaaaaaatagctctgcagaccagggctgaaggccaactccaaaccttgggtctgtcccccacccctttgcacttagtggcctggctgtggtctaggggaggccccgaacttgctgtgatctgtggggacctcataggctctccaaagaagttgtcagggaaggaggtggcatagtccctgccacaggccccagaaaggctgatggcacagatgaacatacctgcaaatgccatagtcttcctaatagctgcccagcaacattttcaggggtgctaagggcctgcggtcagctttgatcctcttagcccccaatctgagtaaaggtgatgccagccagtgattgtgggcaaaggctttggggtgggggaaagggttgatggggcctggagggtgactgagggaggcatctagccaatcacagagccctgacaccaccccattgcccggcaaagtcctcggggttcaacccttcacccaggtgctgtttggctgcgctccacctggagacaggctttgaaagtgaattatttgaaactgaggaagtcaaggcctcgggcctctcagcattctcagagcaaacaaacttttggcaagttcagagaaaaggaagtgggattgaatttcctcttcgactcacctggggaaaaattcagactgcttggtggtgggggcatcagggacctggctccaggataggctgagggagtgggggtcctctggggtcattgagaagggtccctgagacgctccgtagcttctccatagcagctggttctagagctaagggctaccaagtttggacagttcttcgtttggtctgatttcattccctcctgctgcagatcaaaagacagcttctcccttgctcaccagctgagttgaggagtcaggttcaagtcctgaccctagctgtgtgtgctgtcagataagctgctttacctctctgtgcctttcctcatctataaaattggggaaaataataattgccccctcagaagttctgggccaagtggaaaattttacaagaagggaagaggtggggagaagtttgtacagtggttgggttttgcccgcatcttcagagagtggaaggaaggaaggaaggaaaaaagaaggagagaaggaaggagaaaggaaggaaggaaggaaggaaggaaggaaggaaggaaggaaggaaggaaggaaggaaggaaggaaggaaggagctttggtctgcacacaccccggagcagcagcccggtaaaagcggatctttccccaagaagccagattctcataaaactacggagcgccaggaggacaaatcacagaaggtagatagtggaggatgcggtggagggattgagattagacataaggaaacacaaacctgttagtatctacaagtcatggaatcctgggtttaagggggtggaaatttgagggccattgaaaagaactctacaaatgtggtagagtcagggatatggtgtcaatgaccttcctgcatcacacccaggaactctggcccacctgcctacttatgtgggatccctgtccctaagctagcctaaccagcactgggggttgatgaaggtccaatctttgctttcctcattccccagccaaggccagtaggacacatgccctctccccagctcccaatcctccctttcctctgaggaattagctacatgcctcccagctgagccatcaaaggatgcttcctctacatcccagtctcctaaccatgctgcctctggaaccgagtaaaatatgggaaacttccgggcaaaacccaggagcccaggagcaggggttctcagccttggctgcacacgagattcatatgagggagctttcacaaatcccagtgcccaagatgcaccacagccccattaaatcaaaatggacagggggtggggcagtattttttaaagctccttgagtgattccaaggagcagcccaggctgagaagttctggcccagagtcagagctgtggatattccagccacattagatgcctgagccacaccctctgaatttcaacgtcctggcccacacaaagcaggcactgtcaggatcatctcacagagctgtaaggcaggcaagaagagaaagcagtgtgaggcagcagtgcctggcacctagtaggtgctcagtaaatgcttgttaaaaataataacaatggccaggtgtggtggctcacacctgtaatcccagcactttgggaggccaaggcaggcaaactgcttgaggttaggagttagagacaatccctagcaacatagtgagaccccatctttacaaaaaatttaaaaaaaattagctgggcatggtggcatgtacttgtggtcccagctactcaggaggctaaggtgggaggatggcatgagcctgggaggtcggggctgcagtgagccttgatcttgccactgcactgcagcctgggcaacagagtgagactctgtttcaaaatcataataatgacataacaataataataacagctctcatttttgcaatgcctacctggtaccagatactttgcatgcattcacataaacttttctctggacctgaatgattcctgggattggcaccacatttcccaagaggagggctgcctttgtcctggtttgaggcaggcgggtgtgtctggaagccctggagcaggaccctggctggttcttgtttggacacatcttaggtaaccttcagcaaacagtgactcagccgccttggctatagatgagttcttcccaggccaggcctggcttcctcaagtttcctcctgcaacatgtcagggcccaggaggatgtgctaagcacctgtgttggttttccttgggggcccttgggagggatcgggggccaagggacaggggtctctcctttccttctgctttctgaagtgcttgttttgctggagcatcttcctgcctgctagatgctggggctcagagaggcagagtgagcagcccaagggcaccaggattcaaacctagtcctcagtctctaaagctatattctgctggcagcctctggttccacatagcaggggagtagaggaggaatccatagcctctttagagctccacagctggtgtcccgagtcagtggccttaggatttagcaaaaacagtgaccatatggtggcaccctcaggagatctgctgttggccaccccttcaccccttactgataaacccctagagtgtctgagaaccagtcccagctccctcactgactgccgtgtgacctctagcaagtcacattccctctctgggctcagtatttgcatctggaagacaatgagttgggactaggttatctctcaggttgcttccagcttgaaccgactcttttgatgcagagaggatgtctcagacattggagacaaagtccgtactgggggaagctgtcccaaaaaggaaggctggtgcctgccccagacctgagtacaatcccatactctgctgcttagaagctttgagacgtggacagtagcttggcctctctgagttctggcttctttatctgcaaatgaaatgataatggttgcaacatagttgtaatggataaaggagctaatccacaaaaagcccttaatagggaggccaaggcaggtggatcacgaggtcaggagttcgagaccagtctggccaacatggtgaaaccccgtctctactaaaaatacaaaaattagctgggcgtggtggcacgtgcctgtaggccagctactcgggaggctgaagcaggagaatcatttgaacccaggaggcagaggttgcagtgagccgagatcgtgccactgcactccagtctgggtgacagagtgagactccatctcaaaaaaaaaaaaaaaaaaaagagcccttaacagctcctggtacataggaagcactttttatgagctgaaattatcactgatgaggatttctctgcatcttagaccccctgcctataaatagtacctaccttgtagagccatggcaaggctaaaatgaaacagtaagtgcctgtagcttggtgtccagcaaatgatcccaactattgtaaaatcaattatttgcatgggtgtggctgagtctcctgtttccaacccccatcatgagagcagaaactaaggagtggagcattgcagggcaggatggaggtggcttttgtttgccctgcccagggtgccaaagacattcagttcccaaagtcctgagtgcccaggcccaggggacctgtctgcgcccctcccacctcctcggctgtggcactaccagccctagcccaggccttgttctccactaagcacctctccactctcttgctttccctcgggcctgagctctcaacccctaattcatgaaacctgttgactcagggcccagacctgcagccccaggcatccgtccgtcagtctatctgtccatccgtcacaccagaagccttgctggcctctctccagggcctggtcagagggtgccagccagccggcaggggctgcaggccatggagacgacagcccgggcccgtgcgagtccctccacctggctccttgtcccatcaggcaccacttaagaggatgtaccgttacatgtagagggcaaaggcagggctggagacgccttcagaaatggaaatgggacccatttgtttataatttactctctgacacttaacaggaacctgatgggaccaataaaggctcagaactcacccaactcctgcctcaaaagtgctggagccggtccagttctctagaggcaaacacatctcaaagcctggcaaaccgcttggctcccagcaccccataccccctcgctccctccctcctcgctaaacttttgaaagacccctcactgttccctagctcagtgggcctgccagcctttccaagctgtggggcaggaaggcagcaggacttgcttttgaggtagagaggggcctagaaggcaattcgggagaggactagaatattctgggcacaaggtaggcaaagagagggggccagtgatggaggaggaatccagttttcaattttcctcaacagaaaaatgagtgcatgagagacagaataattttccagtgtgcaggccctaagtgaaacctccttgagacattgtgagtcattaaagaggaggaaagaaaagaaatggtaaaatcagtttgcctttagcagaactgtacaatgcactcttatttccaggggaatctaattagagggcagacagccgagcctggaaggggaagaaagccagaggttggggctgggaggccccagtgggccaggtgggaggagggtgtgatggtggaggttgggccctgggaggacgaccttggagagacatattccctcccagcatctcggagggctcagcaggcctggattcaaatcctgaatcttggccctgccttatatctttgggttggtggcataaccagtacctccactttcttcattttaaaatgggaacaggccaggcctggtggttcatacctgtaaccccagtgctttgggagactgaagcaggaggatcactcgaggccaggagctggcatagcaagaccctaactctataaaaaaaaaaaaaaattaaaaaatgagccaggcatggtggtgcccacctgtagtcctagctgcttgggaggtcgaggcaggaggatcacttaagcccaggagttagaggctgcactgagctataattgcatcactgcacttcagcctgggtgacagaacaagaccctgtctcttaaaaaaaaaaaagtaaataaataactaaataaaataggaataataaagttcctgttggtgtagttgtcaagatgaaatgagggaatgtctgagcagagtatggcacatacagggcactctgtgagtgtttgtttctgtccctcctcattcaccaaggtgatcagcctgatgtccaaccctaacagcttcctcatcccacgcacccttgataataccctttactttccagaatctccctttgccatctcctgttctttcaccactgcccctctgaaactagccaccaggtcccctggcatcctggtattacagatctagcttagcctctgagaccaccaagccatccccttcccccatctcttacagaatacataagattcttataataaaatatcaacttttttttgtttagaaacatgtaacaggaaataaatgtcctcaggattgtaagggtgcgccatgcacccacccagcagaaccatggctggcaggaggtgtgtgtccttccatgtcaatttcaggaaacacgaggtgcagcatcttcccaggatatgcatccctgtctcagatgcagtgtcccctcctgccaaatgcggccctagactggagagcactgtgtttttttttttttttttttttgtgagactaagtctcgctcgctctgtcgcccaggctggagtgcaatggcgagatctgggctcactgcaacctccgcctcccatgtttaagcaattctcctgcctcagcctcccgagtagctgggattataagcatgtactaccacgcccggctaatttttgtagttttggtagagaggggggtttcatcaggttggccaggctagtcttgaactgacctcaggtgatctgcctgcctcagcctccgaaaatgctgggatgacaggagtgagccactgcatctggccagagcactggtattttatgaagcctctatcggggctatttagagcaagcacagcacggcgctgatgcggggaagaggaggtaaaagattgtggatgcagcagcactggcacatgcagagctgcaatttccaaggcctcctcactgccctcccttagtgaaagggagttggagtggcaaggggtctgtagcgtgggttccgactcccgatgggcctgggttcaagtcctgacccagccacatatagctgtgtgaccttggataaatcactgcccctctcagagtctcttctttaggactggtttaatattgatgcctaccatctctgagcgcttggaatgatgacaattacgcatgcaaagcttagtacctggcataaggcaagagcgtcatagacacccgttaccactgttttatccccatggagaagaccacatgctcttcagaactaagaagcccaatcccacacggtcagctccttaagtgaacacatttttgtccactcccaaatatctagaagcatgacttcgtgccctgtcagaaccagtgtgttttcagattgtaccaccccctgctagtttaatgtaactaacctatggttggccacatttttggaaaataacattgtttatttgatcaagattcagtaaactgggctcagagcaataattgtcccagggtgcgagtaacagattttatttttattgatcaaaaaaaagtttttatctaaaacacatcaaacttttaaaaggcgtcaacagcaggatcaaattggattttaactcctttaaaaagtggctccttcaggaacccattccaaagatgtccgaccctttgcagtgagatactcaaaccccagggtggatgagggattccacgggcaagggaggttattttggagccataatgaagacactgcatttgcatttgggggccctctgagcagctgagacatctggaagcagaagggggaattcgacggaatatctgtgtgttggtttagagtgtcagtcctcgacctcttggaactgttcagctggctagctggggcttccagcgtggggccaggtgtctggtgttgcataaatacatctctaatgaaattattgtacaaaacaatcctaacacactcaccaacaatcacgttggcttgaagagcaaactatttggaacattgcaccttattgcacagatctggccatataggaggacgcaattctttgactccttcaacaaatgtctgttgagcaattaccatgggccaggccctcttctgggcattgaggataaagcaatgaataaaacagataaaatccttatcttcttggagcggaaacagggttcctccaaataattcaagaggggaggctggaagacagctcatggaggaggtaggtgtccggtgtggttcctgacttcagtcttttaaaggccactctcctgatactatgacggctctttctccttgcaaacaccagtgacacacctgattgctgaacacaaaggaaaagatggtgaggagaaacgggacttagggaaagagccagggtggagaagaagaggtgaaaagaggtgagttcagagcccggagcaggcagggaggcaggcttccaggctgtggtctgtcaagaatctgatggcacagccaccatggcaagttgcaggagcaggcacagagaaagaagttcctcctccaagctggcccccttggcatcgtctccacccttcccatgtgaaaaagatccagggctttggagccacgaggggctagggcatggcaccgctgtctgtccccctttttccactgtgctgatgggtgagaggggttgtgtgtttctccccaggctcttgctccctttcacagagcagcgtggtcctgtttatttgctgatgctggttttctctgcatttctatagaacagtggttctcaaattgtgaaccacccccaccaacagcagtggcagcatcatctgggaacttgctgggaatgagacttcctaggctccctcatggggcccaacaacctgtgtttccagaggccctctaggtgattctgatgctgctaacacttgacagctggtctagaagatgttggggaggtggcttgctttgcttaaaatgcattcattggcttcggtgtctgccccacctgggtttggatggagactttgctgcttagcatctgagcaagtctgcacctctttttgagtgtttgaaagagtcctcttcccacgagatgattgtgagggttctatgaaaggatgtagtgcacgatgacttcctgggacatagtggaccctcagcagcccccttctttcctctgtggctgccttacctgacacacgcccaccatgaaaaaaagccgaaagtgtccaataggcacgtgccgatcgccttggaaaaatcaacctcaccaactctgacagcaacagaaccacagcatcttagaatcacagaatcttaagatgttagaaccaaaaagggaatatttagccccacccagcctacccagtttttatgggtgaaggaacagaggctcagagagaccacctacctggccaaggtgacatagcatgtcagggcatctctcctctccccagcccaattgcatgccggtgctgtcctgggctctggaggtggggtaattaatacatcagatacagcccaggaccccttctcaggctgtccccccaaccccacctgctgtcctgctctctgaacagctttgcagagactcttagccaggaagccgaaatgagcccccggctgctttttgtaaacagcttttgaagtctcattttctgtcgcagctctcataactagctcagaacggggctcatacctgtgttcgaccccgatgtgttgagtgaattcatatcttgaaggcatggctctaagttcgagtctctctttcacttcttctcttggtggtgtctcgggggccaggagtcccggcagcggggagatgcagcaggccccagggtcgctcccctgatcagggcaggtgacagccctcacttagcctcccatctgcccaccagcatccctgcaccaggagctggctccaagccggggtccgctcaggaccaagttttccagggttggggcatctgcctgacataatacgtaacagtaattaagaaataagccacctcgcccagcttcacagcaatcatttggctaagtaactaccatggtccagtgcctcaaaaatcaccattagagtacgctccttatggccataaaatttctcgttttctgcctttcaccagcctccccctgccatcttcgccttgctttatttatacattcgtcctcaaacaatggcaataaactctttcccagagtgttgcaaatcagaaatttgtccacatttttccaccaccttccactgtggacctgctctgcctgggaacggcccatccaggccagctggagagggctgggttgcagtagattgatgggggcacgacaggttggggttgctggggagagagggtggggaggggggcagcgggagaatgcaccatgaaaggcctctcgctgcccagcgaccagccggagacacaagaggcccatgagtggctgggggaggggaggggaggggaggggaagttgggggaggagaggggaaaggaaggataagtcttccccacccccttctcctaagaggaaaagagggggattgggggatcctgggaggcagggcaggccccaggcagaatgggagggtgatgaaattggtccttcccctcccccacaggaagcagatgatctcagggtgtcctgtagctcatgctgcacacgcaacttaggatcatagtcccttctgaaactcctcaccacccccaccagtcaatgatcctttctccagcaacaggcattgttgagagccagccccgctgtatgcctggcactgtcctgaaccctgaaggtggagtttatccatcagatacagcccagaccccttctcagggggctgttctttgagatccaggaagaccccttggttttaggggtagggaaaatgcagctcagagaggggtttagaggtgaagtcagggacaaacttcagggtttcaaccccaagccccctcgtctttacagccagcccacgggctcctgggggatgcccctctgggcaaggtgaagagtcctctcatctaaatggggcatgctagctgactgtaggtgatttgggggacacttccgccctgacaactcgtgttttaatctggcattcctggaggcagtagcaggggaaataaccaagttgatggctttggtgttggtgtctccagagggtgaagtctgtttcatagggtgggcttctcaggtggagatcttgtttctaaggggggcggcatggcctccattacagcaactgccccagtggtgggggtgtcaggcttatgtttccagtgatcctgcttgactttctcatcagcactccaggaccggcgcacagcagacccatctttcggagagtgggtctctttcatggtggcatgatcctgagacccctagttcctgttgcaatgaacattcactgctgtagcttttgttagtgtggtttgtgaggcaccagtgggtgcttggtgaacacctgttgggcacatgcttctctgtacaccttgttaggtgcacagaatgttaggtttcagagttttcctgggaggcctatttgaaggaagatagaaatgtggggatagacgggaagctggaagcatagaaataactctggagggaaaagaaactggcacagagtcctgggagagaagctgtgactctggggaagcttaatcagttctccttgctgtgtgtgtaatgatgagggtccgtggcttctttatttaactgatggctgcagttcctttagactgtgattaaaagcattctagccaggcgcagtggctcacggctgtaatctcagcactttgggaggctgaggtgggcagatcacaaagtcaggagttcaagaccagcctgaccaatatggtgcaaccctgtctctactaagcatacaaaaattagccgggcgtggtggcattctcctgtagtcccagctactccggaggctgaggcaggagaaatgcttcaacccaggaggtggaggttacactgagccaagatcgtgccactgcactccagcctgggtgacagagcgagactccgtctgaaaaaaaaaaaaaagaaaaagaaaagaaagaaagaaaagaagcatttagccgggcgcagtggctcacgcctgtaatcccagcactttgggaggccgaagcaggtggattacctgaggttgggaattcgtgaccagcctgaccaacatggagaaaccctgtttctactaaaaatacaaaattagctgagcatggtggtgcatgcctactcaagaggctgagacaggagaatcgcttgaacccaggaggcggaggttgcagtgagccgagattgtgccattgcactccagcttggacaacaagagcaaaactctatctcaaaaataaaaaaaaaagtgttctagaatgataggaactacagagctgttcttagttaccctgccctcgagtaatgcccgatataagaaaaaatagagtttccatcctcgaggaactccctgtcttattgtaaaggcaccatctctaccctgagctgtcctcagtttgatggggagatggactttccacacatatccactaaaagctaatgattagtctccagcaggagttgataccaagggctgagaagatggcacaggcagcaagtgccacagggattcaagcagagttctctggatgtggtagtcctggagggcttcatggattatgtggccttcatgtctagattgggaggatggtggggttagacaacaggaactaatttgaagccatcatcccagggcacaagtcggtatggaggctggaagtggctctgcagggtgggcatgtttgagcctgtgcaggagacctggcatggcacgctcagaagtgcccatcgcgatggttaagagggctctgggactggctgcctggccgtcacggtcactctgccattgagttacttaacccctttgagcctcagttttcacacctgtaaaatggggctaatagaaatactgatgagcattgtagtgaggtgttgtgatttgctacaggaaaggtgcttcgtaaggtcaaagcacaccagcagcggtttgaacgcttcttctctgtggccttcacacccagccccactgggggatgctgcatgggttcacagagccccatcttcagggtagagtgagccccaggtttaagtccttcttcatggctgagcccggaagcagggagttacatggacagagggacgaggcccaaagccattttccatctccacctccaaacaactttccaactggacacagcccctgtgtctcccagggctccagcactgaggaggggtgagggcgtggggagggggagaaggagggtcccgcaggcttggcctctcaggcatatggtcctttcacagccgctttgtggggcgcggatgggtggtcaggctgccttttcctttccatgccgggcagcttcatctggccactggagccccagctgctgctctttcccctctgctgattttgagacctctccttaggcctcccctgctccagcttcctgggcgtctgtcttcctctggccccttagtgcctctagcatttatgctacagctgaatcacttacctgagaccacctggccccctcttctctgtaggtacattttgcatccaggacagatttctgggaaaaggatgggatgggatggacgtggggtctgtaggcatggcttggggatctgcaaagcctccaccgtggaagaataaggaaaggatgacaaaggcatgttcattcattcagtcagttgttcattcattcaggcatttgttcattcattcatccatgcattcattccttgcctttgtgttttgcgccaggcaactgtgcttgcctctgagggatacagaagtaaaataggtccacactacatggaggggccaataataacaatagcagcaataataatcgctaacatggattgggtgcttactgagtacctggaactgttcttgccttgcagtaattcctttcatctttgtgcatgacaactctgtggggttggtactattcttgtcctcattttacagatgaggaaattgaggcccagagggatgaagttactttcctaggttagtggggggctgggacagttgtatcaagggtacctctgtctgtgtatttctcaaggttcccacccctggagctgcatcagtaccctagggaataggcaggatggcagctcttattcccagggggatggataagcaaatagagattccaagaggacaagtgacaagtgacatgctcagggtcacacagcaggtcatggatgagcccagagtgccaactccccacctgccaggcttctgttctgaaggagaggagagactgggtctgggattggtggctggcaggctggccagcccaggagcgcctgtcacacacaaggctgggagctcagcctccatctagttttcctcacctcccctcctcctttctgtctcccatcactctcaccatttagaaataacaagaacgaggctcaggacttaaacatacccaggagttatggctggtaggaggcagattccgaactcaaacccaggtccgtctgacctcactgcctctactcttctcacctctcccccagtgccagcccttgctacctccaccacactttgtaagataggaccaagcgggcaagcccttcaggagcagcatagtgacctctgctctgcccagcacaatcgttgctctccctgctgcttaaataacttggatgagtaaatgattgaaataacccatgagagaagtgaatgagaactagtgagtaatttcaagatggacttaaagtcacaggaagagtgtaaaagattttgagccgggcgcggtggctcacgcctgtaatcccagcactttgggaggctttgggaggctaaggtgggcagatcacctgagctcaggagttcaagaccagcctgaccaacatggagaaacccactctctactaaaaatacaaagttagccaggcatggtggcacatgcctgtaatcccagctactcggaaggctgaggcaggagaatcgcttgaacctgggaggcggaggttgcggtgagctgagattgtaccattgcactccagcctgggcaacaagagcaaaactccgtaaaaaaaaaaaaaaaaaaaaaaaaagattttgagctgagctcctcatagagtgggcctgcccctgcccccaaggtgccctcttaaaatgtcccacctcatcctcctcactaattcacagctgccaccccttccaaaactccatattagctgcacaggacaccagcatgttaaagagaccaagttagaagggtcctcatgatatcttcaacttcaacctcttgcttcatctcccatatgtgctttgtgcttggttcacagcttggcgcagaagaaagagctctgggtctgccacgagaatacagggctctgaattctgtccatgcaactacacagtaccatttccagcagtactacttccttcttcctagaaaggctctttcctggcaggaatgtatacacagtgccctctagtgtctaaggacagtaccatgctgctagcagagagccaggatcagagaatgccccactgcagtttccccttgcatcagattttgtggtgcaaatcatctacctagggcttagaatttattttattttattttattttattttattttattttattttattttattttatttatttttattttttgatacggcgtttcattcttgttgcccaggctggagtgcaatggtgcaatctcagcttactgcaacctctgcctcacgggttcaagtgattcttctgcctcagctgggattacaggcatgcaccaacatgtctggctaattttgtatttttagtagagacgggtttcaccatgttggtcaggctggtctcgaactcctgacctcagatgatccacccaccttggcctcccaaagtgctgggattacaggtgtgggccactatgtccggccgggcttagaattttaaaatccggcctggtggggttcgatgggagctccctggagaaaaagttttgtcaagttttgtgaacaaggtgagagtccaactctggctttcctaaagacactctcctccctccctcctctccttgagttgggagagtgaaattgaacctgtgggggtctctcagtcactgggagagagtgtaggatttggagtcagacagagcatatttggatcctcacattgccaatgcttcctagcccccaggaggcctctggggcagccagaggacctggccatggagcctgaggcctaggttctggttaggggccggtgggacccttcagacgtcagcatggaggagtcttgccctttgccagctgttgggccccatggagggggaggagccatgttgccccctttctagaatctccttcgagaagaagcaagaagtgttctccctggatcaatgccagctcaccctgtcttcttcccagtggagaactggggatgggaggagcagcctgaagtgggcgggactccagccctagaaaaccccacattagaatcccaccctgccaccttctggcagtggccctgggcaagtccctgagactctgagctgccaccccctcctctggggccagcaacttggtggtttagccttggtccaagggctggagataatggactccccagatgtgctgtggccttaagacattctcggcccctcctgggtctgcctgggaaggggagagaggaggtgctgccgggctgtgggggcggggtaggcaggacctagggagttgatggagaacccatctttcaaggactggtctcaaggggaatatgcagagccccctccctgctcctgtaccctcactcaatccccttctccacctgtccctgcacagctgcccagctgcctgggtggggcagggcacctggctggggtccctgctcaccaggacaggggagtacctgtgtgggggaagtggatgggggtcaggaaagtggtcagctacagccagaaaccagagcagggccaactggtcaggcggttgactcagtggctctatccaggacctgacctcccctccacccatctcccctgcacccccagagtagggctgggttgatttcacctttgaactcctagatactgggactgagtgagcacacagacacatttgaaatgaatcaagcgtggatagttttgctctgtctcagcaatgagaatgcagctatggataccttagacccagagcaccgaggaaggcttacctgtccccggcactgttgtttttctaaatttcgttttctttgaacattcagttgttaccaacccagcactactttatgtgccgtaagataccaagtcattttatcatccattcattcatgcaacaaatatttgagtgtccactttgtgctgagcattggagattcggcaacgaatcaatgaatttgaatgaatttggacagtcaatgctcttgactatccaaaggacagtcaagaatgcccattggccgggtgcggtggctcatgcctgtaatcccagcactgtgggaggctgaggcggatggatcatctgaggtcaggagtttgagaccagcctggccaaaatggcaaaaccttgtctctgctaaaaatacaaaaattagtccggcacggtggtcggtgcctctaatcccagctactcgggaggctaaggcatgagaatcacttgagcctgggaggcggatgttgcagtgagctgagatcaagccaccgcactcaagtgtgggcaacacagggagactgtctcaaaaataataataataataatacccatccttgtggagtgtgcggtgggtggtggatgggtgctggggacagatgacaaaacagaatacatagcacgtctgtgattgtgctgagggagggtcgagggtttctctgttattatctgtgttttcacatgtgggggccacagaatccagccagactgagcccggagtctgtgctcctcagtgcccgctcttcctggcctgacccgctgcaaactgcaggggttcaccaggccatgaggagggtgggacagggcatgggcagagggcacagcctttgcaaagccctgccattgctggggaagaaggtggtggctggagtccaggaagagatggggtgggcggatgccaggacaggttccaagctaacagggactcgggatctcctggcctcagtgctgggccagctgcatgagaggcgtgaagggagaggaggggatgaaggacagtgctggctgggtatggtgcccaatgctgagatgagctcccaaaaggagtgtgagcagaagaggtggactgtaatgggacgcttcatcctctcctgggcccccaaggaggtttaacttggattccaagcccctgcctctcagtctgctcctccgtcgccctgtccttgtgtgcaatctgactcccgcagccacgcccgagccccgtacaccgtgcgctggttacagctgagcagttccctcggaggagcagggagggcccttgccatggtcccggcttgccgggcccccagctgagctgtaaatgacttttccattttctgagacctgcgcccaggcctgtttggtattcagagacgcctggcccacactcgccagctctcagctctgcccgaattacttgattaaaacgcatatcaactattatgtgattcgtttctctgccgcagctcaacaccggggcctatgttaaactgtaagaaaagctgggttgggaggctgcgggagaggggagcgcagaagcaggggtgggagggtttccggagggtgtgagggaggctgagagaaggaccccaaacctcagggccactgccggcctccactgatccgggatgggtgatttagaaatgggtcagctcctggtcctctgtgagctgggtagattcagagattgtggccaccttatttcaaggcttttcctctggcaaaagagggaggagggaaaggttggggatggaagagaagccacgttggttttcaggaccagaaatggaattttccatcacccgggaacttgctgtagccatattggccttctccgggctgggagtcctgagtcctgggtttactttgcagccccactgccctgagactccactgaacatctgtagaatggggataacactgcctgccttcccctccctttattgggagaaactgttgggacaacaaaagggcttgtaaactgtagagtgttgtgtgcaagttcggggggtgactgctgcagtgtgtcagagtttaagagagactttgccaagctctgtcaagctctattcattcaagaggcctttattgagcacatgctgtgtcctaggcatagtccctgccgcactcaaggatctcccagaccagtgagacccacagacccataaacagtctagttcagtgtctcctgatgagctttgagaacgccaagaaagggaactgaaatcaccttggatgggcccaggaagccttgctgggggaggtggcccaagagctggatggtgctgggtgagcactcccaggaagagggaaggcactctgagcagaggaagctcatgttcaaaggcgtcaaagcaagacccacctggctcactcactcacagaagccatgagtggctggacagggaactgtatgggatggcaaggtgagtggggacacatgggcaaggcccatagtggttgaggccttgctggcgtggctgaggcttcctggcacatgctggcagtcagtgatggcttccagaggtcagtagctgtgaaaggaggctttgaagggagaggcaaaggctgggggagagatgatgggagctgcccccagcaaccttccatccatcaccatcaccatcaccatcaccatcaccatcaccaccatcacctcagcctgggccggactttgcctggccaacttgctcctgcccaccccaaagctttgacaacgcaaatggctcccagcaccttccgcccctcattctgtcctaaggctctgctgctttaacgagccacaagctgccttgatgttttacgtctgtcctgtgccccggttcatctggcagtgtttcctccactggactggaaaatccccaggacaaggtgatacctcctccatctgactgggagcttcctaaaacagaggctgtttctcccccatgagattgggaggtctctcaggtaggagctgcaattctcctttgctcagtatggactgctccacatccctaactagagacaggatccaggaactcagagaaagcatctctccctgtatccttctcttttggggcaatctccagaccagcaccccctgggaccatcccattccttagctgtttgatagtgcgagggcaggagcccaggctggccatgaggctgctcccctactgcgtaccccgaatctggctgccgtttaatgaatgcgttcccatgttcactccccccacgtccccctcctcgaaccagctgcccaggcttcaccaaggtacctgcttttggtacacagaagactcagccccaaccagcagggcctctgtggccaattccacctaatcctgttgattaatttaactctgaggctaaaggatttccaggggtggggagagagaagggcaccccaagagagtgggggtgcaggaagctgaagtgaggttgatgtggtggcattggggctctttgtgtcttctcacactgctttgaccctgtactccccgccccgtttccttttctgtcatcaccaccgtcattgtcctcatcatcaacaatagtaatagccttcatgggtccttgaagttgcaaattactcctatcatctttattttattttattattattattatttttttttgagacagagtcttgctctgttgccctgggggacatgcagtggcgtgatctcagctcactgcaacctccacctcccagatagaagtgattctcctgcctcagcctctcaagtagctgggattacaggcgcataccaccatgcccagctaatttttgtatttttagtagagacggggtttcaccatgttgcccagggtggtcttgaactcctgacctcaggtgatccacccgcctcagcctcccaaagtgctgggattatagacatgagccaccacaccaggccccatcatctttatctcattccattctcaaagccatccagggagggaggcatacaagggtgtattgttatcttcatttttatagcggagaaaaccaaggtcctgagaaggggagcgacttgtccaagaccacacagctagggaaagacagagcccacaagccaggtctcaggctgccgagaccaggattcctgattagaccggggctgtcccagaggaccctcaaactccttcccaatctgtcccttcccgccaatccctctccagggctcactggctgtgtgtcctccatccaagtgactgaacctctctgagcctcggtatacctatttgtaaaagagtcaatagtccctgcttcacagacctatgaaggctggcacagaggtttctaaaatgggggtctcttcccctgagcttggccaaggcgggtagtggatgctcttttttaggggttgaagtcacaaacaaactgcagttctgttctcttgagatctctctggatctcggtgggcagtgagacagagctctgccctccccactcagtgtccagagggttgttatggcaacctccaacatccaagaggatcatgccagatcctttcggacaagagagatctgtgggccctgcttggccttccccagtctgggcttcggtctgggcatctctctggatccacggagttccccagatccctgcagaataaggagtgggagggacaaggagacaggaaggaattagacccagaactccatggtgagtctagaaagctgcaggtgacttgcaggacccagggatcagctgaagcatgggagggcactggggcccggggcttggcagaagcacttgaattttatctctcagtggcataaagcaaatgttggtcctttgctaactgcagtcatgattttggtcacaactctatatcttgtcctattatttccttaatattttactatatctaaaagcacctttaaaaaactaattcaaggatactaatgctcttataaatggaaaatgagtatcatttcctgtaaatagatgggaaccataaaaaccataaatagcataaaaacaaggaacgttgttaaattctacctagagactagcacacgggaagttgtgagcgtggggcctgccctctctttgttaagaagagacaacaactgtgttaatgactgtatcggattgtgctggcctcagtggtggccaccagccacgtgtgactatgcaaatttgaattacaattaaatacaatgaaagacgaagttcttcagttgcagtagggaagtttcaggtgctcaaaaccccatgtagctagtactgccacattgaacactgcgaatctagaacgtttccgtcatcgcagaaacttctattggacagcactgctctagaactgaatggagactcagtcagattagtatttccaggccaggcatggtggctcatgcctgtaatcccagcaatttgggaggccgaagcaggcggatcacctgaggtcaggagttcaagaccagagttcgagactagcctggccaacatggcaaaaccctgtctctactagaaatacaaaaattagctggccatggtggtgtgtgcctgtagtcccagctactcgggagggtgaggcacgacaaccatttgaacccgggagatggaggctgcagtgagcagagatggcgccactgcactctagcctgggcaacagaacaaaactccatctcaaaaatataaaaataaaaaataaataagaaagactaggatttcccccaggacaaggctgtgcctcctccatcagactggggctttctgagggtagggcctgtgtctgccctcatctctgacctcacagctctgaggacagtctctgcccagagactgcactccctacaactctagtccccatccccctcagctcctgtctgagctcaagtgtcctcactgaagaactgaatctggtgccccactccccatccacgggctggcctcgctgcctgccagacaaatgcctgcttccttcttctgaagccccaagggctggcttttgttgtcaccgtcagaacactgaggttatgcactgcatttcaggaattgaatccttggcattagttgtatttggctctgagccccagaaatggtggggaaggggccccaggatggcagctgtgcccactgtggtctccccacagtgactggggggctgggtaactggaagccctggcaggaaaggccagggcagagccctggcaggaaaagcaagggcaggggttagatctgactccaggtctctgcccttggggatgaggcaggccatgatgaaggcaggactcccttgcaatccattccttcgctgtgtggcatggcgtcaccatcagagaccacctggcactggccaaaaaaaaagcaaggataactttccaacggacaagatagcaggatggaaggaagtgggcccagggcagagaggcattgccaagatggatgaccctccaggcgcatgacctctcacacatccgggccatacccaccagcttcctggctatgaatgtggcaccatgattaaattacccagcatgccttttgacacaccaggcgtttgcatgtgctctcctgtctgcctgcagtgcccttcccttcacctccacttaacatgtaaggcagtactagtttctctttttgtttttgttgcggggaggagggggttgccccttgggggaggggcctaggcctattcctataattaacacttgaagcgattgggaggaagggatctttgtattggtggaaggggtcaggggcggggagcacagtttgagtgaacctcacgttacctttctgcgactcagcttctcccatctctgatgcgagcacaaggtctcccaagatcttctagcttgactcaggctgaatgctccaagcccagggctcaggtcctaccttgcccactgcatacctagcctcttcaggtgcatagcagatactcaataaatgctttaggggaaggagtgaatgagtcaatgacaaaaaataaaagtgcttccaggaataccagagatggagaaggagaggaagggggagaaagaaatgaaggcaaaagagaaaaaggaggaagaggagtggggaggaaggaaggtagcctctgagtgtctgctctcttttccatcttcctttctgcttcctcttctctatgcttcccgcagctccccaggggctgctgaggggcagcttcagcgccccggctgggagatgccctgctagcatcccctctgttgggtcagacgtgggcaggagccacaggattgatggggacagggagctgatacctgggtgtctcagccccaacagctaaggaggctgagcaggggcttcctgcagcctccctagcttgggcccagggctgaagcagattcctggcctgataaccccaaccaggcctgggaagtgagctgactccaaccttctgggctctccaggcccaggcccaggaagcaacaggccttcacccacccccagtctccatggtggaaattagtggggataatggggtggggtccatggccttgaccaaggtcattcaggtgaggtctcctctagcctgggggaatcactcagagaccctgggacatcccagagagagcttgtcagtggaagtcgcctaatccaaacccttcatgtcacaaatggggaaagtgaggcccgaggaggggaggtggccttcccagggtcaccagcatttaggagcagagccaggcctggaatctaagcttcttgatgggcagctctggacacgtgcactttttcttttgatgagacagggtcttgctctgttgtccaggctgaagtgtggtggtgtgattggcttactataacctggaactccagggctcaagcgattctctcacctcagcctcttgagtatctgggactacaggcatgcacttccacactcagctaattttcttacttttttctggaggttggttcttactgtgttgtccaggctggtcttgaactcctgggctcaagcaatcctcctgcctcagcctcccaaaatgctgggattacaggcatgagccaccatacatggaggcctttttcttaaagtcaggattattgaggtatagttaatatacagtaaaattctgtccttttaactgagaatacagctctatggattttgtcaagtgtatctcaccacgaaaccatcccttgagtcttatgtcatggacatccttgcatgtcagtggaaataaacaaaatgcccaaccagaggggactgttttgttgttgtttgtttgtttgtttttccctaaagggaaaggttttacaagaaagtatttaagcaatactctagggttgggcatggaggttgcttcccatccttcacattgataaacaatgctagggtgagcatccttctatcttgtgcttgggaggagtctgatcgcagtgcagtcatgggtcctaggtgggcacgagtgtgccttgtgctctcctcccagaccccggcacccttccatctctctaagcccctgccttctccctccctctcctccggctgtagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacagaggcgcgtgtgcaggtgaggaggcacctgcggtgtcggtgctgcagatatactccagagattcagaagtttgggatggccaaggtcagtgggtttaatgggacccctcggggggtttacaacaggttcagggggttgtgtaggcaagtaatgccaccagcatttgatgcagagttagttggcagcaaatgttggttgactgagagctggacagcccaaggaggagggaagaatgaagggagagatagagggaaggggggaagaaaaggaagaaggtggaagggaaagaaggacaaaagaaggaatgaaagaagggagggaggccaggtgtggtggctcacacctgaaatcccagcacttcgggaggccgaggtgggcggatcacatgaggtcagcagttcaagacctgcctggccaacatggtgaaaccccatctctactaaaaacacaaaaattagctgggcttggtgacgggcacccgtaatcccagctactcgggaggctgaggcaggagagtcacttgaacgtgggaggcggaggttgcagtgagccaagattgcgccactgtactccagcctgggtgacagagcgagactccatctcacaaaaagaaagaaagaaagaagggagggagggagggcattagttcagccagaagagagggtttggggagtataagaatctccaaatctctgatgagcagaggaagtgatcaggaggaagatttccaaacaagcctagcttcctcagatggatgatgagtgttctgttaccggaagcatgcacgtaggctgggtaggccagttcctggcaggttagatgcctcagggcagggtgggcagcccccaaagaccctgaacatcccctccatggcctcaatatatgggaaggaagaggggagaagagcaagagcctcccaatggctcgaggactgccccgcctgctctctgtcagtgggttgaggggcaaaggcctgctgtagggggcctggggacattgcctcacctccccaggccaaactctcggattccaggaggcctacagttgttctccaagtgcaggagcctctctggggatctggctggaaagggctgaggctggagggttggggatggaggaggaagagccgggacaagtcgtgatgaacggctcttgtgggaatccattccctggctgtcttctgcatggattgggaggcatagagagaggggaaagatccccattaccagaatctaagcagtgctcagggagtcagagcggcctgcagaggggccaccccaaactgctgacggcgggcacttccatccaagaggagccagcctttgcccggcacccacttggtgccagtggcattgctggggctgcttctcaaacgtgacctagtggaagctcagaccaccttgtcgggtcagcgtggtcaccccctgcaagccacgggtgcagaaactggaagttcagagaagcaacatgcccaggggcacaagctggatgggggctgagccaggcccagctgctggcaaaaaccacgtcctttccatccagggaaatgaacaagctgagtcacaagctgaaatttgaaagcaactgggacaatcctagaagcaagggacgtttcagcactccaggacccagcggacacccctccgccccctgtcctcactcccagattaggggtccttcgcttcctttgagggagaccccaaggggaaagaggcgggaggcagcagccagctcatctctttccctcccctcctgaccgaggtgatatccgagctggctccaggcctccctcccgctctgatcctcctgcagctgttctcctgggcacattcctgggcgctttctcgttcccacgtctggcggccacggcggcttcccaccaccttgaagcctgactgctccttgtaaaatttcctggctgtcagagcagtgcttttattggcccaggggactcagaaacaggtgtcactcaaggtccacggagggagggggtctgggaatggagaggcagccggagcccaggcaaagccatcctgagggggcggggcccgcctcctgcgtcttattgacttcctatcatactctgggcttccccagtgcatggagctccctctagggcagggcagggactccccattagaccagaatctctcccagggcagggctggatctccccatttagcctgagagctttctcagagaagagggaacaaaaaacgtttgagtttttaaagaataaacggactggtgcggtggttcactcctgtaatcccagccctttgggaggccgaggcaggtggatcacctgaggtcgggagtttgagaccagcctgaccaacatagaaaccctgtctctactaaaaatacaaaattagccgggcatgctggcgcatgcctgtaatcccagctactcgggagactgaggcaggagaatcgcttgaactcggtaggtggaggttgcagtgagccgagatcatgccattgcactccagcctgtgcagcaagagcaaaactctgtctcgaaaataaataaataaataaataaataaataaataaataaataaatataaaataaaataaatcaagaacatttagcctggagaagtggagacttgaaagatacagctgctctgagcatccccaaagggttaacccagggccagggtcaagagaggagcatctaaagtccaacatgaaggtctccaggaaagagctcaggactgagagctcagggttcctgcctttggtcagctgtgtcaccttcaacaggtcaatttcctttcctgagacttcgtttcctgtctgcaaataaggggatggaactcaacaattactaagacccttacatttctgggatccctatttactgacaatcagggatgctttgtgaggtgatgagattcccattaccagaagtgttcaaacaaaagcacaatgtccagtcaatcagggaccctgaggtctttgagttatgacctcaaagccccctgagtactgcttacattgtatggcttcatacattttaggtcttggtctttgattctaaaggtctgtggttctgggattttccaatcgtataatatctcatctcagtggacctggcagatgggtgggttagtggattggttcagggtaggcttggagccaaatacctagatgtggattccagctccatgtcttaccctttccaccctccacccatctctcacaggcaagatgatgataatgatgtctaccttgctctgaggattaaatgattacatgtaaaaaaaaaaagaaaaaaaaagaggaagtacctgcacacagaagtgccataaatgggggttgttcttactaaaactctgcccgttcttggcagctccaattctagccacctttgcagctccaggtacattcacccagcagtcatttacagagtacttgctgtgtgccaggcgctgttctaggcattggggattcactgggcaaaaagctctgctgtcttgaagctggcattctcataaatacgtgcacaggtaaacatgatgtcaggtggggatctggtcaccaaagagtggcctgttatcccctctggctccctcaagctctgccttcctgcaggggccaggagcctctgcttgaagcctgctagatgttaccagtgcctgtaacacctctgcctcagccaggagaaagccagagccacatgaagggcagccaagggggtgtcaggcaggagaacccatgcctggggacccatgactcctttctctggagtgatacatatatcttccttagaggtgaacagacccattttttcctgggtgccacaaccctgagcctgtgaatttcttctagaaatagaggctgcagggctaataggtcccaaggtcaccccatggcctctcccatgactgcctctgatgacttccccatccttcagatgatcagcaccaggaaactagggcagtgtacaacgcctctttactttacggtccttggaaccctgctctgtgcttggggtaggggtgggatgttctgaacggaaatcccattgtggaagcactacagagattcactaattaacaacttacactgaatctcttaataacactaggtagcattcatggtgcatttcttttctttttttttttttttttttgagacagagtttcactcatcgcccaggctggagtgcaatggcgcagtctcagctcactgcaacctccgcctcccggtttcaaacgattctcctgcctcagcctcccgagtagctgggattacaggtgcccaccaccatgcctggctaattttttgtatttttaatagagacagggttttgccatgttggccaggctggtcttgaactcctgacctcaggtgatctgctggtcttggcctcccaaagtgctgggattacaggcgtgagccactgcacccaggcatgtgcagtggtgcattttttatgtgccaggcatgatggctcaccagtctacgtgtgttatgtttattaattctcaccatgaccctgcggggtatgtgtgattcttctctccattttgcagatgagaaaactgagatgtagctaaggaaagtaacttcctaaagcacagctatacatatacacagtggagtactattcagccataaaaaagaatgagatcctgtcgtttgcaacaacatggatggaactggaggtcattatgttaagtgaaataagccaggcacagaaagacaaacttcacatgttctcatttatttgtgagagctaaaaattaaggcaattgagctcatggagatagagagtagaaggatggttaccagaggctggggcgggtagtgggaggtgaggggagaagtggggatggttaacgggttcaaaaaaggaataaggataaagaagatgtatttgtatttgataacacaatagggtgactatagtcaataataagttaattgtacctttaaaaataactaaaagaatataattggactgtttgtaacacaaagggtaaatgcttgaggtgatggataccccatttaccccgatgtgattattatacattatatgtctatatcaaagatcccctctatcctataaatatgcatgcctactatgtagccacaaaaactaaaacttaaaaaaaagatacagttcaaagtgactgtgctgggacttgaacccaagtctatctgctcaggttcgtttcctctgtgctacatgaagagaagggccagatggaatattggacacagtacacagatggcatcaactgtaccctactcccagcgcagggtattgagagaaggatcagaaatgaagaataaaacccagcgcctgctttcaaagaactcagtcctgaccagagattctgggtagggtgctggggctgtcactgtcccttttagagcgtttatttccctctctgtaaacgggcagctcatacgagacgctggcagagacccttccagctcagctatctcagagggtctccagcagaatgatacttacctgtggctggcgctgttctaagcatgttgcctgtgctagctcatttgaggtccagaaccacctaggaggtggctgttattagccccattttatgaagaaactgggataacaaaaattttcccatcttaggagttagaggcagaattccatcccaggcagttgactccagcatccctgctgtcaaccatcctgttacacttagtgagaagggaggtgcctactgggaaggaggtgaacctagggacataggacaatgaaggaagaagagatgacagaattggcaacaaaggcatgccctctcctccaggaagtcctcctggattctgagaggcaaagttggaagcccctcctctgagctccttacccaaccttgcatgtcaccccatctgagcttattgcactgaaaagcagctgctctttgactcgtgcccaggcaaagggcagtttgagggctaggagtgggtcctgtccatctctctagcctgtcttgcttggcacagagaggagtcccagtaaaagtttgagaggagaaggtgggaataaagaaggaagggaagagtaggaaaagaaaaggaagggattagaagggaagggaaggaggaagaatgcatccaactttattcagcattctttttttgaggaaaagatgagcggcacctaaggacctgctgctacatgacaaactacagtggcatatcccaaatgcccatcgctctcccacccacccaagatgttcgccaccttcacctattatctatattgttatttacttttcaacgaaatcaagtgttttaaaataaaaatgcacaacactcccataaagggaaggcaattgttaaaatacacacacacacacacacacacacacacacacactacacacaaaggaaaacaaaacaacatgattaaagcctttcaggaaaatgtcacctgcaaacgcctcctctccctgcattcagaagggagattggcacaggttagaaaggcactgaggatgcattagcaccaaactgagacccctcttccccccttctccatgcccaggaggcctgggagagaagtggaatggaataactttcccatcctcatgtccaggttattgaattctgtttctccaacagggagcagtggcaggaggcccactgtttgggaaacactgaattagtacaaagacctcctcacacccttcccgcagagcctggaagctcggaggcaaggccattccttgcagggctccctccagcatccctgccactccagggtgccccggggaaaccctcggcgccctgtggaagtggggagaagccagggctttgaatccatcgggagccagtcgtttttcctccaggcttggctgcctcctctccctttctctgtgaaacctcaacaggtgaaagccggcagctcttgtttatccagcctgcaagctgaacgctgcttttcccacccgggaaggatggctctaggggtgcataagcgccctccacctggctgcattcccctcccccatctcagcagacacggcccagagatttgggggtcttgggtgatcaggtgccaggggaggtggcggccttcaccccccatcaggatggaacaccaaccaagccttgtagccccagccccagcaaaggcaccccagtgccaatcctgcctccccttgttcattcattcattcgtcattcactccttcattcattcaacaagtattccttgaacacttactgagctccaggcattgggcaaggaatgcatggcctctgtcccgtggagcctgagtctgagggggacattaggagcagcacagccaagaaacagatatatagaatcattgatcctgtggggaagcacacaggtaggaggcccacctgacagaaggcagagaacctacctgaacccaccttagatgcggcaattaaggagtaggagtaggaggaagcatttcagctgagctctgaaggccaaagagccagctgcaggaagagtgttcaggggagagggaacagcatgtgcaaagctgaaggtggaaaagagccccctcaaggcagccccagtgtgcaccctcattctcctctttctctgacctgtcccaggaaacttgcaaatccagataagtgggctctagaaagccagactgatttttttttttttttgaggcagagtctcgcttgtcgcccaggctggagtgcagtggcgtgatctcagctcactgcaagctctgcctcccgggttcacgccattctcctgcctcagcctcccgactagctgggactacaggcgcccaccaccatgcccggctaatttttttgtatttttagtagagacagggtttcaccttattagccaggatggtctcaatctcctgacctcgtgatccgcccgcctcggcctcccaaagtgctgggattacaggtgtgagccgctgcgcccggccagactgattttaagtttgaacctcagctccaacacagactagctgtgtggacttgggcaagcaacttgacctctgtgagccttggtttccccttctgtaaaatgggaataggagaatacgtctcatgggtctatgtatggattgatacgtgaagtgccagcacaggaaggggagacaaaaatgttgggttattatcccactaatgtttgataaatccgtgtgtgtgtgtgtgtgtgtgtgtgtgtgtgtgtgtgtgtttcctatttcaaggaggcccagggtgtgtaagcaaagtagggcctcagtctccagagaaagaacccggcttgcacatctgggtctgaagtgcaggtctcattcaggtgggttgcagatgcgtggcttcctcctggggggcttcctggaggaggtggtcaagcagggcaccagcatccctccaggaaggagcagctgcagaggaaagagcactggcctgagagccacacaggactggctggaccactgactcaacctggcccatggacaagtcacccactttctttgggtcttggtttcctcatctgtaaaatggggataatatagaaccccctcactggtggttgtgagggcagaatggggtcatacctatgaaatcactctgcaaagcgtcctgtgctgcacaatgccggggcctgcaggaggatgctggctggatcagagggtgatggcttgggcaactgggtctacatgtgttgcagctctctgccaggaacctggccgaggggtctccattctctgctctccacctcccaggtctggttcagtaaccgccgcgcccgttggcgtaagcaggcaggagccaaccagctggcggcgttcaaccaccttctgccaggaggcttcccgcccaccggcatgcccacgctgcccccctaccagctgccggactccacctaccccaccaccaccatctcccaaggtgagtgtcttggccccgtcctgccatctcagtggtgccccttcccttctttctttactttcacttacaaaggctcttcttttttttatgaccatttcttactttcatgtaagcaggctattgagagcaaaaagatgcaatcctgcccttgaaattcttggccctgacacagagcagccaggtgggatccccaaggcagcccctgtgcacctgtttagaactgagcttctcaaatggtaccagggatctcccaggaatgttactaaaatgctggtctgggtgaggcctgagattctgcacttctaaaaatccccctgggaatgcccaagctggtggagcatggaccaggctttgagcagcgaggatttggaggagaggacactgggctgacctgctttggagggaaaggaacggattctgcagggactttgggaccatgcatagtcacagtctttgagtttttaaagtgagagagtgacatgagtacaaatgtgcgtgtgagtgcgtgcatgagtgtgtgcgtgtgagtgcatgagtgtgtgcgtatgagtgagtgaatgagtgtgtgtgggtgtgtgcatgagtgtgtgcgtatgagtgagtgaatgagtgtgtgagtgtgtgcatgagtgtgtgcatgtgcacgtgtgtgtgtacttgttgggaagatgttggaatcatgttggaatcatttttttttttagattatgttggtctccaacctatgacaaaaaaaaaatttacaaaggggcttaaataatttgctgggacctcattttcttgcctctctctggaaagatccattttcagagatggaataaaggtcagggtctcctttgaggacctgagaaagctccctatgagggattccccccactctggggtgaacagccctaggccaggctgggctgagaggggtcagagccctcaggtcctcctgggaaggaggcctcacttgagcccagttctcccagtggcttgaagtataagattcccttctagcgctggaaagggataggcagagggaagaaggtgagtgggtgagagaggataggggatcagggggccttgggagaggaaaggaaagtctgggtcccaggagagaaggtgagccttgtaggggaagaagggttccctccccctacctcaccggaacttgctctcattctgtcaccccagaagccctgtcccagcacacaccaggaataccactacttgatattggcctcatgggctgggcgcagtggctcacaactgcaatcccagcactttgggaggctgaggcgggcggatctcttgaggccaggagttggagaccagcctggccaacatgtgaaactccatctctactaaaaatacaaaaaaaaaaaaattatctgggcatggtggcgtgcatctgtaatcccagctactcaggaggctgaggcaggggaatcgcttgaacccgggaggcggaggttgcacggagcccagatcgcgccactgcactccagcctgggcgacagagtgagactccatctcaaaaaaaaaattaaattttaaaaaagatagctacctcataaagcctcctcttaaatgactggcaggctggagttctggaggccaaggaaagagtcaaagagccccctccagcaccactgtgacttggtaagataaattgaaccagtgttgagggtcccagcctctgcaaagctgcacagaagggcccagagagcgcagaataacagcctagcagcaaagaacagagatggctccagagttaggccattcaaatcctggtcccatcactcactagcctggtcatcttgtgtgagtgccccaagcccaccaagccttggtttcttcatctgtaaaatgggatttacagtcttgcttcatacccttaggcagcgtttgtaaaagcacctggcaagtggttgacgctcacaaaacaaaacagactgggtagattaacagagtccccatcaaggtctggttttcagcccagctgacatttattgagcacctactgtgtgccaagcactgaggaacagtggctggtgtgcacctgtctaggggttgtctagaatgttgggttgtcagtcaagacctggccagtgcctactgccctgcccaggagccaacttgtctcatcccaggtagcatgagagggtggtcccttccctccaaggaatggagaccgggaggaggagtctcttggcttgccttctgctctcagaggcccagcgtccagggtgaggccacttgcttaggacctctcttgggtctctctacagatgggggcagcactgtgcaccggcctcagcccctgccaccgtccaccatgcaccagggcgggctggctgcagcggctgcagccgccgacaccagctctgcctacggagcccgccacagcttctccagctactctgacagcttcatgaatccggcggcgccctccaaccacatgaacccggtcagcaacggcctgtctcctcaggtaggtggtctcagcccagcacccaggatcccaccgccacgaaagtcagacatctgcagacagcacgtgggtggaagccttgcgctctttcctgtagcaggctgactgcggttggggtttttgttctagaatcaggaatcctccctggactctgtcctgtgctcttggcttttcaccaggagtgaccaattcctgaaaggcaggaccatgtcctattggtggagagaattgtggatggggttctgggccggtaactctaccctgattggtcaatggaattctgtttgctcctgtgtgattggttaagtcattcattgcctcggggtgctgttagaagtcacaggacctgctttggatgaagtcagagagataatgtgggcgctgatggtggttattggtgagtttggggaacaggacttgataatgccggaagtcccaatgaacttgaggaactgatgggctcatttttttgtagcttcagcaggctcccaaatatccgtgggggaagggatgaagtgccccctgccacatgtctgtggtgagaatccactgcacatgatccaaactgatctgaagagccatagtgtggcagaacagtgaagcctgtggaatgggtctaaatcccagctctactgctcaggggtctctgaggcaagtcagcatctgtgagcctcagtttatcccctattaaacaaagagagtctgtaactaacgtctcaacaagaggtgcttgccacattcaatatgctaacaggtcagagcacctagcccagagcctggcacgaaatcagtgccaagtaaatattagttctctggccctcccagtgtcaggacaatgtaattaatatgggaaacccattacctaaaaggagaatagaaagaattcaaagaaggccagcaagctacatcctgcgggccacatctgtccagctccctgttttttgtaaataaagttttattggaatacagccatgtccatttatgtatggtggcttttttgccaccacagcagaattgagtagttttaaaagagatcatataaggccgagcgtggtggctcacacctgtaatcccagcactttgggaggccgaggcgggtggatcacctgaggtcaagagttcgagaccagcctggccagtacggtgaaactttgtctctacagcaatacaaaaattagccaggcatgatggcaggtgcctgtaatttcagctacttgggaggctgaggcgagagaatcgcttgaacctgggagacagaggttgcagtgagccaagattgcaccattgcactccagcctgggtgacagagtgagactccatctcaaaaagataaataaataaataaaaagagagaccatgtggtccacaaagcctaaaatatttactatcaggcccttacagtaaattaaaaaaaaaaacaaacctttgtctgaaacattcccaagaatgttaattttctgcttgtctggattcatttctgtttgcctccattaatttgtgtagttgagggttaattgcctttcagctgcatcgtttatttatgggaaaacccttgagtaagtcccttcccctttctatgcctcaattttctcatctatgaaatggagataagcccagtacttgcctcccaaggttgctggggattgaatgagatgatctgtggaaggcagtcagctcaggtctggcacagagtgagtgcccagtacctgtaggcagctgcctgcggagctcctaatggtgacgtatcaagccctctcagggtccgcagtatgaagggtgatgccacttacttggctgaccttgtcagcccctgcactagtcctcaccaggccaccccactctcttgctgggatcccaggtgagctaaaccctgcacatggaatacagcctgtcggccagaatgtcttccctggggaccccagttggcttctttgaggttcaaggtcatggcctccatctcactagtgctaaccttccagagcccttgagatgagtcacaacaggatccctgaactggctgggggaggacactgccgagatccaagctttccacacccaagaatagggtccaggcgtggcttggtggtacaaaacaaatttgggggagtgtccttagaaagctgaagagggtctttggggttctgtgtgcagctgtcttgctttggagatggagggccccagtacacattggccaggccagggttgacaatccggcgcacctgactccatgaccactgcttttcctagcccgccctgtctcactgtgggctgaggtttatccccaacacaggactctgtcacaggacaaaagagagacttagcaaagaaggggccccaggcctccagagtgtgggtcggggatgggaaaccaacccactggtgtgagcagtggatcaaggggaagtatctcccccatggcaaggagacttcagggttggatgacgtgttttccatcctctcctggaagttcctaagttggacgcccagccctccacccagcccagaattttactgaagctaaaagcgagaggcctccagcccattcctcagggctgggaggctgacatgatgaatcggagaagctcagaggctcccatcaaaggtgtgaagacagatggagggtctgaccggggcagaggggaccaggaggtgaacagctgctggaggagggcgggtgcaggggcagcagggcaggccgtgtgtgcttctgtgcatgtaaaccgcagaggttaacctgcgagcacttcctgaaggacgggtgcagcgagcagggcgggagtttctgggtcttgtacaaaagctcccggggttgctaggctccgactcccactgccctccctcctcactctgggcaggtggacttgacaccatcagcacatcactgtggtcctgggaggtgtggggccaggaatcctctgtgtataaggatctgcagggagacgccctgtgaggacagatctgcctcctgcatcctctcttcccaacaggaccggcttctctatagctcacctgggcaagagggacaggttaagcttccccgctgggctgtggggtaggcacactgtccctttccccaggatggcaggtccctgacacattgcccagatagatgtggacctcaaaactggaaggaatttttttcttttcttttctctctctctctctttttttttttttttttttgagacagagtctaagtctgttgcccaggctggagtgcagtggcgcgatcttggctgattgcaacctccgcctcctgggttcaagcaattctcctgtcttcgcctccaattctcctgtcttcgcctcctgagcagctgggattacaggcccctgccgccactcccaactaattttgtatatttagtagagacagggttttgccatgttggccagactggtcttgaactcctgacctcaggtgatccacccaccttggcctcccaaagtgctggtattacaggcgtgagccactgcgtctggccggaatttttgttcttacagaagccaaaggggcttacactggaggatgaatttgtggctctaccgagaacctggacagacccgggttaagctagctgtgcatcacgctggccagcttgctactaccgtggggaagacatgcctcctccagtggcttgacccaagtcccttgtctcaaacccagcctgggaagtggggaccacagaacatcaaggactccatgcagaatctcaaggaaaagccatttactcatctcatctctgcacgtgccccctggcttggaagggagtcactaacatagtgaatatttatagagaacctactatgtgccaggcactgttctaggcacttgggataaatcagtgaacatgagaggaagacccttatattgtcctagtggaggtgacagtacaacagggtcagacagacaaaaaatataattttaaaaggcatacagtatgtttaataccagtgttgacaaggacagctgaattttctggagcccttctgactttcagatcctgctctgggtgttttacttatattaatccacttaaagggtagagccaggattcaaacccatgtctttagagcctgaaatcttttccttttctttccttttctttttttcttttttttttttttttttttttgagatagggtttcactctgttacccaggctggagtgcagtggcgcgatctcagctcattgcaacctctgcctcctcccaggttcaagcaattttcctgcctcagcctccagagtagctgggactacaggcatgcgccaccatgcccagctaatttttttgtatttttagtagaggcggaatttcaccatgttggccaggctggtcttgaactcctgacctcaagtgatccacccacctcagcctcccaaagtgttaggattacaggcgtgagccactgcgcctggcctagagcctgaatcttagttacttgttctgtcttcctgcctctcagaaatgccctcacttgcactctttttagagattggctggtgcaagaagaaaccatctagggaagccaccccccatctatggaagccacccccttcagtttggtggaggaaatagctcattcgactcatgtggtggatgagaaaactgaggccaatgactcaggttagggaccaataggcagagctgagttatatgggcaaatgcttttcaggaggtttagatacccttgaggcttggttccctgattgtctcccctacccacccaagccccagcctaataggattagggattaggcactcagcacatgcatgtccctggctttgtgcactgggtccttctgaagagatgtagggaaaaggaatcctgctcatgagacctcattcctgataacgttcatctggggttaggatcatagactacccgcaacccccagcccactctctcccctctgctccgggctgagggccagttacttggacaacgactgtaagaaaacaacttagaggtggggtgccgtggctcacatctgtagtcccagcactttgggaggccgaggtgggaggatcacttgaggtcagagttcaagaccagcctgagcaacatagcaaaacccagtgtctacaaaaaatttaaaaattagccagatacggtggggcgagcctgtggtcccagctactagggtggctgaggtgggaggattgattgaccctgggaggttgaggctgcagtgagctgtgattgtgccactgtgcgccagcctaggcgacagagagagaccctgtctcaaaattaattaattaattaaaaacataaaatgacttaggatgaaaggaaccttttgtaacgcaaatgactttgaataatgtgacacctgcagattcatcccttcataccagcccctgtctaggaatcccaagcaggccaggctcttaggagtagtgaccacaggcagaaaggagaacacaaggctggcccttcagggatctccagtctggtggggaagacacagcccctgtcttcaggaactcatagtctgacggaagagacaaaaccctcatccttagatgccttagtctgatggtggaagcacagccctctcttggaacagagctccaagagacaggtgggggagacaggcatcagaaagtcattcagagctgcagtatttggcaggctgagatcccaagcaaagaaccaggagaaaagttctgccagtttcgagggtcccttgggttgaaggctgcaggcagggtgccttgtgctggaggcttcctcagggcccaggtggtgtgtgccaggtggggctgggaggtgtggttagctggaacttcctcatctcccaacctttttaagatgccaactatatcagagtaggaagtggaaactgaggcccagagagggcccaatctcccccgagattttctgaaaatcacacggttgggttagcggcatccttggctggggtctggagggctcctgccacgacctcgtggaaggggcgtctgtctccccagcaccgctcctggtgctcttttgtaatgtcccatactcatcgtctcctttgttcctttctggagcttaaaacgaaggaagccataaagggatttacatatttacaatttccccacacaccgacctaatgaagaatattctctaagtgtgcagttaaccacacaaccacgatcacggccaaccagcctttctgtcctttcctgcttcttgatacccttctctccggtccagcctgtgcctttagtaattacggcgacagcaatggcagagatcatgcttacagagggccaggtcccgatgggcctgaatgctgaccccacttgccctccttgactcttggctgttatcttgtgaccctcgttttacagatgaggaaaccttccttgtccagggtcccctatccatccaaccacctaagaaacatttatggagcctcttccaggtgccaggttgtgtgctaggatctggcaagtggcagagttaggattccaacagtggctccagagctcacgatgctactgtgttgtatctgcctggtgaggttggtctggtggtccatccagggaagctgaggtcctaagtcataggggcaattaatggcagagtcaggttcagagtcgctgtccccaaacgccaagcttcctctttcctcctgagacccacagaaatcaagctcaaggctttacctttatttatttgtgaatggggtctcctgggtgcgtcttaacagcacatgcccagtactgccctcctggcattgtctgaggcctctgggcagccagttcagcaagaaaagacattccatcaatggcacacctactggacgccagatcccatgtaagcactttgcctatctgaagtcattccagccccacagcaaccctactcttggggaaataggctcagagaggtcaagtcacttgctgaaggtcacagagcaggtgagtgatggagatggggttctaattcaggtctgccggacccaggaacctcaccaccacttgactctcagcaagacacgaccaagacagtcctcttgccctagggaactgagcagtgccactcacacagtggacactggagattcctacctctctctcctatcacttcctcttcatgcccccaccccttcattggcgacactgcgtttataataggcatttaaaatgagtcttgctggaccagggacgaggaaggaggagggagcgagagatttgtaggcaggaagatggggagggggattgtggggtgttaaatagcccagaatttaaaaaaaaactgatgcaaatcactggtaggagagaaaattatgtgcaattacgtcctgatattggaaggttttgcctagcccaggcaacaagatctcattaacaagcagaaaataagattgaaatggtgtgtaaaagagctgaaaaatgaatttgaatgctgcgtttgtccacaattaccccctccttcacacatattttattgcaatttttttattattcttaatctctccattcctcaaagcagattggggacatcctggcattaccagggcgtcaggaggaggtgtggaggattgcctgccccgctgaaaggagacccttctctcgcacattttccgaggttgggttttggagggatcagaattcatttctccggcttagcaggttgtaggaacatggggctttaaccccagctgcgcgctcctctgcgccccgcccagcccttccttctcctcccttcctgggcgagtctcctgctgcccgcttcctccctttgccttctcagggtctctttcaggcctccgctttctcgggaggcctctccctcaggccccatgggtagaaggaagcctggagcgagagaaactgtgccacctgtgccaacaagcagccgtgagttggagctctggttctgccatttactaaattgctgtgtggccctggcacagcttgcttaacctctctgggcttccttttcctcatcggaaaacaggggtaatcattgctacctctcaggggttgctgtgagaactaagggaaaattcaaattaggtgcctggtgcaagtaggagctcactaaatgtgccctcgtcacacccccctcacctgtgccctggcctccacctctgcctcactgccatcccttctgtttccttccctctgttcccttcttttacttccctgctctccttgacccccttcagttaactggacaatgcttgagttggtttcctatccagggcaatgtaaggggttctgctgacctaagtctggggaggagaaggtgccaggtgcagggggttccctctctgcagaaagcaggggaaaggctgtctcctgctcctccctcaagcccctggggaaggacgagctgatggaggagtgcttgactcaagttggcagggcatgggctgagtggtttttcccaggattaggggaaagctaactgagtcatccccccaccctccaacacacatccccacacccctgtttctctttctcttcatgaccagtgcggttggtacagagtcaggggtcagtttgtggagtggaccaggagtccgtggctggatcttcttggacctgaagccgaatgacatttttcagtgtctgccctccccaactggccttctgcacccaggaagagcccagctcccagagactgctcccctgccccacccaaaccacatccaccagcccctggtcacagcatcaggctaacagttaggctgcccgtccactctgctcatcaggcagcccccaatcccccagggctttttcccccggttctcttggcgaggccagccccagggtagggatgaactgcaaggctcagggaagcagccaaggcgtaggtgtgaactgatggtcagtgtgaattgatggtcagtgtgaattgatggtcagtgtgaactgacggtcgctttagtccttggccctgagcatcctcagcccttccagaacctggggagacagacccggccaagaccctgctctcacatccagctccatctttgtccacagttaacccacctcagtgggaaacgctcagttatttccccccggcagctcctcaccaaacaaaaccacctgctcaagtccatcagaggcctcagctccagcccacaagggagcggcctgggcagagcctcttctcctgtgaaaatagactcgtgtttatgtctctgcctttcctacccctttttcctgggtggagggaaatgagggggcaggggagaaggaggaaacccctcccggaaagaaaggctaaaccaggattaggaactttccagactgctgctgaggggagtggagcatgcctatgagtaggctctgctaggaactgggaggcctggcggattgcctggctttcagggtgacattagagcccttggatcattgaaggagaagtgggagagcaaccctgaccttgcctcctttcttagagaactgggtagaattctgggaagatatcgggtcttcagcccacctatctgagtccgaacaagaggtgggtggagggtggccttcaaggaccactctggggccgggtgtggtggctcacgcctgtaatcccagcactttgggaggctgaggcgggcggatcgcttgaggtcaggagactgagaccagcctgggcaacatggtgaaaccccccctctactaaaaatacaaaaattaactgggcgtggtggtgcatgcctgtaatcccagctacttgggaggctgaggggggaggatcgtttgaatccaggaggcggaggttgcaatgagctgagataacgctactgccttcaagccggggcaacagatcaagactccatctcaagaaaaaaaaggggaggggcactctgggcctcttttatgcccaccagcaaaacatcttccatccaaactccacacctccagagggtgtgggcaggagctgacctctgcccctttacacagatggagtagaggcctggtataaacaagtggggaaggggaaagtagcctgcttggaagctctagatgtttccacacaccactgttgtcagggaccatggtcttcagtaggaccacaggcagcatggcagtacttggcacacaaaatcttggtgtgacacttgtattataactaggtgtctggcaggtaacggaccaccaccaactgttgggcaacccgcaggcatacagcaggcctggtgagacacagctgtagtccattctcaggaggattttgaggcagctgatcatgtggtttgcacttgaatatcattacatatgattcccttcaaattcatttatctaactccacttaacagcctagagggagactcaagaaagaaatatgcatggctgtctctgctcttatactttggagagacaatactcctcatcccaccccagagataaattagagtattcattgtagacaatttagtgtgatttctagtcagacaggaagaccagaggaagtctagaggagggagggcatagtcagagaaggcttcctggaagaggagttccagagggaagactggatttgcacagggataaaggaaggggtaggaggttggtgccgaccagacagcagcaaatgacatggcagatgtgaaaacagtcactaatttaggcacatcgtggacacagtggaatgaacatacagaccagggctcaaatgctcacgtgctcagccgggcacagtggctcatgcctgtaatcccagcactttgggaggccaaggcgggtggatcacttgaggccgggagttcgagactaacctggccagcatggtgaaaccccgtctctactaaaaatacaaaaattagccgggcatggtggtgcgtgcctgtagtcccagctactcggctgaggcaggagaattgcttggaccccggaggcgggggctgcagtgagccgagatctagtcactgcacttcagcctgggtgacagaatgaggctccgtctcaaataaataaataaataaataaataaataaataaataaatatacaaaaacaaattctagctcctctacttatttgctgtgtgatcacaggcaagttatatgagcgctcagagcctcattttactcatctgtgaaatggggcctctgccactcaccttgcaggcttatgagaattaaatgcgattgttcatgtgaaacccttagttccacacccggcatctagtaagagcttaagacaatgttcctctttctgcttctcctcgccctgaacagaaattgaactccagaagtcttgctaggtttctctacccaggcaatttcctttctggtcaaaggttggaaactcaggagatccaagtttcctctagactctgcctccaaaccaccatgtgatcttgatagaggccttactgctgtgggcctcagtttccccatctgtgcaatgaaagagatggaccaactgctagcagagagccttcctattcagaatcagtgattctgtgggttacttgtacatccaggggagtcacagcctccagatctgcgggcagggctggcccgcctctcagtcgtacatccgcacctccttcctgcctcctgagaagcctagcaggcccgggtttagccttccagagctgcatggcttggtgggaaagaatgcaaatagtggatctgtccttctttctgattagcacagggactggggacgagacagtacagcagacagaaggaaagaaaatgagggagattaggaattaatacagcaggcagacttagagtttctcaggcctgtccctggggtcccctgcaggaggaaggccgctgggatggttgggcaatcgggcctgggaggccaggcaagatcgcaggtaggagagacggggggtgactttgagggtccccaaaggagacttgtgctctcctctgcctccaagcctttgtacctgctgctcccttggccgggaacaccttctccaccaccccattgtcatctcaagcccacccgtacttcttttttaagacttggctcccttccatgaagctttccttcaggacaccccccacacggtgggttagctgtgctttccctgtgcagttaccacattttatcagtacattaaatgtatatattgatataagtaatacagtatgtctgtattgctacacaaatattattaaatagtaataagtaaaatgttttagcatttaccacaagccagatgctgtgctaagtcagctacatgaattatctcatttaatcgttataacatccccttggaggaagtgctggaatgattatttctgtcctacagatatagggacagaggcatggagcagtttaaataatttgtccagggtaagttgctctttaaggcaggagagcaggggggtcaagatgcatgctagaatcccagtgcttgggctcaatccccagcattgtcacttcctacctgtgtgaccccaaacaggctcttccctgcctctgtttccccttctgtaaggtgaggctaataatcatgcccattttatagagctagcctgagaagtgtgttcatatatgcaaagcatgaagaagaacagctagcataatatgaggtagctgtttgcagatggggtctgaggctccagcaggtgccaccaggggccaaggtcacagtgagttagcgcagggccgggatgcagacctcctgttgcagaattcatgttccctcaacacctttgcagctgtctcttccacactcatttcccatcttctttccatcagccttttccatcctgttccccccgctccttcttgtcccccactctaggttcctgccctgctcccacctcagccccagggctccctaaccttccccaccggcccttctctctcctggccctttccccggctgtgaacacgcttctccaacacctttttcagtggggacgggtgtccttggccaccaggggagttctgctaagggcaggggaggctcctcccttggagctttggagaacatcagagacctgggtcgggtcccccaggacattgttggaggcctttggaaggatgggcctgggtgcgccctaattcctgcgcacctcggccttgtcactcccccactctgtggctctgtcgccttctgagtgataagggcctgcactttcttgagagggtggacagcctcccccacccctcagcccagccaggcctgcctttcactttctcctccagccattcgtgcctccctgtcccctgccacagcccagaactttctcttgggctcagttgatgggaaatccacgtctgtttgttgttttttgtttgtttttttttcacacactctctgcttcctatttctttcctttccccacttcctcttttcgcccttcgcgccccatttcccttcgccccctgtgccaccacccccttgctcaccgtctccctgatcgcgtcataaccctgagaatacctccagcctgggtcctctctccacccactccattctctcaaaccctcatttccctctttgcctgcctcctcccatagctggcctcgcctctacccattctcttccccctaatctctctcattctcctctcctctctcattccgcacccaacaaacacctcttccccctccatcttcagcccctgcgcgccccccttgcccttgccctctcccccacccccgtgtcccctttccgaattcctccgctgctggtgggctccgaggcagggaccgggcgcgggctcccgaggccgggcggacccaagtccagggcgggggttggggcggcggccggagcggggatcgggtctggggggatccgcgcggccgcccctccccgcgctccgccgccgccgccgtcgccgccgcgcctttgatccatggcccgaggccgcctgacagtggaaaatgcggggagacaaaaccactcagtcaaagtgattcccaacaactgtctccccgagataaggacgccctcgggctcggcggcctgcttaattcccgctgcccgggcctgggatcccgagcagccgcgcgcctggccgccccccggactgcggagccgccgctcgctcgtccagtcttggtcgcggggcctcggccgtctcgggacggggcaggcggcgaagggacgggcagccggtaagcaagacccttgctgcctgctggagagagaggctccctcgggagcgccccgttccccacccgttcattagttcattagggccttctccaccaatgcacttgcccttccctccacctagaaccttcttgcccctcctctcctcgcttagccagctctgctcatctctctggtctcagctcagaggttgtttgctccagaagtttgccctgacctggctgtggtggccaggccccctcccatgccccttgtattcccctgggtagcagctttgcctctggtttctaactttttggataccgctctctccctctaatgcaaggaccctaggctcttggcgtgtgtccccagcacaaagcctggcacgaagtaggtgcccaataaacagctgcaaacatgccctgggctctcctgagggtctattttgtgccccattctgtgcacagaggatgccaggtgggctaaacctggcctctgccctcaagaaccttccagttagtccacccacagacaagcaagtgacaaaccatgagccagaagcctccagagaggagggaggcctagggagggtctgcagccccctcttagggggagaaataccgtcttgacggccagctggcctgactcgctggatagaccacctagagccccgactctgctgtctgaccaccctccttaacaagctatggttcaacaatgtgtagattccagagggacaggagatgagattatataaagtgaggccaaaagggagccctcatgatcccacctgaacctccatgggggtgtcagggacaggagagccagcatgtttgggatgatggcaggaggcacacgtcctgtggaggcagaattcagctgaactgagttcactcagagctggccagggatggaaggggtaactttggaaagcagggagtgcgccatctctgctcagagcggggtgccagcagaatccaggccatacctgccaaaaggattggagggtgagtctttgcagggtggggcgattgagctagagtcagtggttcccaaacctgagcctgttaaaaatctcaatttgcagactccaccctgagagcctgttatagtaggtccatggtgggactggggaaatctgtgttttttaaaaaggtacagtgcaaggcagccggtcccaggcctggcacatccaaagcatggattagcgaggttccatcttgtaaacctctccccaagtggaggaacgtggggatctgttgaaggcctccctaacctcagtgcacctgggggtccctgtgcaccccaatggtatccacgccttgacccttcctttttttttttttgagatgggagtctcgctgtgtcgccaggctggagttcagtggctcgatctcagctcactgcaacctccgcctcccaggttcaagtaattctcctgcctcagcctcccgagtagctgggattacaggcatgcaccaccacgctggctaatttttgcatttttagtagagacagggtttcaccatgttggccaggctggtctcaaactcctgacctcatgatcctcccgcctcagcctcccaaagtgctgggattacaggcatgagccacggcacccagccgacccttcttttctttagaaaacaggttggggggagtgtctgcttgaaatgaactgagatccccctccccagcaatctcagagctagaaggcacctagaaagagttaactggctgtctcattttgcaaatagagacactcacaatgctcctgcacactttcactgtccaaaaagactcaggagttagcagggcttttgagggcacagtgggtgcagcaatggccttatcattgcaagaggttgatttgcagcacgtggggtcattcatgcttctgctcccagtggcttaggtgacttctgctttgacacagagccctgggaaatcttttcaagcatccacaaaagaggtaacccgtgtgggcgaatgagtgctggatgaggagacaggagacctgggtggggcttttgagggagatccgcccctgccctgttcctgtccctccatcctgctgcgtgagggctggggctttggggaataggagacagtgtgcgctctcggaacccagcccctaggccctgaggactgccagtggaactggcctgaggccaaatgaatgtgaccctctcaccagaccaggggtctctgaccagcggcatcgaaggattaaagtcccgtgagggccctggcaagtgtcttatcacaaaggggacatgtccaggctgaaattgagacatactgcccaggggcagaagttccggagcctccccggcaaggggctcccttcccttcttgggcatagataatgacctctgccggccctggaactccatagcatccttccctgagccccctggactgtggctccaaccccaaccaacttcattctccttgtctaggtctctggggtgaaacagctgtcccaactggggtcatattctgcttttacccccaaagaagtgaagttggtatcccagcatggttactgatcatagtagcagtcatgccacaccacattggtttggcagttggcaaaggcacctctactcctattagtatttggccctccctgagccctaagggcttggaatcattgtacccattttgcagactcagagaggtgagccccgtggtcagcagcaaggcacaatgttggaaccaaaacccttggtttatccagatactaaattctctcctccaagctgggctgccagaacaggcagggtctggagcagatccttgctactccaagtctgttctgcactttaacgaggtccctccaaggctctgcgtgcctgcggatgtttgagaagcactagaggatgacctctcatgccgtcccctcctcccagctctcagatgctccataagctccctgcgatgactcaaagtaaacaccctgaacagcagaggacagagaaaggaaggggcctgggagggaaccccaaatccttccgaggcccagaggaagaggcaggagagcaagggaggtggctgcgtttctgtactcagccaacacccagctagaccagggtatgggcctggcaccctggcatgacagctcaaccctgggcacatcaagctcctgggctgatttggcaggtgaatctagcagggaggtatgcagtgggcaaggaagtggtcagagagacagacagacagacccagagagagctggggtatgaggtgctgatggagagaagggaggtgtgtgtggatggacccatggagagaggggaggtgggcgcagacggacccatggaaagaagggaggtgggtgtggatggacccactgaagcatcaaggaaaaggagggatggagagtggtggagactggggggagagagagagagagagaggtagagagacacccagagaccaagagacagaaacaggagcaagaaaacctagggcagagcaatgcggaggcaggggcatatacaggggtggggccaggagaggaagagacacagggagagagataaatcaagaaggccagggatgatggaggggggacccagagctggagggaggaaggtgcagagagagggcttgagggctcggaggagagggacacagacagctctgccatcagaggaacccgaatttgaattccaggcccaccacctgctcccccatgttggtccacgggagcagcagcagcaggcaggtccctttctctcccagcctagtgacctgccagagccagcttctctccacactccctccagcctcttctcccactcccagtccaggtgtctgtggcgaggaccttttcccatgcacagggggctgcccgggcctgaaccccagatgccctggcctcccagtgcagcggtggtgggtcccagagccctcagagcccagggtgagaagtcctgcccttttgccaagtgttttcctttagttccagatgccaccctgacaggtgctaccctgtgattaatgtccccacccccaaggcctgggaccagcccctcctccccaagccagaggtggcggtgggtgtgcagcgcagggactgagcttcccgaatcccttcctggttcctccctctccctcgaccccctccagccaccaggagcagagagcagacccctcctcaaagacactctcagataagccacatggccgtgactgagtttccctttaagcctcagtttccctggctctctgaaggtggcaatagtcctgctgctgtgctcaggaggctgtgccagcagaaagcccggagctccctggggcaaagcagagaggctgctgggggcctctggggagccccacacactcttgataccagagccactcatggtggtggatgtggggataaaaagaaccatttctgctccgtcagtgatgcggggaggagaagctggcagttgtcggaccatgtctggaaacacacaggcttcagcaacttgaaggccctgtgcagagtggcagagaagcagaccatggttacttcaaagagagtcataactagggacattgcatggtttgggggactgctgtcagagatggggatcaaggttggagttagaattggtcgtgttaaattggagagtattatctaagttggtggcaatggttaccagctgtgtgatcttgggcaagtcacttgacctctctgtgcctccatttgctcatctatcaaatgtggatgacacagggttagacctgcttcccagggctgttgtgaggagtaaatgggttaactcactgaaatgcttagaatactacctgagatggagacagcattacagaaatattagcttaggattatgggtggctgaccttggaagtgtggtcagcaccagggtcatggagtggggtcgtaatcagagcggggggcccaggttggagttggggtgcatgcagtataggataaggcggggactccatttgcccaaccccttccccatataacccgaggcatcgcctttccagcctgcatcgccagcgagaaagctactatctcctcccgcatctcttagggcctggggactgaaacgagacaacatctctccaccaccgtccccagcctcttgtttgtttggtacgtcaatgccgtgggcatgtttttgctaatttcgtagctgcctttatcaaatggggattcacaggcgctttatcctcgataagtggattagtctttgagctaaacaagaaggtgtgggacgcggggggctgctccggagaagatatttgttttgtaaagaatggagcctgcgttccctgccctgtgtgggtgaggcggcagggcgtcgacatagctggaagggctgtctctgttccttctcccagggccccagaagccctaactcgtgggaactttctacagtgccagcagggagcaggagggaggctggatctctggagaaagagctcctgggtccatctcgtgaggggagagtgaaactccaaatcagacctgggtaaataggtataccggggctcattttgagttgtgtcacctccttgggttgcagctttttcctctccatcttctgtcttcatccacctttcctttccttcctacccttcacctcctttatttgtctcctttcctcatccctcaaacccctccaagggccttttgctaagaactgcacattcaggcaccaataagacattgtttctgctcttgcagacttcatagtccagttggacaaaaccaagacaacaaattaatgggcccccaaatgtggcagcaagaggcgaatctggttggaaaccctagaatgcttccagctgcttccttagccttgatgctctctaaggaatggccatctgctgctcacagggcttctcaagcttctcaagcttctcttcaaacacccgggataatagttgagtatgttccccccgaggccctgggggtggggtgtaatatagagtttaatgtattctctttgagatgcattctttgccactacggagccatatatgttgggtcataataatggaataagttggcatcgtgtcaagttgactcctctccaggaagttgcgccatgtttagcttgtggctttccatggcacatgaaggacagccgaatatgggcactgagagggaaatcgaagatgattgggatgtctgaagtctgagtgaccaagaaggtgaggtatcgtagacagaaacagggaatgcaggaggaggacctgggtcagagctagctctttgtaggtcaagaccaggagatagccacaaacgtgtccaggacagaggttggggcaaagatgtggatttcagagacatctctctgcagagacctggaggtggaataagatgcacagggagagaagagagaaaggctgggaggtttcattgcacccatggcggggggacccaaatgctttctttttcccttccatttttaatatgcatagccaggatcttgaggtccttgctctgtgttgcagcaagagcctggctgagggggagagagggagcagagactctaagaaggaaagaaaagagtggagcagagcattccggtccccagctggtctttagcagcgtctgtcctccccaagctgcctccagctgagtgtgattttgctatttatttacatgtaattattgctatgaggtgcagatattaacgctgtcaagagcaatttgctctgacatttttcactcgctcagtgcccccgccactctcaatggggcccagggttctcccggctcaggccgctgcgtgctcggtgggccggccgggaaccacccagccggcaaggagtggcgtcagcgggctcacccggctcctctgcaaactcattaagcttcgaaattgaatttggtccgggagagggctggctgggccccactccaccagtcgaggctggctcaaggcctccctgctctgtcttccacagagaaaactgggcagggccaagctcactggggcacaggccagtggctaaggctggcagcaggctgcagaggcagctggtgaaggcagtggagggtcatggtcagagaggtgagatgtacacagccaccatcagcagagccccaacacggccaaggcacgctgcgggcatggtagctcaaaccctctctgtctgctccattaccaggtcacccagaaaaccaatccgtaacttcgagggacagcactgcaattgacaggtgcacccacctaactaacagactgtcctatgaagccagtcaaacaccttagtcatcctgcagaggatggtactatggaggtaggaagaggtgctgagctggccctgcagcaaggcccctgggtggatgctagaaacagaaccgactctatttacaacttttgagttcaaatccaacccccagtgcttactaattgtggagactggggcaaattatttagctttctagagcctccgtttcctgatcttgaaaatggaacaggcatttttcattatatttcatatttcattgaatctaagacatctgatcctggccctcccttgatcctatcagaagatgggaacaaaagctttccacacagctacgcagccacatagccacagcaaggcactgacgaaggcaatacacatcctcatttcagagaagtgaaaatgcatgtcttcgacctgctgtggggaggaggggctggcagtccgcctgcacaaagtaggtgatgggcacatagtaggtgcttaaggctatgatcctttgcccatgtgagcttctctataaccaggggccattttacaaatggggaaactgaggcttatttattaattcattccactgaagggattttgttcctgggagggggcaagccgggcctgagctatcacggccctgagtccttaacacgttgtgatatgtgccagcttgtctgcccaggtactaacaaggcctccctgccaccgctcagtccctgccagagccaatctgcatcctcgtctccaccaattacagaggtggagacgcccccccgcccccaaccaacaccgccaggccaggggggcctgagagcccagacgtcctccttttccaacctgggcgggggaccagagtcaaggaggccctcctccctcccctctccttcctcccgcctgcccctcctcccctcagctcggccaattaggcccctgacacctggagccgctgacaaactgtttctgtcacttgctctctgtctttcattagggccgcagaagagggggagcagggaagggagggggaggagatgggatctttcatgcttagtaaggccagatacattaattacaaaacggccatttgccgcgtgaaagtgtgctaattaaatttatgcaatcattatctttaaatagtcatatcttttccagcgatcggccccttccccccgagcctcgccgctccgagcagagtcactctaatccctcgtccaccatttatcgagccatcagagatggtttcagaatctcactacaccgttagcaccaggacccaccaggggccctgagcccttggacccatcctggcgtgggcaccttcagactcaggccaacccaaggatctgccctgggatgaggggcaaagcctccatctggtgtttccagatatttctagatgtttccagaaatttggagattgacatcttgtaaaacagacattggaagagtgtgtgtgtgtgtgtgtgtgcgcgcgcgtgcgcgcgtgtgtgtgcgtgtgtttgtgtgtgtgtgtgtctttgacttcttggacaataagtggaatgccattctgttcctccctccgcccccacctcacctctagacatcttataaaacagacattggaagagtgtgagtgtgtgtgtgtgtgtgtgtgtgtgtgtgtgtctttgacttcttggacaatgagtggaaagccattctgttcctccctccacccccacctcacctctagacagtccttaactaaaagcctccaaggacccctggaatggggagggggcacttagaaacccattgggttggaggatgtttgcaatatgtcccctcaatttattcttttcctccaaccaactctgtgctagatcctgtgctcaggataaaaagataaattcatttcttcattcatgaattcctcacttagcaaatgtttattgggtgccttctgtgtcccaggcactgggaataagacgccaagtctgtccccaggcagctcctggccaaatccaggcacgtcatggccaaatccaggcacgtcatggccacaagaaaacaacaaacagggtgaggctcagtctgttcccaggcagagggttgggccttagtgggactgaaagtttccacggggtaaggcttgaacacagggacctcacagcctcttttggctgcacctcccagggtctctccctcacacaccagaaggttcttaccaaagtctcagctggatgtcttctgctgcagtttcacaaattatcccctctgctttcctcttcactcagacagagccggcctcatgagtctttccaagtctgtatatcaagctgcacgtgggaggagaagagaccccaccagggttgtgggtggctagcccccaccctggtcagagatggcagtcaatgacccggtgttcaccacgtatcctctgagcttccaaggtccccgagcttcagcctgtactctgggttggggcacacaggatctgtgccctatacatgtgcagtgctcacatgcacacacaccatgcacacacagtagtagatactgcatgcacatgcaatacttatgcacacacaatactcacagaaacacataaaaaattcacacatatacacacaaatacttgcacatgcacacacagattctacacatgcacatacaatactcccatgcacatataacacacaggcacatacaaagacacaatgctcacacatcacacaaggacttagaagcatgcatacaacacacacacacagtacttccatgtgcacaagcatgcatgaacacacagtactcacacatgcacacacagtattcacacatgcacacactctctcatcctctctctctctctctctctctcatacacacacacacacacacacacacacacacacacagagttaacactcaggtaataaatgaccctgagccacctatggtaaatgaaggccacagccaggcacaaggcgatcaccttctagcatcagaccagaagtcgagagtcaagggtccttgccccagtcctgtcactcatcccccaggtgattctgggtgagccgctaagcctcagttttctcatctgaaaaatggggtcacagtacttcctagagtcatgatgaggcttaaagggaaatacttcacaaactgtaaagtgctgtgcttgtgcaagagaatgccatcagccaggcttagaaaagcgttcatggagggcttcgagggtgacaaatgagagggaaccaggagtcagggggctgggtcgggagagggaagggaaccttcttgcccacacggcaggtgcagggcttcggtgtgggatgctggtagtggagggggttgggtgtggaggccataagcagagatggaaactgaagtgggggacagggagacctgcaggaaatcttgtttggaagctccaagtcagcacccgaagcctattaccgctgtccacagggggaaaggagggggagggtccagatcctcttagtggagtattgagaggaagagggggtgagggtgggcagctgcccgggtgggtaatttctggcttgcactaatcccagtgtggggctgggaacaggcagccgccagtaggggcatgcgtgtgtctgggtgtcccctgggggctggaggagggtgaagggcgcacaggtttgcgtgagtgagctgacgaaggcggagttgtggggtggcagtgtgtgggtgcgtgagggtctgtgtacctctttgtgtgcacatcggggaggccggtggatctgtggccagcgggatgggtgcctgcgggttttcatggatgtcgttctctgtctgttcgtgttggcgtgtctgtaatgtgtgtgtcttcctgcacgggtgtctgggtgtgtgttggtgcgtctgtaatgtgtgtgtcttcctgcatcggtgtctgggtgttttttgtgtgcatcccatatcttcgcctgtatgagtatggatgtgtcatggtattacgtgtgtgtagcaattcacagtgatgtcttgagactagtggccgtcaaacttggctgctcattagaatcacccgggagctttaaaaactcctgacctgaccgggcgtcgtggctcacgcctgtagtcccagcactttgggaggccaaggcagccagatcacctgaggtcaggagttcgagaccagcgtgaccaacatagagaaaccccattctactaaaaaaaaaaaaaaaaaattagccgggcttggtggtgcatgcctgtaatcccagctactcaggaggctgagccaggagaattgcttgaacctgggaggcagaggttgcggtgagccgagatcacaccattgcactccagcctgggcaacaagagtgaaactccgtctcaaaaaaaaaaacaaaaaactcctgacccccagacccccaagtgattccagtggacagtcaagacggagaaccagtgatggagcagacagacccaggggagaggcccatctctcttgcccagtcctcagcctgctctgacaggatctgcctggaggcagaggtggattccagaccccagacccttaggaaccaaggcaagttgtgagctgggctgccacaggtcatctcccagcctggggacagttcttggtccatagggacactttcatgcaattcagacaaagcattctattcctggcaagctgtgttctgacaatgggaacagagggctctgaaaatatctcctcttctcacctcttggggaagtcaaaacggtgagccagggctggaggtggacctgaggcttggagatgaaagtgctctgtgtgtcaagccagcagatccttttggaaccacacccaagacagggggcaggagggagtggcagtaatccctggggtgccaagtcactctccctctttcagcctcagtttccccatctgtgaacatgcagcaaactccaagttgcctcccaagtttcatgtgcatatttgggtgtatttacatgcaagtgtgtgcatgtgtaagtgtattggatgagtttaggaaagtgggagtgcaaatgggaaaaactatcctgcccgttaactggggctctgatgaaaggctatttggcgattgggaccagagatattttcaatggactcatcgtcctggattcagttgtgtgtcctgcagagtgtggtgtgggctgccctgtgcagtgtgtgtgttgtggagttgtgtggattccaggccttgctcagctgagactgggagactccaaggatttgtactttgatggttccttcttcctataggggagcacactcaggccagagtggggtgcaacttgtcaaagcctcacactcctgctccctttccagtgtgcaggccccagcttctgcgtggggacagaacagttctaagggggcagagcaatgcttcattcagaaagaacccactgggtgttggcccccatgggagaaaaagatgaaaaactgcacagcccctgactgagagctgttcccagagtctgcttccaagtgctcatttccatctcaggcaaggtccctgagccacctgcctcttcccttctaatccaggcagaagaggtgtcggggaggtgaaaaaggaaggggagggggacagctgatatttactgggaactaacaatgcaccaggcatggcacatccagtgtacatttactcacttaatccttacaataactctctaggtagctacaattatcatcatacctattttatagatgagaaaaccgaggcacagaaggttaaagaaattgctcagagtcgcagttagtcagggcagatattctggcccctatgctgcaggaaagcccttctgagcactgactggtccaggcccagtgccctcggggaaactgttgtccctcttagagcctcagggtccctctcaggcagtgtagaggtggggctctgtgtcctgccgatggtccctgcagccttgacctgattcctgacccccacccctatcctgaccttcagtctctaggccctgtgcctccctcttcctctgcaccctgctgcggcccccacccacccaccacaaaccctgccacagagccccaatgatggcgattgccccttctaattgcagccacactcccaaagccacgttcagttatcacagagggtgcagatctcacagctcagcctcctcagtcccaggccctcggggccagctcaggaacggagggaactaattacatttttcccatccccttcttttaaagtaggggagcgcgccggcatgtcccaggggagggggcggtgagcagaggctgtggaaggggggcccccacccccaaaccagcaagcctctccccagcagacggaagggagggtgaggctggcctcttattgatttagtctggtcgaggctgggactgatttggagtagagggagaggaaggggttgggggtggggtaggggccgtggcgggtggggggaaatggaggaggaagggagaggaagggacggctgtctgtcagcctgacggacagccctgagatttgccttcagataaaaccttacagatgtggaggtcggtattgattttgagttagtaacggtaacctaccaagaagtaatacattagtgaaagcaaggtcaccaggaaaaaagtaaaatctacccggggagaggccttagcattcttgagaggggtggattactgcatcagacctgaacttcctcaagttgaaaagtttgcaggctccggacctcagctggattcctaactgtgggccaatgcttcctgcttctgcaggccaagagggagccctaaaggtccccgggaagccagaggccagcgaggggcatttaggcccatagggctctgtgcagtgaggttgccaaacctctccctgtgtgctctccagcacagctggtggcagggaaagagcacagctagggacccgggagacctgggtgcaaatcccagctctgccacttaccggctgtgtggttgtgggtgagcccttttgcttcctcgtgtctcaatttccccatctgcataatgggagtaatgataccccatctgcttgaggagtccatgaactggccaatatatgactcaggccttgtggtcttcatcagtgagtgttctcccctcccgccgctctccagttgggtcctgtcccattagcttagacgctgccctgcctggagacagggggttggatgaaatggaagccctttgatccacagacccccaggggctctgggagagagtaagcagtggcagcacatcctccattcacaccctccccagatgtggatttgatttgatgttccagggcaaatcccattgagcaaatcccattacgggaaaagctccctggacccaagctgtttctgagctgtcagttcacagcccagggtccaaggcctcttgagccaccgggcaccacccaagccccttctgagaaaggactgcacaagccctcgcagctcctggaatttttactctccgccttcaccttcttgctatttcctaaacctgctgggtgtatctcgtgattcagccccctcagccccagggacctcagggcctttgcacttgctgacttctctgcctggaaagctcccctgcctcgtcttctcagggctgttctttctggtcttgctggatatcacatctttggggaggtcttgcctgactgccccacatagccccttatttttcctccgtagcatttatcagtatcagaaattatattatttgttcacttgtttattgtcagcttcgttccttaggccgacagctccaggaggacatgggattggcatttttcatggctgtgtccccagtgcctggcttagtgtctggcatataataggtgctcagtaaatgtttgttaaaggaatacacatgaattcagcagaggttttctgagctcagaatatgtagcaagtaccacgtaggcactgggactacagagacagacaaaatgcagttccatcctgctctcaaagagctcatagtccagccctagctccagactggcacatagtagcaccctatgaaatgcttgttggacgaatacgtgaatgaatgaaggatatcttcaagaaataccacattgtttgggatagctggaaggtaaagtgcagggtagaaaggggtgaaaggagttgggacaggcagctagaggtctggtcactaggagcttttgctgagagataatggggagccattcataattcttgagtgatactgtcagattgggcagcagttctgtgcaggtctctgtcttagaggatgagtagtgggactacacatagctctcagcctgtctcaaaacatcctcgtcctcttcctaaccatcccccgactcctcccctcccatcatcccatccgggcttggcatcctggggatgggcaggagggaaggatcaaactggagtctcacgggagctgacaaaccctcccagtagtctcccagcccccgtcaactgtccttctgaaagaagtgatctggagcctgagtgttttttctgagcctctaagtctattcttggagtccaggcctcctttgagcagggagcagggtccgtgtttgtgttgggtgagaaaggagatgggtgggaaaaggtctagactgagaaccccagggtagactcagattcctgagtctgccctgggaccttgctctcctccccaagcccctagcacattcttcaagctaaggagatcccatcttgacagacagaaagcaacaaacacagtcccacagtgtcagacaccctcacataccactaccccagcaccctactgttgacccgaccacaacaaagatctcagaagcacattcaacacagagcgagttagggagacctcagctccctaaagtagtgctagtgtccaaaggactctagaccctccccagcccagcctcctgcctcccaggcagactttctctctccttcttgcaaacccattccagtgtgtctttgccatcttgatgaggttgacacacccctatgtcccacccaaatctccccagctgtgtggagatgaagactagccagttgacggtctcagctggtctgagctctgagctctggttctggggtgagagtgacagagggaaaaggtggaggaggggagacccccagggctgagggcatgggggaaagaaccaggcagaggctctgctcaagacattccagaggacctaagcttcccccagagcaagggaccccaccccactcaccccacattagctgcccaggaaacaaactactgctggtccttggagtgagaccctctaaagtgatcagatgcctcaacctcattcattcttgagagttgaacttgacattttgcaggtgagccagggtcaggcgaactgagccctgggcctgctgtgagatctagggaagccacggcccctttgcgggcctcagtttttcatctgggaaatgggcatcctagctttgccccacaaatctctgtgggcttttgggttgggagagtcaaatgagttaactgctcagggatactcccgaggttacacagctggtaaacggaggagctcgctgtctgtccctagcccgaggaatccatcagtgccctcgactgtggccaggcctcaatgcctgtggcacaagccaataataaaggcaaaggtaaaaatcttcagaaggtgtctagtcggcaaaacgatcactgctcgaatgcccgcagcctgctttcttaccctgtaaggggagtcagggaactcaactgtgtgcccagcagggattgccacgtggttctccgtctcggtgctgggcagattatcagcaaagccgtccccacctcatactcagggtcttcctcccataaagggcggcatcaccaggaggtcatcaggggcctgggccctgcaggttaggttcacgagggcctgcctctccctcctaccctctcccctgccctcctctgaactcactgggacactgtgccctctctctcctgccctctcccctgctctgctctgaactgactgggacactgtgccctcccactctccaggagctcctgctgcaccactcccagtcccaccccaggaaagcactgcttctccccgtcctctttcctggagagctagacagcaggttccacctcccctagatttcccagactgccaaggatgactgggtgccctcctctgtgtcctttgatagataagatgcctgtatcactactccatgtctctatgatctttgctagtagcttccctcacccgacccagacccttcctcctcctctcccccgaccgagggcagggaccatggctctttctcctctgaagtctcagagccttcagctctcagcctggggccagagtcaccatccatgcctgtttgtggagtaaacaagtgaacatcccagtaagtgaacacctggacctccatccaggtcccctaagctgagcttctagagacaagcctcccctggtagtctgtgttgccagcactgacagtgagttcctatttgcggaacctggccaggcagggaaggaggggatgctcacagacctcaggagctggtagaatcaaaggaaggggcctgagaggctctttgaaagcattggctgtgggcttcagtgtcgaaggggcaggaacctcagagtccggaggagtggcaggcagagcaagccacacacagtgacagcagacagatcaagagtcctgctgtaatgtttgtgttagaagatggggccatcccagtctgatgggggaggcacagttctctgagcttggagaactccctgactgatgggagaggcctcattagccagttcgttcattcatgcattcattcatgcatttattcattcaatagacaggcccagagtgacccttagggccagaccctggagctagagaggcgagtaaggccctgctgagttctcagtggaaggaggatccctgggtcaggaccctccttcaagagaaacaccgaagaccagcagccatcccatgcatgagggcacgcaaatcaggtaaactgaggacctcgaagctacagagacttcaagggaacaactctggcaaagagtgttccagggccagcctggcattgtgcccagtgtgctcgtgtctctggggtctgtccggtgagcctggcactaatggccttttccccacaggtgatgagcatcttgggcaaccccagtgcggtgcccccgcagccacaggctgacttctccatctccccgctgcatggcggcctggactcggccacctccatctcagccagctgcagccagcgggccgactccatcaagccaggagacagcctgcccacctcccaggcctactgcccacccacctacagcaccaccggctacagcgtggaccccgtggccggctatcagtacggccagtacggccagagtgagtgcctggtgccctgggcgtcccccgtccccattccttctcccacccccagggcctcctgcttgtttatggagagctacaaggtggtgtcagggtggggaatgtccatttcacagatggaaaaattgaagtccagccagatggaacagttcacctaaaatgacactgagttgggcaaaacccaggacatctcctggctaagcctctgcttccgtactatggctccaacagaaataaaatacacaacacaaatatcacttaacatttctagtggccacattttaaaacataagaagaaacaggccaggcgtggtggctcatgcctgtaatcccagcactttggaaggctgaggcaaacgaatcacttgagcccaggagttcaagaccagcctggtcaacatggtgaaactctgtctctactaaaaatacaaaaattagccaggcatggtggcgcacacctgtaatcccagctactcaagtaggtgaggcacaagaatcacttgaacccgggaagcggaggttgcagtgagccgagatcacgccactgtactccagcctgtgtgacagagcaagactctgtctcaaaaaaaaaaaaaaaaaaatcaaggagaagaaacaatggaattatttttactaacattttatttaacccagtacatccaaaagattatcatttcaaaatgcaattcatatataattattgagatattttacattctcttctttatgctatgtctttgacatcatgtgtgtgttttacacttacagcccattttaattcggacactgagttttcaacagaaatacttgatctgtatttaaatttcatatagtttgcaactgagaaaatatacttacaaacccaaagtgttccaaattgtaagttttccaactactaaataacccaattgaagattggtttttgactttaaattagttcaagtgaaatcggcatttgaaattctgtttcccagtcgcactagccacatttcaagtgctcagcagccatgtgctgctggtggccactgtgctggacagctcagtgggagaccctgccccttctgccgcagggcatgggaaagctgtgtttccaactctctcctccactccaaactctgcaatggtctcatgcacccatcccagctgctatcccctttgtgccttgccttgaggcagggaccgtggatcctcacaccaaaggctggaaaacgcaggcctggacacagcctccaccgcctggcaaggccagcagcagggcaggtccagatgggacagggagccagaggtcatgggtcactttcctgccccaccgccctgcaaaggcctcacctgctggtgtcaaactaatcagaagggcgtgtggcaagagggtgaggcccccatccctgagggtgtcctctcccccagcccagccctgggccagcctttctgacctctgcttcctgcccacccccccaaacccactcctcttcacgtgtcgttggcctccactgccaaatgagggccactgccaaatgagggccagctatgtcggcctccacctcccagctgtgttcacaacccttcctgtgcatgtacatgtttgcatatgtgtatgtacacatgtgtgtatgggtgtttgtgagtacgtatgttgggacatgttacaattcttgtgtgtgtgtgcatgtgatgcttctatttcagcacccatgtgttattgcatgcatctttgcatatgcgcgaatacatgtatgtgtcagtgggcacatgtgagcatatgtgtatatgacttcacatgcgtgcacataaatgagcatattgtgcatacatgatgtgcacatctgtgtgtgtgaacacacatgtgcacacatatatgtaagtatatgtatctgcttaaacatgtttaaatgtgcattcaagtctgtacatatggttgagcgtgtctttatgtgtgcctccatgtttggcataggtatgcatatgtcaatatgtagataggtataatgaatatgtatgcgtgtgtatagatgtatatgagtgtgcaaacatgtgactgtatgtacatgtgtatagccatgcattgaggcatgcacacatgcttgagtgtgtctgtgattgtgtgtttggaagtacctgtgtgtggacacatattctgtgtgcagtgtgtaaataggggtgagtgtatgagtgtatgtttgagtatgtcataggtgtggctgtgtgtacatgtgtatggatgtacatctgggtgtagacatacactgtgtctgtgtgt

SEQ ID NO: 14170 - DNA, 109159 bp, Human; identical to SEQ ID NO: 14169

SEQ ID NO: 14171 - DNA, 8829 bp, Human
agagagagggatcctttaataaccgccaccaggtcccatccctcctcttcccacggctctccaggattcccacctcactcagagcaaaagcccaagtccagggccaggcgcagtggctcacacctgtaatccctgcactctgggaggtggaggcgggaggatcacctgatgtcaggatttcaagaccagtctggccaatatggtgaaacctgtctctactaaatatacaaaaattagccaggcgtggtgatgcgcacctgtaatcccagctactcaggaggcagaggcaggagaatcacttgaatccgggtggcagaggctgcagtcagccaacatcacatcactgcactccagcctgggcaacagagtgagactccatctcaaaaacaaacaaacagctgatcacggtggctcacgcctgtaatcccagcactttgggaggccgaggcgggcagatcatctgaggtcgggagttcaagaccagcctgaccaacatggagaaaccccgtctctactaaaactccaaaattagcggggcgtggtggcacgtgcctgtaatccagctactcgggaggctgaggcaggaatcacttgaacccaggatgcggtgagctgagattgtgccattgtactccagcctgggcaacaagagcgaaactccatctcaaaaaacaaaccaaccaaccaccaggtcccgtccctcctcctcccacagccttccagggctcctacctcactcagagcaaaatcccaagtcctccccaagacccacaagtccttgctggactggcctgcttcaccagctacagagttagcagggcccagtgcaaaagaaaactcaaaggccccttgttcaaaaatgattaggaatctcaaaatgcagcagtaaatattaacccaagcacaagccctgctgtggggtgggggggccctggacaaaagcacgaagcccccggccctgcctccctccggccttcctgacctccccccgggcactctgctgccaggcacagtcctgccccagggcctttgcacctgttggtcctgcctctgactacctctgtaccccatccccctgttctccctccttcttcaggtcgctttaggggtggaggaagccgtctctgatcctccctcccacctctttaactttgcaccttcctaccctgccattctcccggctggtttttctgcagaactgtccccaccatctgacctgccaggaattcagcttgtgaatttgtctctgtctgtctccaggcaccaccaccagggcagggacccacccccgccccgccccaccccagggccctggagcagcggggcctggcacacagtaggcgttctataaatgtgtcacaagaatggcttccctcaggaaggcggcattaccgctgcctttctgcagaaaaggaaactaaggctcagcaagaaccaccgcccagccagagccaaggtcacagagcacgtccgtggcacgcgtccaggtcgtgccacagcagggccggcggcttcgacgcgggcagccgggtcccttttctttgacagatggggaaaccgaggcccggccggctgccgggtaggagagggtggcgggggccgctgcccggggcgggggcgggccgggcccaaggtcaccgcggcgggcgggccacggggaggcgggccggcgtggggatccgcaggcctccccgggcgcgcgcgtcccccccctcggcggcgcgcacggggcacgggcggcggcaggtggagccgaagcctccgcagcagccgagccgcggccactgccggcgtcgccgccattagacaatagcggtggggccggggagcggggaggcgggcggcggggaggggcggggaggggcgccgggcgcgcaggaagcggggcccggggcgcgccggggccgggcgcgcggggagggggcgcaggaagcgggcgaggccgggcgcgggaggcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcggtaagcggggcccgtccggccggcgcccccaccccggatccgggccctacgcccccgacccccggctcccggccccgcgccccccaacccccaggcccggtgcctccggcccggcgccccccccaactccccggccctgtcttccctctccagctcccagcccggcgcgacccccctcccctcctgccgccggcccccggacaccccccctccagttcccgatccaccccagcttccgggccccgagcccccccgccgcagctcccggcttggcgccccccccccccaacccgccgggacagtcagggcctcggacggccttggcctcgggtctggggcgctccggaagccccgcgaggcacctctagcccggggatcctttgggggcctgtggtggggggggcgatccgaggcgcacccctcccggaagagcgtgtccccgaggaagggcgctgggaatctggggttgggcccccccggaagatttcgagcaccgagagagagacccctcccccaagaggactttgcagggaggaatcgctgccccccaacttggggagggggctccctagggcgcgtttctacccccctcggatgtgcactccctcccggcgctttggagggcggtagagggcgcaccctgccccccatctagggcgggccttaaaacgcacccccactgcctgggggtggcgggggacggggcggctccgggcgcacccacccgctcggcttcccccgggagaggcggggggcaggaagcgcgggtggggtcgcccagggggccgtaaacacgggcccaggaagtggggcaggagggggggcgccgcagctgcgcggccgctccctcctagccggcccttgaggggggtccagcccacgcctgggcctgacccgggccgccccatccctacagggctcctcgcacctaccccagcaactcaaattcaccacctcggactcctgcgaccgcatcaaagacgaatttcagctactgcaagctcagtaccacaggtgagctgggggactgggggtccctgcgtcccgagaatgtgagtccccccatttcttctgcgcagatggcaaggctgaggcctggagattgggaaaataatatatgctagactctgacctaatcacttgacaaatactgaattcatttattttaaacagccccattttgtagaggagaaaaccgaggcacaaaaatagttaaataatttgcccaaagattcagctgtgtggcttcagagcccctccctcctccccaatacccccaagtcccccattggataaaagaccttccaacaattggagttacggcacggactcgccatccctcaacccccaaaacagaaacattctgcagcctggtcatctctctctttgcccagttttggagaaagggttcccagcacccgtcagattctccaaggtgctgcttctttcagaaatctggcgtttctgaagagcttgccacgctgcggtatctaaggggaaggaactatttagtcctcttacacttaaagaaacttaagcccaggccaggcgtggtggctcatgcctgtaatcccagcactttgggaggccgaggaaggtggatcacttgaggtcaggagttcgagaccagcctggccaacatggtgaaaccccgtctctaccaaaaatacatagttagctgggtgtggtggcgggcgcctgtaatcccagctactcgggtggctgaggcaggaaacttgcttgaacccgtgaggcggaggttgcagtgagcagagatggagccactgctctccagcctgggtaacagggagactctgtctcaaaaaaaaaaaaaaaaaaaaaaaagaaagaaaaaaagaaacttaagcccagagatgttatgatgttatttcctcgggggtgtccatagcattgaggaagtggcaaggctgaggtttgcaccaggtctctctcctggtttaaggatataggttctcgcctgccctgctctggaggggcacgccgggcctgggaatctggagaaagtcaggctatgctcaaacccccgtttggccttggggccctctctaaactgaagcgtgcccaccccagaagtgttcctggaaggatcctggatttcctccaagtagaaaggggaatctcgattttgttgttgctgctgcaaatatcccacctttttgggtactccctgtgtgctcaagaccgttcgtgcctcctcgtgcttcatccttcctgtcgtccgactgtcgtacccattctcaagctgggcaaactgagacactgacagtcgaaggtgctggagtcagctttccatgcaggccccagaagcttttgtgcgggttcctcgatatgaagggttggataccgcctggtgagccccggggctgacctgattccacagggaagggatcagatggcggtcacagtgctgtgtgacctctgctaagccggaagccctctctgagctttggggtctccatccgctgggcctgggcttcctgctgtccaacgagggaccctaccatatcagaggcacacaccggatgttcgaggcgtaacagcccctgggtggccagaccatcctatttttcaagaaaggccagaaatgcaggctttggagtgaaacttcttttttattttattttatttttttgagacggagtcttgctctgtcgccaggctggagtgcagtggcgcgatctcggctcactgcaacctccacctttgggattcaagcgattcttctgtttcagcctcccaagtagctgggattacaggcgtgcaccaccacacccggctaatttttgtattttcggtagagacgggctttcgttatgttggccaggctggtctcaaactcctgacctcaagtgatccacccgccttggcctcccaaaatgctgggattacaggcgtgagccactgcacccagccccggtttttttttgtttttgtttttgtttttaatggtagcaacaaatgcacattttaaaagaaaactagagaaaaattggtggcggccaaagcatccctaacccggcacactcttctccggtggagcaaaatgccaggttcctggggtatcctaagatccatgtgcatttatgggatgcttactgtatgccaggtactgttctagaacttttcttgtctgaattcattgactcttctccaccccaccctgcgaggttgttagtggtacctcacagaggaggaaatgaagcccagagaggtagtggagtttgcctagagtcacacagcagggaagacgaagggctgagctttgaacccagtccgagagggggtggggatggcagaagcaggtaagccacagccaggtccgcagggcccctgtgctgggttggatttaagtaggttaaaggacacctcccccaccaccatcaccagttcttttcctggactgggaggccctcctgcctgctctcttccctccggccatgacgccctcatgggggctttgagaaacgccccacagctcatccttcccgggagggcctgtaggaagctctggtgtcagccacccggactggccaggtggagtgggagaaatggtgtgttttgtcccagctaaagaaaaaaggctgttaggaaggactaagagggagctgaggggtctgcctgggaagtccaggccccccatgaagctagggtccccttgggaagtccagccgggagccgccttgcagccccagaccctctcagcctctttgtacgttctatttgggtctggaaaattttcccctgtggttgagagcttgggctgctgcttggctgtgtgaccttgagccagttcctcaccctctctgggtgtccactgtgtcatctataaaaggagcgtgacaatgacgttgcgggcctcgtcgggaccgtgagaggtgaaggctcgtgagactctcagagctagcgttaccgtgccccctctaacttctgttgttcctataatgttactataatgttgcttatttccccccaaccagatctgcaagggtggtttcatcacccccttcttacagtcaggggccctgatgctctcccctccccgcagcatcacagagagctcaactcttaccaacttccctgcccctcaattcaatgtcctcagcccctatgaaagtttacggcttcattggccaggcacggtgggtggctcatatctgtaaccccaagcactttgggaggccgaggaaggaggattgcttgagcccaggagtttttgagaccagcctgggcaacatagggagacccccgtctcaatttaaaaaaaaaattattgcttgaccctctgagaattggctgatcttgcccttacaggggacttggagcctcagtttcctcccctggataacggagggtggggggctcccgcccagccgccactaaccaccccatctcccccctgtgcctcctcagcctcaagctcgaatgtgacaagttggccagtgagaagtcagagatgcagcgtcactatgtgatggtaacgtcactccgcccccaggtccagtgttgggggcgggcgacagggccctccacatcccctccaccacgggcagctgctccctcaaccccggccacctcccctgggaagcgcgaggatcggggcctgttctccattcagccggcccctgctgggctgagcctgcctcgctagcctggcagatggccgaggcagtggccgaggtgccaaaccgccgggttgcagaccggccctgccaggtcccccggctgtccttggcagcggaggagggaggagagggaggctcaccggctgtgaaagccaacagccaggaactgacgtgggggagcagccgagtccctccccaccgccaaggtcccagcgtccacacgcttaacccctttgggcccgagctcaaagaagaagcctgtgggagggggtctgagccctacccatttcggggggctgaggtgtgacactgcattgctgctgccagaaccacttgctcggttttgtaactgccaggtgacgatttctgcatcaaaaatcccctcccttacccacccttggcctggccctcgagcagcgatgctggggtctcagcccagtacccaaatctcccagactgtgggggaggcagagccagaccctgaccctcccagccagaagaatagggctggggtcagagagagggacctaggacctgcctgaggaagactatatggagaaatggggcacacagctggggtcttgcaggatgagtaggagttcaccagacagagacagagaaactacgtgaaggcctgggaatgaacttggttttcccccaggggtgacagggagccatgggagggtttagagcaggggaggggcagggtgagatctggggcttggggtgggggtagctgctggccccagagccagcaggctttgtttacccctcactgtttatacctaggcaggcaaacttccctggcgtctgggcccacccgcagacaagacatagaaagatacaagattaggagccctggaatgcgtgttctcgcggtgcacatggagtgggggaggagccaggccagggctagggacctaaagtgcccccagtctccatccgcagccccagcggccccctgcccctctccagggcgggctgggatgctgggtgtgggcgtctctccctcctctttccctcccacctgcctctcctttctttcctgccctcagctgtctcttgctgtctcccccctttgtctgtctctgccactcccctatctctttgtctccgtgtccccccatccttccccacccccatctcccgctccccctctctctcccccatacagtactacgagatgtcctacggcttgaacatcgagatgcacaaacaggtacgcccatctcctcctcctcctcctcctcctcctccttccccctcctccccccacctccagccccgccttgggcacccccaggcaggtagcggccggccctcggctgggcaccaagccagcccggttatcctgttacctcctaagccctccccaagctcccgctctcctcccccccgccccgcctctttttcaggcctccctgggagtgtttctcccggtggtggggaggggcagagaccttccccacagcctacggcccccagccctccctacattcgcacaagcgcttactacctgccaggggcctgagtggccgacccccgaggaatgtgcagtctggcctcatcctgcacttacctcactctaagctgcaggcgacagccggtgtccagccccacctttgccactgactggctgccctcgggcccgaacacggctttgctcatcccaccctggccagacctagcccctcttagaagccgcaagtggcagggctgggccgggccccgcgcaggcctcctgtggctagcctgcacctgccacccgcccaggactgaagccggcttcatctgtgtgttccaggctgagatcgtcaaaaggctgaacgggatttgtgcccaggtcctgccctacctctcccaagaggtaagagccagggccttggggaggggttgtgagggggccccgcacttgcccagcccctgtccactgcagccatcttgggtggtgtgctgggcgccccagggcacacgcctcccctctctggacctccctggctctgaacaccagagccggcctgtgcagaagaatccccgggccagagacactccaggggtgcaggcgtgtggggggcgggcct

SEQ ID NO: 14172 - DNA, 194933 bp, Human
  misc_feature (1)...(194933): n = A,T,C or G
tttaaaaatgtaaagactcattgcccatctatttgggatattgggcagggatcttttattggataactagaggttggactggatgaccttcagccccaagtttctgaatctgaggggagaatgagtagagtgaatttacagcttactgatcacagggacaatcttgtttaaattgcctcctttaaggtggcattttgggttggcatttaaaactgtactgtttgaacaagtatagttcaatgacccagctgtttttcagcaacattccaggatctctgagagcaaatactatattcttcagtatgtctggctaaagtttttaaggaaagatattattttcttctcttaggtatagtctgtctaaataaataaccagagataactttaattttgtattttgttataaaaatttcaaagtatatagatgttgcatttgatgaaagtgataactatatattgaatattagataatgtgtttatttaatcctctcagtagtcctgtaagggatataccagtattgcctacaagtaaagtgatggaagcttaagttatccagggttcctccactggacattgtggtagggctggggttcagacccaggttggtctctttgcagaggcagaactagctagagcaggcagttgtggctcaggtgagaacagtgatggacttagttggattttagaattggctgggcacagtggcttacacctataatcctagcacttttgagaggccgaggtgggctgaggtcaggagtttgagaccagcctggccaaaatggcaaaactccatctctactaaaaatacaaacattagctgggtgtggtggcacattcctgtaatcccagccacttgggaggctgtgcaggagaatcgcttgaacccagaaggcagagattacagtgagctgagattgcgctattgcactccagcctgggtgacagagcgagactctatctcaaaaaaaaaaaattaataaaaaaaattaatgatgttcgaccctttaatctgttattgactcttcccttgggtgaattccatcttctcccgagcctcagtttacccacaaagttctgcagtttaagtgacaagttatatgtgagcacactctgtacagtttaaactataaaaagaattaagaagtggatgttatcattggacaccaagattagagctcaggtttggcccaattcccaggccaaggctctttctccttgtagcctctttgtagatgtactcaataccagattggagatctagggtggtttttgtatataccaagcatctctcagaacaaatgccactgtccacctggaatcagatttgtatatatcttctttgtactgagctgtttaatgagctaactgggtattaagataactagaatgctctactacttaaaggtgaagggttatgttactgtattattttcagttttccaatttgtgggttagagggtatcatagacctctgttaaagggatggggatgtgattccatagaagtagctagatgggaagtttttttacgtatgagacttgggaaatacaatacctagctgaaagctggattatttactcttttttttaagtttaagattttttgaaataagtttaatgtactttcatcagattttttatatcatagacttattctttgatgtgtattttatgtttatggcagacatatacctcaaaccactttcatataattttgttaatttcaataaatataattaaatgtataatttagatgtgattatgcctcataaatgacttcatatagagaagtgaaacattctaaaaacaatttcttctcagactgtgacccaatttcttgttgaaaaatatagtcactgtggctgtgttatgtaatacctgcctgtcattacttcttgtggtcattctgtgtctgaaaaagtcatgctaaagaatcttttagtttatttgtgtaagcttcattattaagagactttcccctctttttatcctttaaggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccaggtaagcgaaggagtaatgttcgtgcattctcactactgtccttttgtcttttacggtttcacttaagttttatgtggacaaaagttctgaataaagtttgataaaattgaatgttttgccttagagcaggcttttgtattttaaaatgtatatattgtactgcattgtgtggaggacttcctcactggttggccaagaatttaatggaagagtcatgtggtttgtttttaagctctaattgctaactggttggtgtctgaagggaccaggaaggataatattgatctttcttcatccaggcagggtcatatatatttcagaaatctacgaaaaggccatcgtatatttttctctttattactattttcaaagaagaatctacagacttcttattttactattattatttttttgagacagaatctagctctgtcgcctaggctggagtgcagtggcgcagtcttgactcactgcaacctctgcctcccaggtttaagcgattctcctgcctcagcctcccaagtagctgggattacaggcacctgctaccacacctggctaatttttgtatttttaatagagacaggacttcaccatcttggccaggctggtctcaagctcctgacctcaagtgatgcgcccgcctcggcctcccaaagcgctgggattagaggcgtgagccaccatgcccagctagacttcttattttaatggtgataatctatgcttttttttttgagatggagttttgctcttgttgcccaggctggagtgcagtggcacaatctcggctcactgcaacctctgcctcccgggttcaagtgattcttctgcctcagcctacctagtagctgggattacaggcacatgccaccatgcccagctaatttttgtatttttagtagagaccaggtttcaccatgttggccgggctagtctcgaactcctgacttcaggtgatccacccgctttggtctcccaaagtgttgggattacaggcgtgagacaccatgcctggctgataatctatgcatgtaagaagttattttaatacgtcacctaaatccctcatttcaataaaaagtcattttttattgtccacttctctgtgttgtaggtgaatgtttattttgtctcatacagtatctttttaaaatactctgatttcttgggccttatgttatttctatagtatttataaatatatggcagaattctccttacattactgctaccactttaagtttttggttgagtaagatttgtctttgtttcaaagctacagtatttacttcccaaactaaacacaaagtagagcagcagaaagttatttatagttcatgtctagttttggggtttattctctgtcttttgggtgagcagatatattgatatcagttaattttattaatacatgttataaaacattaatcattgttgatagaaaggtggttttggctgggcagggtggctcctgcctgtagtcccagcaccttgggaggccagggtgggaggatcacttgagcccaggagttcaagactagcctgggcaacatagtaagacccctgtctctacaaaaaaatcaaagaattagccaggcttggtgaagcacatgtgtagtcccagctacttgggaggctgaggtgggaggatcacttgagcatgggaggtagaggctgcagtgagccttgattgtactccagcctgggtgatagagtgagatcctgtcccaaagataaagaaaggaagaaagaaaaggtggttttggccaggcacagtggctcatgcctgtaatcccagcactttgggaggctgaggtgggccaattgcctgagtttgagaccagcctggccaacatggtgaaaccccatctctactaaatatacaaaaaaattaggcaggcgtggtggggggcacctgtagtcccagctatttgggaggctgaggcaggagaatcccttaaacccgggaggcagacgttgcagtgagctgagattgtgccactgcactccagcctgggtgacagagcgagactctgtctcaaaaaaaaaaaaaaaaaacaaaaaaaaaaagaaggaaagaaatggtggttttattcatggtttactgcagccttgaccttttgggatcaagtgttcctcccaagtaactgggaatacaggtgtatgccaccatgcccagctaagtttttaaattttttgtagagatggggttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgagccactgtgcctggccaacatttatttgttaactatatttttattttgttagtcttctgccacatttatttgatccttaggtggttgttgtgtttgtgtaaccaacctctagttctctgtggcagaatgtgggcataaagaaagaagtaaagttatgaaattttcttcttaataacatttgtttaaaagaaaatacaaaaagccacttaaatcctaattcatatgtctgacacagccaaatcagggacctctgtttttaattaaatacatatgtatatatatatttttgttttgtttttttgttttttttgagatggagtcttgctctgtcaccaggctggagtacagtggcatgatcttggctcactgcagcctctgcctcccaggttcaagtgatttccttgccttaacttcccgagtagctgggactacaggagcgtgccaccatgcctggccaattttttgtattttagtagagacggggtttcaccatgttggccaggatggcctcaatctcctgacctcatggtccacctgccttagcctcccaaaatgctgggattacaggcgtgagccactgtgcccagccttaattaaatattttttataaaagcttatactgtgaagaaattccttaagggactatagagccatttcttgatggatttggatatctttgtttttaaaaatatgtacactaccctaaggtatgttaaggttttataatgaacaggtacgtggactaattcaggtagctttaggcaatttaatagtatgtttcaataattttgtgatccaggggatactttttacttgtgatggaagagtcagtacaaattttccacagtatcttctgatccttcgctttaaccttgcccgtcatttcttgccaaccttatcatatttttttcaggcagcatctgtacagaagtatttttagtctaaaggaaaattcatgtctgaaagtgtctaggattgagagcagagtaatttattgcttagcaggcaattgttactgctctttttatgatgctgatctttaaattgtttagttagcatcatgctataatgaggaaagctgagaaatgttttctagaatttttacttgatgaaatttggagactaattctattaagtaatcatttgattcttaaaaaacaaaaataaataaaaatcagtttaaacaaagttggcaacatgtttgtattctttaatgaaatagcatttttttccagctgggtgcagtggctcatgcctgtaatcccagcactttgggaggccgaggtgggtggatcacctgaggtcagcagttcaagaccagcctgaccaacatggagaaacctcgtctctattaaaaaaatacaaaagtagccgggcatggtggtgcatgcctgtaatcccagctgctggggaggctgaggcaggagaattgcttgaacttgggaggcagagattgcagtgagccgagattgcgccattgcattccagcctgggcaacaaaagcgaaactccatctcaaaaaaaaaaataaataaataaaatagcatttttccttaaaaaatgtgagaaaattacaacataatatattaccctttgaaattaaaagtgatttaatagtttaaaaccatgtaaactcgctaagtaaatttaatagaaattcttagcccgggatccacaaatgaacttgggtgggtatcccacaaatcctctgaaatagagtgtgaagtcatgtgtgtgtatccatgtttttctttttttttctttttctttttctttttttttttttttgagacatagtttcactcttgtcacccaggctggagtacaatggcacaatcatggcccactgcaacctctgtctcccaggttcaagtgactcttctgcctcagcctccctagtagctgggattacaggcgtgcgccaccatgcctggctaatttttgcattttcagtagagacggggtttcaccatgttggccaggctggtcttgaactcctgacctcaggtgatccacccacctcagcctcccaaagtgctgggattataggcatgagcctctgtgcctggcctccacatgtttttctatggctagggtctatagcaagcttgtccaacccatggcccatgggctagatgcggccctgaatggctttgaatgcagcccaacacaaattcgtaaactttcttaaaacataaagagatttttggcttgcggcgtggtggcacacgcctataatcccagctactcaggaggctgaggcacaagaattgtttgaacctgggaggcggaggttgcagttagctgagattgaggcactgcactccagcctgggcgacagagcaacacttcgtttcaacaacaacaacaagaacaacaacaacaacaacaacatttttttgtggtttttaatttttttttttttaagctcactagctattgttagtgtattttatatgtggccctagacaattcttcttccagtgtggcccagggaagccaaaagattggacactcctggtctacatcttttgtcaaaggcacccaaaatgcctagtagccattttaaaatagtttgagtttcttatactaaatcatagtatgctaattgtcgacctatgatgattcttcctttggctgctgaacttggattcatatgtagattgattgtactataatttcctatatataagactttttctaatatatttgaaaagattatcattgttcttgatgtgcttgaagtcataggatttgccttgcattgtgggaggaaatttatgatataagtgaaaacagttcagaaatggagtgatctcaattacaatctagtcaactaatgccttttttttgagacagagtgtcactgtgtcacccagtctggagtgcagtggcatgatcttggctccctgcaacctcagcatcccaggttcaaacaattcttgtgcctcagcctcccgagtagctgggattacaggtgtgtgccaccacactgggctaatttttgtattttagtagagatggggtttcattaatgttggccaggctggccttgaactcctggcctcaagtgatccgcctgccttggcctcccaaaatgctgggattatagacgtgagctactatgccccatgcctggcctaactaatgacttttttttttttgagatggaatctcactctgtcatccagactggagtacgctggtgccatctcagctcactgcaacctccgcctcccagttcaagtgattctcctgcatcagcctcccaagtagctgggattacaggcacgcaccaccaagcccggctaattttagtatttttagtagagacagggtttcaccatgttgaccaggctggtctcgaactcgtgatctcaagtgatccgcctgccttggcatctcaaagtgctaggtaggattacaggcttgtgagccaccgtgcctggccatgactttcaagaagctgtttattctggttacttttttgagcagttacattaaatgtaaaacaaaataaaaatagtaagaataataactaacgttttgtaagtgttaaatgctggcactattccaagtgctttacatttattatctccttgacttgtcacaataactgcaagggaggtagattattacccttattttacagatgaaaaaatgaggctgaaagcttaagtgatttgcccaaggtcactgatagagctagtgagtggtgaagccaagattctgacgagacagtctgacctcagagctctttaccactgggcagtacactggtcaacagtggtggctttttttttttttttgagacagagtctcgctctgtcgcccaggctggagtgcagtggcatgatctcgcctcactgcaagctccgccttccgggttcacgccattctcctgcctcagcctcctgagtagctgggactacaggcgcccaccaccacgcccggctaattttttgtatttttagtagagacggggtttcaccgtgttagccaggatggtctcaatctcctgacctcgtgatccacctgcctcggcctgtggtggctttttattaacagtaaaagtatctcttccagttcttcaaatgattagaagcagttttgccccaacaaatagatttccagcattttaaatttggtagatgcaatgagcttattatagtttttaaagtagatactatttataatattagcaatatggaaaggcagtagagaaagtagtaagtctgtgtctaattagattgaacatcatcatcattccgatgcatgactgctaggaggaatacaatgcaagttaaaatagaagggctccttcctttctgaaatgtaattgcacatcttctgatagtctggaattcaaattgggtattaccacactggcttcttagcataaattctttgtatttatttaagaaagctctcttcggtgaggtgatatggaaatgaattaaaccactgaagataaaactttatctttgacttggtgagggaactcctaaaggatagtattaatgtttctcattaaaagtagtaaagctcaattaggtcagattatgaggactttggaaagtcacatattctaagagagacttccattatcactgcgcactttgtagcattaagattccatttgaacatttgagctttagcatttttataaaatcagtttagttccatttaaaataaattccatagtatttcactttagtgagaatgtcttcataaaatttattaagtgtcaagtcttggtctgtttccagtgtagtacataatgtgggaattctcattctaggttggcatcgtaattggaaggtgggacactttcagtatcaagtagggcttctgatgttttttctgttgaagaaatatttgtattagaatcttacaaaaagccttcaaacataaacaaaattacaaaaacagtgatactgtcaataagaaaaaaatcaaaatgatttttttttttttggatacagagtcttgctctgttgcccaggccggagtgcagtggcgcaatctcggctcactgcagctgccgcctctcgggttcaagcgattctcctgcctcagcctcctgagtagttggggattacaggcatgtgccaccatgcccggctaatttttgtatttttagtagagacagggtttcaccatgttggtcaggctgataagaatgattttttttttttttttttggagatggagtcttgctatgttgccaggctggagtgcagtggcgcgatctcggctcactacaacctccgcctccctggttcaagcaattctcctgcctcagcctctggagtagctagactacagacgtgcaccaccacgcccagctaatttttgtatttttagtagaaacggggtttcaccatattggccaggatggtctcaatctcttgacctagtgatccacctgcctcggcctcccaaagtgctgggattacaggcatgagccactgtgtctggccacaaaatgatttttaaaaggagttcagatgatcagaaatggggttgaaagacaaacgtaggacccttgttatgtgtggtcttggcttattcagttgtttattctatttctcctgccccttttagagagatacgttgttagggtttttggcactgttattaatatgaaatatttctacaaatagaagataaatgtacatcctacagcagttgcttgagttgtttacacacatgaattagataagtttatttttagattttcttttcttctgttttctccattctgttttctcctcttcagtccccttaaccctgccctagagcagaccctcctcatctgttctgggacttttccaatagcctgtactttatgaaggactattcattagtccatattgttctttgatgtggcaggcttccagaagtctctcagccctaggggaattgttcatagtctcaggcaactctggatcttttttggcagaaatgtgtatattttttatctgctaattatagagcctgaatgtcctcctctctgttgaccttcttagttttcctttgaattggtatcctttgtgttgcagatgtcatctttcttgaagagtgcttgattatgtgtatttaactgaaaatcgaataaatctctaaatattgtaaaatatgctcttcaaaataacctgcattttggaattggtatggataaagtcagttttagaatcactaaagtcagacagaaacctattgtaatgtgaaagacgaggtggatcaaatacttgctgttccagggtcatggaaggaaaaaaattgcagttcatgttcttcttataattaagcttcagaagttcttcacaatagcagtgtctgaggactgcttttgtgagcaggtagtaccagttgttgagacattgttgagagagcacatgaattgtctcaaactagttagttgggtcaagggaaagataaaatgaagggtgaatgagtctttctattgtactctgaggcatgacagcgtgttccacttttgagcttttatcaagatgggacttgtctagacttctaatgaaatgggcttcaggtaaagtagaaacattatgtcaagaggatttttggttgttcaaatgaatgttaaacattcttttaactctttggatcttagatagatttgatagttgtgatacctttactgtatgtaacacatgatcctgtcctgaatgatcagcagctttcaggagttactcttgtattcccagctacatttgtgatactttcagtgctaagaaaatctatattctgtagctttgaagttatttaacagttaagtactatttgctggtttattctgattttgtcttaaatgacaaatattttattcatcctttctcttcaaacattatttaacaaatgtacgttttaatgtttctcaaaaatgaaggtctatattctttttatatgttttatctttgtatgttatttctttcatctttttttttttttttttttttctgagacagggtctcactctgttacccaggctggagtgcagtggtttgatcatggctcactgcagcctcgacctcccgggctcaagtgatccttgatcctcccacctcagcctcctgagtaactgggactacaggtgtgcaccaccttgtctggctaatttttttttttcttttttttgagacagtcttactctgttgcccaggctggagtgcagccgtgtaatcatggttcactgcagccttgaccttcccaggctcaaatgatccatcctcccacctcagccccccaagtagcttggactacaggcacacaccactacacccagctaatttttgtattttttgtagagatagggtttcgccacgttgcccaggctggtcttgaacgcctgagctcaagcagttcacacacctcggcctcccaaagtactggggttataggcgtgagccaccgtgctcagccttttatttttaatatataagaaatgccttttttttttttttttttttaatttgagatggagtcttgctgtcttgcccaggctggagtgtagtggcatggtctcggctcactgcaacctccgcctcccaggttaaagcaattctcctgtcttggcctcccgagtagctgggattacaggcatgtgccaccactcctggctaatttttttgtatttttagtagagacgggggtttcaccatattggccaggctggtctcgaactcctgaccttgtgatctgcccacctcggcctcccaaagtgctgggattagaggcatgccccaccacgcccagcccattgttttatcatgacagtagcaatgtgttttaattgtaaaattcttgactttttgttttgtttataaacttccttttcttggccctgtgccttaaactacagtagattaggtgaaactgttctctgatcacactagcatttaaaatatgaacctgaatcttctcaggtactttgatctctccaatctattaatgtttctgagtacataaacatcaattagctcaccaaattaaagttagcaaatgcgtcagccatgtaatttgcatgtgacattttgagttagcagggccaagagggaagtatgtttttgtgagtgggtgtgcttatctctctgtcttcaggtggtgatggaaagttgtacatgtaagagaaggagttgtggcagtggatatgtgaaatgctaactgtacatatgcctctgcttggggcagaagcactttaccagagaagtctccaacagttgcaaactacatattctttttccttatataagtgaatcttttaattagtgtaatattatgtagagtgtatgttttttctgtttttttttaatgaaaggtgatattttgataaatctgcaaaatgagcaatatagacaacattttagagtgaatgatactagatttaaactatgaggctggtctctgcaaagatacaaagtaaatactaatcactggtctaagcaaaatccaggaaggatttttgttaatttgacaagtgggtttagaattctttagccactattttttagaaaccagctttgttcatacatcctttctctaatttgcctcacttttgatctgtgataaaccagctgcaatttggtttcattaacaaacttaactggtcaacagatgttttggctctattttgtcctttctattagaaacagcataggcgtacacagaaaccatgctgggccttttcctgtctgtagctcgacaggcgttacagaagagcaacctaactttacttacaagttcaatttttcttcctcagtatttttattataggtatacaaacattgtagttttgtctcccccatcaagtcggtcttttgttgttaatcttccatctgttagtccagtatacacttctcaccctgctttttagcattgcaaaatcttagcatgcagggaaaaaggtactattgcaggagaggtaattgagatatcagcgactcttccacaattcaagggaaggagtggaactagcctggtgaatttagataatttcttccgtcttctttgatgtcagtgagctgccatatggagagcagtgaggcctgcaggaaggaggtgagccttggtctgggctgcctagggtgttcagagtgacatgggctgagagccagaggcagagcttgactgtttctgttagtagtttctgatgtgaccagccctgctttttgtccaaggtttccctgtcatgcttgccaccctatgggtatgatgaagtttaagaaacagatcataaacattatcttgggaaagagaaacataagaacatattaaaatctagtaataaggccattaaaagatgactcccatttgatatttgaccaacttgttttcaaaattagtattgtaaacacttctgtcttataacaaaacccagctttagctgttgagccttgagttgtgagtaaagcagcagaaaacaggatctgctagtggaagagtattggctgtttgaagaacatcagctgttccaggtagactcctggcagtgtgtgagcagacctgggaaaggcaggcatggagggagctaggaaaatacttctctcctaacctttataatttataaaattagagtatttcataaatattaaaagagtagtacagtaaacactctatttctttcacatagattcaccaattttaacattttgccacattctttctcttcctatatgtgtgtatatgtatatgtttttatacatgggtgtgcgtatatatacagcacatttatatattcacaattttgactaaactgttggaaactaaattacaaatattatatttcacccctaaatacttaataatatatcaaaaatgttctcttatatactatactattacgcaaaaaattcggcagtggaatgagtgttaactgacagtccatatttccccaaatggccccaaaatctcatttataacttttgactttttttgagatggagtctcgctctgttgcccaggctggggtgcagtggtatgatcttagctcactgcaacctccacctcccaggttcaagcaattctcttgcctcagcctcccgagcagctgggactacaggtgcgtgccaccatgcccggctaactttttttatttttagtagtgatggggtttcgccaggttggccaggctggtcttgaactcctgacatcaggtgatctacccgcctaggcctcccaaagtgctgggattaaaggtgtgagccactgcgcctggccaacttttgacttttcatccaggatccaaccaaagatcatatattgcatttggctgtcatgtcacctttaatagagaacagttttccctcctttttgcttctgaagacattgacatttttgaagagtctagggtagttgtcttgtaggatgtcccacaattagtatttgtctgactgtatcctcatgattagattcagagtaaacatttttgacaagaatagcgtgtgggggtctgggagtggtggctcacacctataatcccagcactttgggaggctaagatgggtggactgattgagctcagaagtttgagaccagcctgggaaacatggtgaaaccccgtttctacagaaaatacaaaaaaatcagctgggcgtggtggcatgtgcctgtagtcccagctacttgggagactgaggtagaaggattgcttgaatccaggagatggaggttgcagtaagccaaggtcacaccactgcgctccagcctgggtgacagagtgagactctgtctcaaaaagaaaaaagaaaagaaaaaatactgtatgggggatgttgtatatttcttcttgtgagataccaggagataaataatttcagcttgtctcattactggtggtgcttagtttatcagttggttaaggtggcatctgctagatcttcgtttataaaggcgccttttcccttttgtaattaacaagtaatctgtgcaatgatactttgaaagcatgtgagtaacctttcacccagtgtgtattagttttctattgctgctgtaacaaattacagcaacttaatggtttaacacaacacaaatgtattgtcttacagttcggtaggtcagaagtccaacatgggtttcttaggttaaaatgaaggtgagggcaaggtaatgttcttttctggaggctctaggagagaatcttttcccttgcttttttgagcttctagaggctgcgcatattccttgactcatgatcccttcctccatcttcaaagccagcaatgttgcatctctctgactgttctttcacagtcacatctgcctcttaccacagcctggacagtttttcagcttttaaaggatgcatattattagattgagcccatttggataatccagataatgcccttatctcacagtccttaactttatcatatctgcaaggttattttgccaggtaaggttctgggcattaggaagtagacatttttgggggagcccattattttgcctgccacacagggtttagtattgtcacctaaatcaaattttgcattgggggttgcaaatcattgaaggttttgggctatggtgaaccatgatcaagtctgtttagaaaggaaagagggccaggtgcaggtagctcacatctataatcccaatgctttgggaggccaaggcaggtggatcacttgaggccaggagtttgagatcagcctggacaacatagtgagatcccatctctagaaaaaatttttaaaaattatccaagtgtgatggcacagaactgtagtcctaactacttgggaggctgaggtgggaggattgcctgagtccagaagtttgaggctgtaagtgagctatgatcgtgccactgcactctagcctgggcgactgagcaggactctatttcttaattaaaaaaaaaaaggaaaaaataaccagaaaggaattaatcacagtttatgggagtaatgctagctgaaggccgggggtcaagaggcctgagttttgagtctcatggtacatcctgagtcatttccaggagagcaggaacgggggctgcctcttgcctccacttcatgtccctttactcactagttgaagaactgaagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagatggatgtatattatattcttttagtttttagtaaaaattcagaaaaataaacatgaacttgaggtaacgagcctctagaattcttcattttatttcatttcacaatgtttcagcagtcttctgcagttagttggaaggttttggaaattctgactaatccagttgttgaagaataactagttagcttaataaatatgttttctagagctgataaaaaagatgattttttcatctgatgagctctgaccctctataaaccttctaacttaactcattttccaccagctacagaaatgtaacaagatgccaacaattacatcctcatggagcatgtatactagcttataaaatcacccctttgttggaaaattgtgtaatatcttgatttcaatttagcatggcatgttggttagcagtaaatcttgctagtgtatgaacacaagcctgcaggcagtttggagaacattgatcaggtgtaaattgtatgtatttttctcgcttctaaaaattttatagcagaatgaaataaagagctagcattgagaacactttttcagttgttttttattttttatttttatttatttttattatactttaagttctagggaacatgtgcacaagtgcaagtttgttacatatatatacatgtgccatgctggtttgtaggttgttttttattttgacatgtatcttgtggaaagtgccttctctctcctgaaatccatgatttgtgtctctgaccacttaggttccccatttagtatgtgacacatagcaaaagcaaacaagcatagttaaaacgtgtatttgtgccttgtgaaatgtgcattataagcagttaatactagatttgaaggctgtacaaaaaacatgcaaaaagatattaatattaaatacttagtgcttattgtgtatattaagcatttaatatatacaatataattttgcatgaactctgaaagataagtactgttattaactgaattttacagatgaagaaacaggccaaataaggtgacttgcccaagagtacacaggaagtattggagctggtgtttcaatcctggtgcacaggcagagtgtagtgtagtcactttatcaccttctgcctctcatttcttcgggcgaaatcaacacatacctagtgaattcttgcaatatataaaacactgtattaggcacataatatggaagttaccacatatctaaatggtaataaaagtgatcagttgaggctaggcatggtggctcacgcctgtaaccccagcactttgggaggccaaggcaggaggatcacttgaggccaggagttcgagaccagcctgggaaacatgacaaaaccccatctgtaccaaaaatacaaaaattagctgggccaggcgcagtggctcacacctgtaatcctagcactttgggaggctgaggcgagtggatcacctgaggtcaggagttcgagaccagcctgaccaacatggagaaaccccgtctctactaaaaatgcaaaattagccgggcgtggtggcacatgcctgtaatcccagctactcgggaggctgaggcgggagaatcacttgaacccgggaggtggaggttgcgggagctgagatcgtgccattgcactccatcctgggcaacaagagtgaacctccgtctcaaaaaaaaaaaaaacattagccgggtgtggtgacacacacctgtaatcccaactcctcaggaggctgaggcaggagaatcacttgaatgccggaggccgaaggtgcagtgagcagagatcacaccactgcattccagcttgggtgacagagcgagactctgtctcaaaggtaaaaaaaaagaaacatgctaatacatacagctgttattccttttcaaacgatcattggagtgatcatcacttttagagcaattgaaattttaagaatgaataataacaaccaacatttataaaatgctttactatgaggcaggcactacttcaagtgctttgtgtataacctgtttgtaaggtaggactattcattcttcgtttacaaaggaagaagctgaggcatgtcaggtgaaaggacttgcccaagattacctagctattaatgtggtagagctggagccaggatttagacccaggcatccaagctccttgatctgtacatgtaaccattatactacattacctctcattttcctgatgaagaaaacttcttttaatgagaaggtattgaaaatagtttcatattaggttcttataaacatgagcctttaagtgcctttttactgtttataatagacgtcactgagaagattgttaaaatttataatatgatatcattaaagtagcttttcccaaatgatgttctgaggaagaaggaagtactctacaagaaattaatgatgctaataatagtctgagatttacagtacctgagtagttctaaaatttaccttgcctaacccaagatgatttgacgatgggcctctctcctctttgtcttcatagcagccattcacttgtctagaaatctttgcatttggttaagcagtttggatagtgctgatgtaaggttatagtgctaattcctttgcttatttcttctaaatacacatcccaagggaaaccattgattaattaaacttggagtttgtccttcagaatagaaaaccaaaaatcatcaaattcaccccttgtctctattaatgtattgatttagtaatatttatgtaattctttaaatgtagtataaaactttagagttgcaggagatctttgagatcaccaagtccagggttttaaggctaaggttcaaggagcccttttttctggggtttgtagacctctgaaattatatgcaaaaagagtatttttctggagcttcttgcccctcctctccttcagcaggtcatttgacctaggccagtggttcccaaactttgctgcacattagaattactggaggagcttttaaacgttagatgcccagatcacacctccatgctgcttaaataaaaatgttggagtgggagtcaggcattagaactttttgaagtttccttgtgatgccagcatgcatcacatgctttcttctttaatagatgaacaagtaggatctacttatgtggctgaggaagcaatctagagatgttaattggtcagggctctgcttcctgctaaaagagattttagagatcgttctgaaggagtcttgtggggaagtggctctggagctagaatgcttaggttcaaatcccaagttttcctcagctgactaatagggatgataatatagcactgaccacactgggatagtcgctgcctgagctacagaggtggtgagcttgtcctcagcctcaacagaaaggtcagctgaacagactccaaggcagtggagggacggcagcccccagcactccactctgccatactgtttgggaaggaaaagctgtaaaccgatgtcctcattaccttctaacgaagacctcctctcctcttgctctcttacgccaagaatggctagaatccgtttctctttgtggctccttccaccccacctcatgttatttaagtaatcagaaaaggagtctattattttcagagtaacacatgctccttgtacagactttgaaaaacagaaagatttggagatgatacattatcactgcaaatttgactataaagataactactgttgaaagtgtgtattttcttccagtcttttttccttttttcctacatgtaaatatgtatgctatatttaaataaaaagaagactgtgtgagctatataattttgtatcttcctttctaaatttaaaatctgttgtgagccttttcccatattcttgattattctttgaagctgactaaatagctgcatagtatttatgtctttatccttcaaaatttaaggtgctcctaaatcttctgctattacaaataataccgctactaaaaatttgtgcatgtgtggataattatttcccatagaatagattactaaaggaggtaatactgaggcatgactatgaattctttttctaaagctttggaagcatattatcaaaaactgttccaaaaagatagtaccaatttatacttatgggcagagtataagggagtgtgggcatctaattgattcttaatgcttaccttttgtcatgttaatgtagtagagggaagaatggatccttaggagttactttgcatttctttgattactaatgacttggacattttaaaatgattaatggccattgctaaataacagtgttgtggttatttccccatccttattcctatgccctgcagataagcatcttcaactctttcaaccacatttagtctggcttcttagggaagttggaggtctgtaatattcttacgctgttgtttcttatttttaaattgtagacattatctgttgacttcttgcgagtgtagataaggataaaggtccctcatacacatacacttttctctttccctttgcccctcttatctcaatatacactacttttatgtaggtaagtatatgtattcagtgcttatatttttatgagtttgtaaatattattcacacttgagccatcaaaattttttgttgttgtttttttgagacagggtctctctctttcagccaggctggagtgcagtggcgcgatctcagcccactgcaacctccacctcctgggttcaagtgattctcttgcctcagcctccaaagtagctaggactacaggtgcacaccaccatgcccagctaatttttgtattttttgtatttttttgagatggagtctcactgtcgcctaggttggagtgcagtggcgcgatctcggctcactgcaacgctccatctcccaggttcaggcgattctcctgcctcagcctcctgaatagctgggattacaggcgtgctccactacgcccggctaattttgtgttttttagtagagacggggtttcaccatgttggccaggctggtctcgaactcctgacctcaagtctgtataaaaaagcctgtatatgttctgtaaagacgcaaccatccacttttttcccctcaggtattttatttatatatttggagacagggtctttctctgttgcccaggctggtgtgcagtagtgtgatttcagctcactgcaacttccgcctcctgggttcaagtgattcttccccctcagcctcctgagtagctgggattataggcatgggcaccaccccaaccctcgactaccccaggtgttttgaattgaggttagttgactccacacatacagaggtccaactgtatataaagtaaagagtaaaagttttacctcattggccctgtgtgttcttctctgaaaacagctttccaaaggcagccacacttggtggtttgtatgtattcttacagggctttttaaagcacttgtaagctaatattatacctacgtttatgtatttcttgtaacagaaattgggatcggactttggtattttttcttttgaaaagtttttagatatataagacatatatgagtacattcttcttgaaaaagttctaatagcagaaagaaagtgtcacacaaactccctgagtctcacttaccttatctgtaaaatgggaaggattatatattcttcatagggttgttaattagaatttaatgaaattatgcatttaggtggcctaacacagtgcctattcaataacaaaaatgagctagttattttgaacatgtatcagctttggaatttttaatgaagagcattttggcatattactgtatagtttgacagtggtcttttgatttgctcagtcctttttcagggtcttacagaagaaaaggagagtcttacatgttttccttcatagctttgtatgctgtaaatatgagtttagtttaatagcagagtttttctttcttttttgaattaattatttggattgcttcctctctactgccttcaagccaaaagctcagagtttcccaaaccaaagtgtgcctcaatcacaatttttaccagttttatacaatctgtattaattattttatcttttttttttttttgagatggagtcttactctgtcacccaggctggagtgcagtggcacaatctcagcttactgtaatctccacctcccaggctcaagcgattctcctggctcagtctcccaagtagctgagattacaggcgtgcaccaccacgcctggctaatttttatatttttagtagagagggagtttcactgtgttgcccaggctggtcttgaactgctgaccttaagtgatcctcgtgccttggcctcccacaagtgctgggtttacaggcatgagccactgcacccagcccctgtattattttcttaatacttgctttcacattaccgcactaaagaggcataataaccaaatgccgtgcatggaaaacagtacagttgacccttgaacaacacaggtttgtgctgcgctggtcaacttacgtgctgatttttttcaaccaaatctaatacagtattcatggatgcaaaatgcacacatacagagggctgattttttgtctctgtgggttcttcagggccagctgcaggacttgagtatgtgtggattttgttatagtctgaggtcttggaactgatccctcatgtataacaagggatgacaatattaaaaaattacttatttgggggataattggatacatttgaatttggattacatattaagggaacttaatggcattaatgttattgttcttcaatatgataatggcattttgattatctaggatgtctttatgagttgggagatgccttcggaagtatttaatggtgaagtgtcttgatgtttgcagcttactttcaaatggttcagcaaaaatcatactaaaatatgtatgtataaatatatgtgtgaatatagacagatatagataaagatatgaggcaaaagataggacccctaattgttgaatctaggtgaagggcataccagtgttcattatgctacttcaacttttctgtagggctgaaagtttttcaaagtgtaaacttggaaaaataaatgtaattagaatatttacttaaaattaaattgcctcattttctttatcttagtagatttactaaaaaaaaggagtctatatcattattgtaagtggaaaacaagcattccttgccataaatagaagataactgtaaaagttattattttaaaaagtttcagctggatattgttgtctgccaaggctctgagcctgaggcctgctctctcaaaagaagattaacaagcattagaggcgttaaacacaatattagcaccaaaatgagactttcttcttgacttaatgggaaggtatgaaagaaaattgaaaagggaacaagtttctcattctgtgtgattcagctcacctcataacatctcaagtctcacctcaaggcatcttgagtaccactagtgatagaatcccacacttggggaaatactgtatcaggtgatttcagtgtaatgtgttagaatgaaagtaaatttttatattaaatactgtttatagtgcccattatgtcttttttaaaccttgtatgttggtttatcatcatcattattattatttggtagtctcgataactagagctagctgcatggttagctgcgtgatgtcctggcttagggcagatgtcagatattgcagtctaaattattattggggtatacttattctattttatgatatgcagtgttgcctgactctcgaagcataataaagccaattgagatctttaaaaaattaattattattgatttcttactctgaagttgctcttgtagtgggtttttgctatatatattttttctttccttctttttttcttgctacattgttcctgctgttatttggaaggcactaggacattttgcctcttgaacaatgaaaggatccagatcgtgtctgtctcacattttgttatcccagtacaagactcaattgaataaaacatattacccatctggcctggaaatctcagtggcactcaaaataacttactaacaagttgttggatcatgatatcttgagattttctgaaagttcagcttctttttagctgttgctaagagagaaatttcattgacatgagggacacgaggacatgtctgcacactgccagttgttttagaggcatttggctctgccgccttgcagatggttagactctgggtggtgggtgaatgtatgctgattatcttattgaattaaggtaaccttttgtcattcattgaattctgcagaccagttggtcagtgagcagctgctccatgtggcttggtttgggttttgaagtacacaaaaactatcttaaagggtggtcagtctaatccaggtattcaacaaagcaatattgaaagccttcttccccttttgacactgttttctgttctgatggaagtgaatgagcaaaaatatttttactttttgctcaattaactaaatgattgaagcaaaggtttatggaatggccgaataagaattttttaacctagtgctttaagttgaagaaaatacactttcataatatttggtgtcagaaacattctacttttatggcatggtcttatgtttgaagatacgtggtagagtttttaaagtttatttttacaaatatctagaaactaaaaagcattcttttttatcatgcatgcttaataacatcatcttgacaaatactagctgcataacttttggtttgtagggttgttttaagatcagttttttgtttgtttattatattttaagagacggtgtccctgtcttgcccaggctcgtcttgaactcctgagctcaagcaatcctcctgcttcagcttcccaaataactggaataaatctgccatattttttctatatggcttccatttcagtttctagaaactctttcaggaggcttcattttaaataaagaggttcttaattgtttttagtaaattgctgaaattgtatggctcatttctcttctcagagatttttatcttgagctgatccttttggttttactgaaggtgcaatataggtaacctcagagaaagtgactttagccactagttgatttgcttattgtcagagagaaatcatttaacagtgattgatgaggaactgtttaatttctccagtttagtcacctgttgggccctagagcctttcgattcagagctcactgtttcatttgcatttatatcctagtaactatcataatgtctaccagtatttattaagcacatattctgtgctgggtgtcgccgtttatatatgctctttcattttgtcctcaccacaactttatgaggcaggtcttgttagctccatgttagagatgatacagcagcctcccagggatgttcattcacttgtctggtatcatgcagatagttaatggctgggccatattggagtccagggccttcagactctcaggctcatgctcccttctgccctgctgctgttttaatgaaaatcagccttgttctgaaccacagttttacaatgaagcttaagattaaactgaaaatgctcaagttctctgttagggcttcagattctatgtctatacttgtcttattaatggtaaaaataatgtaacaacattaaagaaaaattttgaagggtgaaacactgtttagactcttgccaccttaatacaaccgttttgtttttgcttatttccttccagatttgtttatgcgcgtgtcctttcacacaactataatcaaagcatatatacagctatgcagttttttttttaaacatagtgttattttatacatattttctttttaaatgttcttttttgtttttgagatggagtctcactctgttgcccacccagactggagtgcagcggtgcgatctcccctcagtgcaacctctgtctcctgagttcaggtgattctcctgcttcagcctcccttgtagctgggattggccatgcctggctaatttttgtatttttagtagatacagggtttcgccatgttggccaggctggtctcgaactcctggcctcaagcaatctgcctgcctgggcctcccaaagtgctgagattacaggcgtgagccaccacgcctggctttaaatgttgttctttaaaaagacttttcccacctctttgaatttcccaatctcaacgaggtcccttttataattcgaacaaaggaccatatgctttttcttattagcctttattatagtctaattatgtatttatttgtctggctattttgtaacttaagttgtcccctctaaatggaaaagcttcatgaagacagggaccttatttctgctgtatggatgcaagcagttatttattaactaagattaagcttctgtttatctgttacctcatctgtcagaaacagttggacagattttcaccaaacttagaaggtttttgaagggcatctgtggtgatcaggagacacatgacatatattttctgatcctgtgtctgagataacatacagagatttcaaacatgagacctggctgggtgcagtggctcatgcctataatcacagcaatttgggaggctgaggcaggaggatcagttgagtccgggagtttgagaacagcttgggcaacttagcgagaccccacctctacaaaaatacaaaaattagacaggtgtgatggcatgcccctgtagtcccagcgacttgggggtgctgaggcaggaggatcaatcacttgagcctgggaggttgagtctgttgagtctgcagtgagccatgatcacaccactgcattccagcctgggagacagaacaagactctgtctcaaaagacaaaaaaccccacgaaaaaccaaatatgagaccatgagacctatattgaagggcccaagggcagattgtcaagatggcagaccttggtttgcactttagagttgggtagcttcttaacttgggctgttccacatcttaatctaggatgagcagcaacaaggatgtctttatttaataatgaccaacaagtctcccagtcacatactgactaatttcaaataaatgcatttgatcttttcattttcattttgcttgtttaaatataaattgtctattgaaagagtttttttttctttttgagacagagttttgctcttgctgtccaggctggagtgcaatggtggatcttggctcattgcagcctccgcctcctgggttcaggcgattctcctgcctcagcctcctgagtagctgggattacaggcatgcgccaccacgcccagctaattttgtatttttagtagagacggggttttccatgttggtcaggctggcctcaaactcctcacctcaggtgatctgcctgcctcggcctcccaaattgctgggatgacagatgtgagccaccatgcctggcgtttttttgtttttttttttgatatggagtcttactctgtcacccaggctggagtgctatggcacgatctcggctcactgcaacctctgcctcccgggttcaagtaattctcctgcctcagcctcccaagtagctgggattacaggtgcccagcaccacgcccaactaatttttttgtgtgtttttagtagagacggggttccaccatgttggccgggctggtctcaaactcctgacctcacgtgatccacctgcctgcctcagcctcccaaagtgctgggatgacaggtgtgagccaccaagcctggcctttttttttttttttttttttttttgatatggagtcttactctgtcacccaggctggagtgctatggtgccatctcagctcactgcaagccctgccttctgggtccaagtgattctcctgcctcaacctcccaagtaactgggattacaggcacacaccgtcatacccggctgatttttgtatttttagtagagatggggtttcaccatgttggccagactggtctcgaactcctgacctcaagtgatccacctgccttggcttcccaaagtgttgggattacaggcgtgagccaccatgcctagccctcatatggtttatgagtacttaagacatgtttgattcaatttaaaaaataattacaagctgggcatggtggctaatgcctataatcccagcacttagggaggctaagacaggaggattgcttgagcccaggagtttgaaagcagcctgagcaatatagagatactctgtctctacaagaaatttaagaataggctgcaacactcactctaaggggagcattgtgaggtataccaagatgagtaagaacaatatggtttagcatgccagaacaaggaagtttcaggtgctagaaacacagacatcctcagctcaaacaggaacgcccagaacagtatacaagaaagcctggagctggagtcagaagactggctcccatgtgtggtgtcctaactctctctagacctcaatttcctcatatgtttaataaggataacaacctactcttcagcccacctgagaggacaggatgcttcaagaaagacagtgagcagcaggtcctttaaaaatcaaaggaaaacaggctcctggataggtgtgagatagaagtgaattatggcacatacgagagcaacaataaattatcctttactaacagtaacctaagggaaatgcccggcattgtgtctggcacagactagatactcagtagttcccttctcacacttgctcagccctgtttgaacccagacagagagcagctcaaaatatgcaagtattacatactcacagaacctggagacaagagaagcggcttctaggcacatgggctcccatccttgcagcagctggtatagaggttgcatgacaacttgtgaggattctgcagtagcgtgggctcagctacatgacctaaataaaggtctctttcaaccctgagattctgtaagtttctttttctttagacagagtctcactctgtcacccaggctggagtgcagtgacacgatctcggctcagcgcaacctctgcctccaaggctcaagtgatccttccacctcagcctcccgagtaggtgggactacagttgtgtaccaccatggctggcaaagttttaaagtttttttgtagtgacagggtctcactatgttacccaggctgattttgaactcctaagctcaagcgatcctcccacctcaggctcctgagtagctgggactacagtcttgtgccaccactcctggctaattaattttttttttttttgtagagagggggttctgctatgttgcccaggctgggtgaactcctgggttcaagtgatcctcccactttggtcttccaaagtgttggggttacaggcatgagccactgtacctgtcttagtttatgttttaaagtcatcgagagacatgaaaactaaatggtcctaggttggaggaagaaaacttactgtaaaggacagtattggggaaaactggcaaatttggaatatgtactgactgttagatgatactcttatatcaatgttaagtgtcctaagtctgataatacattatggaaatgaagagaatgaccttgttcttaagcggggtgaatgatcatggtctttacaacttattctcaaatgattcacaaaagagagataaagcaaaagtggccagttttaaagggcatatgggtgtttattgaattattcctgcaacttttctataggtttgaaattttttcaaaataaaacttttttgcccaggcatggtggctcacggctataatttcagtgctttgggaggctgaggtggaagtatcgcttgaggccaggaattggagaccagcctgggcaacatagagagatcccatctctacaaaaaatgaaaaaaaaaaaaagccagatgtgatggcatgtgcctgtggttccagctgctcaggaggctgaggcaggaggatcgcttgagcccaggaatacaaggctgcagtgagctatgatcatgccactgcactttagtctgagcagcagcaaaataaataaataaataaataaataaataaaataaaactttttaaaggtcaccgaggctgctgtgtggccaggggagctatagaggagcaagggtagaggagggcaagcctgggaggaggcctttgtgaggatggaggcatagactggggttttgacagtggggatggagagatgaggacagatctgaaatatgttttgaagaacatatttaacagaacttgctcatggattggaagagattttaggggagagagagggaggtagatgttccccacttggtgcaccctgatggttgcagactgaattccaatagaatcttctccccaaggtctttttattccctctctcttttcctcaattcagccactctatgagtagttaatacaggtatttatttcacagatgaggtgagactcagggagatgaaatgactcatttagagttatcaggtgcagacagaaattttactctacccagaaaaccaaaatataggcatgaaatcagtgttcttcaaactgaattgtctctcattaattgattgtgaaatcaacataatgagttcctatcagcattaaagaaaaaaaaaagagaaacagaataaaaatatagcatgccttgtgtaaaagggtaagtaatgtttcatgaaacttctattttagtttaatattcacatatgtgtatagtaggtcatgatgtgaacgtatttcttacttgaagttatgaaaaattggaaaggcacatacaggatcattgtagaaggaacttatgttatcacagaggtcctgtagtccccatgggaataagaaagcaaaagacaaattcacttgggtggttactgtaggttgtcatatgttgtttatttcttcagtgactgataggctgtaagtctgtcagtttcttagttgttttcttagttgatttttcttttcttttcttttctttttccgagacagagtcttgctctgtcgctcaggctggagtgcagtggcgcaatctcggcacactgcaacctctgcctcctagttcaagggattctcctgcctcagtctcccgagtagccaggattacagccatgcgccaccacacccagctaattttttgtagttttagtagagacagggtttctaccatgttggccaggctggtctcaaactcctgacctcaagtgatccacctgcctcggcctcccaaagtgctgggattataagcgtgagccaccatgcccagcctttcttagttgatttcatagtcatcctgtacttccagtcttgccattagcaaatattgagtacttgctgtgtgcagggttagaagttacttctttgtgtgagatctatgttttgtgtgtgggtggtgtgtgtggggtgtgtgtgtgtgtgtatgtgtgtgtgtgtttgtgtgtttaaaagtagacttttttttgaagagcaattttagatttacagcaaaattgagtggaaggggcagagatttctcatgtactccctacccctacacatgcacaattttccccattatcaacctcccccaccagaatggttgttacatctgatgacacattgtaattgcacagccttatcacccaaagcccatagtttacattagggtttactcctggtgttgtatattctatgggtgtgagatacatgtttaaaaatattttgtattagataaattggggataatagtcatttcaagaacaaaatgttggataaattaaattagctaataaacacagagtgctttaaacattcctagtgcaaaataagatcttgttgtttgtggtggtggtggctattcaggcttaaggtctagattccacttagtatgtaagtaaataatagcaatcctggctgtcatctgtatgtgtaatgtagtaatcagttttgtttagctagttcttatgtgtagcacattaaagcaatcttgaatagtgaggggacctcattactagattaccattaaatggtaatgttaagtgaccctgaaaccaaagtaatggaaaattgtcttcctttttttctttttttttttttttcccttgagatggagtcttgcactgtcacccaggctggagtgcagtggctcatggcaacctccacttcttgggttcacgagattctcctgcctcagccacccaagtagctgggattacagatgtacgccaccacacccggctaatttttgtatttttagtagagatgaggtttcaccatgccggccaggctgatctcgaactcctgagctcaagtgacctgcccacctcagcctcccagagtgctgggattacaggcatgagccactgtgcccagcctgtcttcctttttctcaaacatttaatttgctgtttcttgatcacatatcatccttctttcctttcaaggtcaggggagataattttttactgtatgtactgctgcatcttcacacaaattatcatctgaaaagccttctcagatttgacaaatgaagtctcttttcattcccaggaggaacttgttaaaccaatgaagttcaaaattctaattcctgttcctttctagtgtgcaccactttattcatcttgaataaacatacaacctcaagcatcctacaaggcaaatagattcctttttaattagtggctctatacacagagttttatcatcatgaaatttataaaccaggaagggaacaaatatttacacttgcaacttcatgtcaacattgcctactatttgaagagctctgaaattgtaaatgtatcaccccctccttcttcccccactccccacccctgccggcttttaaactatggcagtagaaaaataggtttcaactttctaggagcacatctctcctatgtggggaatgtggcagattctttatataagtgctctttctttgtgactggcattacttttttttctcacaaagatttgtttcagaagctaatcttcatttttttggttgttgctttttgtagtactatttctaaggcatctccaagtagaaaggcaaaattttattttgagaagttactgctttcatagttacacagaattatttctcaatttaagtaggccttttattccaggacaaaattaagccagtcagaaggtttctgggagaaaaataatgaagagctgaggttttgtatgttaatgtgggcagtctaatgcttgataaaagaaaacttttggctgggtgtggtggctcatgcctgtaatcccagcactttgggaggccgaggtggtcggatcacctgaggtcaggagtttgacaccagcctggccaacatggtgaaactccatctctactaaaaatacaaaattagctgggcatggtggcgcatgcgtgtagtctcagctactcgggaggctgaggcaggagaatcgcttgaacctgggagactgaggctgcagtgagctcagatcgcaccattgcactccagcctgagtgacagagtgagactccatctcaaaaataaaataaataaaataaagaaaactttttttttgtttgtttggcccttgtcagggacagattccgtctcagaaaagtctcgctctgttgctcaggctggagcgcaatggtgcaatctcggctcactgcaacctctacctgccggttcaagcgattctcctgcctcagccttcccagtagctgggattacaggcatgcgccaccacgcctggctaatttttgtatttttagtggagacagggtttcaccatgttggccaggctggtgtcaaactcctgacctcagataatctgcccacctccgtctcccaaagtgctgggattacaggcatgagccaccacacccagccaagaaaacttttaaagatgtgtaaatatgcagtgatttaaaaatctcagttgaagcttgttaaaatgtatcaaaataatttaggaaaaggggggctgattttgccaaaatttgggagatgcatactttttttcaaggctttactgcagttttaaaaaatattttattgttttgtaggcagcttctgaaccagagtaggctcagagactccctttattgcagttttgatgctgcagaaagtgactgcttaatttcagctgttgaggatgttggttatactatgcctggatcaaaaaaatgattttacattgcttagtttgttaaaatatgtttaataggttaatctttttttcaaagcatcaaaaataattaagatgaaatatcagataaaccctatgtctagaatgaataatttagttctaaacatcctggatgctaaggagaaaagaacaagatgttggtttataaaattcttattgtcaaataaagaagcatagaagtttgaagaaagataatttttttgtttttattttttctctctgaatttaggagtaatttatgtttgggttctaatcctatgttatcatcaaagagtaataacattggcaatcttccctcccattctgcttcatcctccccactaaagggaaataccagattgtaaaagaaaaaaaaaaagcatgctggttgtataaaaagaaacattttaaacaaataagaaatatatatattgaaatgcagtctccctgaatgatgctaaacccctgtccaagtaggcatttctcagcccacagaaagggatggcattaaatcacagctcaatggagacatttttatgaggagctgtgatggtttgtgtttagcaaacatgtattgggcatctcagatttgcctgttagggatgcaacagtgagtgagatactatttgttcccttaagaaactcaaagaggaaaggggttgacttgttcagtcagtgacttatgaaatatttcatactcattcatttacagagtactttttgtaggtatagtacagcgtggtcagccagggagactatagtgggtgcattagtaactaaccatacaactaatgctaatgttgcgggctgactgggtttggggtgaacaaatgacccctaaagctcaggagttctagaccagcctgggcaacacagtgaaaccctgtctctactaaaatacaaaaaattagccgggtatggtagcatgtgcctgtaatcccagctactcgggaggctgaggcaggagaatcacttgaacccgggaggtggaggttgcagtgagccaagatggtgccgctgcactccagtctgggtgacagagcaagactccatctcaaaaaaaaaaaaaaaaaaaagacatttgttttggctggggaaggctttgcagagggaggtaacttctagattgagatttgaagtcagagtccatccagaaagtagggaagacattttatgtagagaagtaacaagctacagggatcagaggtatgaaccagggtgcatgtttgggttatggtgagtggtgtctggccaaactgtgtggctcagggtctttctgcttcaccatctttagcatagaagccttccttgtgctcacttgctcatctcattctcacaaaatagctgcttcatatctaggcaccatctctctattcccacaggggaaagagggaaagtgccaagggtaacagcggaaacgtcttcctttttattcaggaaatgagggactccccaaggcttctgcttatatttcattggcttgagctgagccgtacaaccatcactagtggcaggtagtctgggatgtcaagaaagtagcttcccagtctctttggttagaaggcaaaggagaagatggtgggaatcggtttgcatcagtcactctacacattatctgctttgttagggcagcattatcttagtattgttaccaagttcagggtcttttctggggtgatcaagcatcctgggtcgcctgggaccaagtggttttctgggttgtaggactttgagtgctatagcctggaaagccctaggaaaaccaggatggttggccatcctagtctttccccatatcctctgttgtccaaaaatatggaagcaggtcatttcttgacataggagctgccttgactgggcttaaaaaggcctgaaaggcagcttaataatttacaatgagaaataaatgatattggatcaggggaggatactggaagaagagctccatgggatttgcttggtgctcgtgagattttgactgacaagagatcttagggctactatattacccaaattcaggggactctgttcactttgccagcagcctgggattaattctgtagtgctaatgccattctgagaagcctttcaatgaatctgagctcagggttcttagtccccctgttactgaagcttctccccagacagtgtcgtttttgttttttccttcctttctaagcttctggtgctgactagtctccccttctaatggacagtgtttagatacgttattgtctaaaggtagatctggccaggcatggtggctcacacctgtaatcccagcactttgggaggccaaagctggcagatcacctgaggtcaggagtttgagaccagcctggccaacacggtgaaaccccgtctctactaaaaatacaaaaattagctggacatggtgacaggcacctatagctgagatccattgtgagtgccattgcactctagcctgggcgacagagtgagactccatctcaaaaaataataataaaaataaaggtagattaaaaaaaaagagacataatttgcgttatcgtaaaatttacttttttaaagtgtgtaattcagtggtttttagtatgttcacaaagtcattcaccactgtctaattccagaacatttttcttaccccaaaatgaaatcctatacccattagcatcactgcccatttcctgcttcctttagactgtggcaaccactcatctattttctgtctctataactttgcgtattttagacatgtcatataaatggaatcctatggtatgtggccttttttaaaaatcactggcttctttcactgagcataatttttcaagttcttttaagctgtagtatgtatcagtacttcattctttataactgccaaataatagttctttgtatggatataccacattttatttcattcattcattagacattgatggttctactttctggctattatgagtagtagtactatgaacatttgtgtacatatttttgtgtggacacgtttttacttctcttggctgtatacctagcagtggaattgctggtcttcaggtgtgtcttactgatgtttttttttgagatggagttttggtctgtcgcctgggctgaagtgcagtggcgcaatctcggctcactgcaacctccacctcccaggctcaagcaattctcctgcctcagcctcccaagtaactgggattacaggcgcacgccaccatgcccagctaattgttgtatttttagtagagacggggtttcaccatgttggccaggctggtctcgaactcctgggctcaagcaatcctcctgccttggcctcccaaagtgttgggattacaggcgtgagccactgttcctggccttatcttactctctctttttttttttgagacggactctcactctgtcttccatgctggagtgcagtggtgcagtcttggctcactgcaacctccacctcccaggttcaagccattatcctacctcagcctctggagtagctgggactacaggtgcagctaatttttgtcattttagtagagatggggtttcaccatattggtcaggctggtctccatctcctgacctcaggggatccgcctgcctcggcctcccaaagtgctgggattataggtgtgagccactgtgcccaaccatctttaagcctccttaaggaggctgtgtctctaacatgccctgttggttttatagttggactctcactggacagcctcgtttttctaagatttgggggttataaggatcagagttgtccccagttggctcctttcacctcgtccataaggttgttgtgaggcttcactgaggtaatctgtataaagtaaggtgctggcctgtaccctgtacatcactcagtagtggtgatttcactgccctttgcctcctgcctttggcttctggctatctccaaacaccccatgccttctgtgctccaccctctgttgaaacacaggaatctaaaaccattcattgatactttttgagtgattatactgaaaacaattgcatgttgtctcatgcagaattttcgtgttaaaccctgtgttgcaaggatgccattaaccagcacacagatggcggtggagattgattgattgagatggggtttcgctgtgttgcccaggctggagtgcagtggtgtaatcgtagttcactgtaactttgaactcctggactccagtgatcctcctgtgtcagttttccaagtaactgggactacagtctcatgtcactgtgcctggctaatttttaaaattattttatagagctggggtctcgctatgttgcctaggctcttctcaaactcctggcctcaaagcgatcctcctgcctcagcctcccaaagtgttgggattaccagcgtgaaccaccacacttggctggggatggagttttagacaccagaggcttccttccgaggttgacctagaaagcacccttggtgggtgccatgggatgggggaatacagtcaaaaggaacctgctcttcccgctgcgcctccacctgaggtggatgtgtctgctggggctgctggagtctccatcttccactttaacttcacttaagagctgaaagctctgccccttcttcaagattttccctgctgtctccccttccctgctcaaccagagattcctcttattcttcctcttgctattagtattaatctggctcactgactcttttccttaacctcatcctaaaactgtctgatgcatattttatattttcttgcatgtttgacttttagttagtattttacagtaatttcgttctgcagccatcctcttatctgataccctggaactcattcctgtgcctatcagttctcacctctggtaattaaactttgtaaaaaagaaatgtgacatttggacatattctcttattagtaaaggtattattgtgtatgagactaatgctgtgcatctataataagttgtttcaccttgtgaatactaatgtaatttggaaataaacctttctttgttaaagactttttctacatgggccacgtttttccagacctatttcctaataatttgtggtttttaaaggtatgtcaatagagatgctgtagccagcatggctggattctgttagataaacattttgtgagattgcttaccttaaacaattgtctttaaaagttaatttcttccctaatgtgtcagtaaggaaattctatagtatttaagaagcctgataaagtccagttaaaacattttgcattgctctttaaacatcttttctgagggttgatgtgttcgtgtttgtttggttcacatagtttcttctgaattttaagaaagctttgtcagaatcagtaacttgcctatagtgtatttttcatgaccatatggctttcttcatcaaaaacagctaagtaaaaatttcagtgaataatagtatatatatatgggaatgtattcctcatcatttgtatgctcttgagagagtgactcatgtactgttttctattgagttcccgaaagtttataaagagatgacaaacaattggctatgggattgaaataatgcacatgtaaaatggaagggaaaacatggaaacagtttcttcctttgttcttcccttaccttgatgaaatttttaccacttaacgtttttcagtaaagtcaaggtcagtatcagagcctagtacggttctgcttgccgctgtctgaggattacctgtcttattacagaatgtacatgctcccagaggagaagatacagtttgatttcaggatgacaaacagctcttctgggacaatagtgtcaagtataaaaggattataaaggttttaggaccatgggatggtttgaaggggaaagggtgaaatgacagttaaggttggcatcaccgaggtcccagttgttggctgccccctacttctcctgttcccctctggcagtattttacagatgtatttcctttgacctttcctttagtaggaagttgtaggctttaagatccagcagaaaaaaattatgagccatttgtgaccctcttgagcagtccttcaggtagaacacatttcataagagctagtgaatggtcttgggtaattaaagctcactttatgattatacagtgtggtggccagcccagagggaacatcacaaatacacattatgaatgtatagaattgagactttatacctggagactgttggatgacctggtcctctgcccccaggcctacccttctgcccatcctcatccaattctgttttgatttttaaaaagtatgtgcttcttagccctctcattgcttcactgtgaggggaaaaacttttctattgaggtgctgaagctgtgctttccaggactcatacttatgtgctgttgaatgagtctcagtgctcctaggagtctataaaaggaatagaagacttcttttctctaactcccttatggtttgtattttatctgctaagagacactggcatttcatggagatgggagagaaaaagacacagcctacttagacagttcctttattccaacatatatactcacttcacatattcatagacaccttccacctagcatcaaattctgaactcatagaagacttaggtgtttttggttttgtatgcatagcttttgaaatccctgggttgaaaattttctaggtgttgtttgtatgctctagtcaagcccaggacataaagggttatgttaaaattactttccttagtgactattaaccagaaattttatctgtcaggagaaaggattcatgcaactctaagaatgcattgccctctgcataggctattagctttggcaaccgaagatagatgagacttaggctgtgtttaaatttttcattgtgatgagacaaatctattattataaaagccctactttatcagtgagagtgtttccttatgttgttttaattaaaggagcagtgtgtttttaaatttaattatggtaccttgaagatctgatactagctgtaagctaaggattctttgggttttcaagattttttttttggagacggagtttcactctgttgcccaggctggagtgcagtggcgtgatctgggctcactgcaacacctgcttcctggtttcaagtgattcttctgcctcagcctcccaggtagctgggattacaggtgcgggccaccatgcccggctgattttttgtatttttagtagagacaggtttcaccatgttggtcaggctggtctcgaattcctgacctcaaatgatctgccatcttcagcctcccaaaatgctgggattacaggcgtgagctacagtgcccagccagttttcaagatttttaatgcatttggagcagcgctatcctaaagaaccttctttgatgatggaaattttctctatctgcaccatccaatatggtctggtaaccaccagccacatgtggctattgagcacttaaaatgtggctgagactgagaaactaaaattttaattttcttgaaaatgtaaattaattaattaattaatttatttatttatttagagacaaggtcttgctctgttacccaggccggagtgcagtggtgcaatcatagttcactgcagcctcgacctcctgggctcaagtgattctcctgccttagccttctgagtagctgggattacaggcatgtaccaccatacctggctaattaaaaaaaaaaaattttgtagatatggggtctctctatgttgcccaagctggtctggactccaggcctcagcctcccaaaggagaaaatgtaaatttatatagtcgcatgtgattagtggttattgtgttggacagcacagatttagaatctgaggaaactctccatttagtataatgccatctgaagctcttaaccagttgaggctggttaaatctgaagttgatattggataatattgctattaggccaatgagagatttctttaataaagatgcaagtttatcaaacttaaatatgctagatatgaactttgggaaggcaaaaattaaattccagaaataattccaatataattaattgaacaaatatttagaaaatgttatctaggataaagaagtgtagtaaatattgtggaggactcagaggtgagtgggacttaggtgaggctgcctattttgagtcctgctggggaggccttgaaaggtcaaggagaagttcttttttttttttttttgagatggagtcttgctctgtcaccaggctggagtgcagtggcacgatctcagctcactgcaacctctgcctcccaggttcaagcgattctactgcctcagcctcccgagtagctgggactacaggtgcacgccaccacatccagctaattttttgtatttttagtggagacagggtttcaccatgttggccaggatggtcttgatctcttgaccttgtgatcctcccaccttggcctcccaatgtcctgggattacaggtgtgagccactgcgcccggccaggggaagctctttctaagggagtagcttagagcacagaatgccaactgggttatcatcaggctgtaaacagtaggatttcagtttgtgcaagcacgatggttggggctgtaacaggagaagggggagctgtttacatcaggggaacattaggttacatttggctctgacaggcaagattaattttgtctgagagaaggttgaggtgggattggaattttcccaggtatgccctgcgatgttctgctgagtttcatgtgtgttggagcaggcctctcaggccatcacagttctgggagatggactttccaaagattgggaagctggaggcagggacacctggacacagagccttcttcacccccacctgcatcccaggtgaggaggaattcttgaaaatgccgagtttgactcaccaaccaggagtatctaatgtatataaatattcctttaaacgtaagtatagtgatgagtagataagccagagtatttaaaagccacagcaaagattcagcttcctctccgctcccccgtgccccacatctgggaggaccccacctgagcttggtgttatagttggctgatgctcttaggtggaaacccaggggcaaaggacaagccacagaaacataggctgcatctgctcctactctgtacttccaccttacctgcccattaagtgctatgttcttgactaaataattcatgtatcgcagagagggaaggtatgtgttcccaccaacctctgacccatccataacccagtgtattacactgacccaggaaccagagctcacttcaccctgcttggagtcagggaactcggaacctaactgtcctgggccctctttctggtagttgggtgagtcctgagggcctgatacgtgaggtttggacaggctgggcagtaggttatggcatatcttgtaagggagaccatgtcagcagtggggagcagaatgcagaggaatcaaagacctgatctcatagtgcaggtgtgaagggagaagagccagcctttctccaccgtctctctggggacaggggactgtctcgcagggactacaccttggcatttgggcatgtcagaccaggatctagtcatcagagttacccaatgccctggggttggtttctaccaggtcaggggatgcagttctgcaggcagtatgttacatctgagactacaggagagaggggtggggtgacagtctttccatagggtgtccagacactcctggcccagggactgagccatggatagtgggatgcttgcctctctgtgtggcagggctttcgtctctgttttttgtttttgagatggagtcttgctctgttgctcaggctggagtgtagtggcgcaatcttggctcactgcaacctctgcctcctgggttcaagcaattctgcctcagcctcctgagtagctgagattacaggcacatgccaccatgcccagctaatttttgtatttttagtagagatggggttttaccatgttggccaggctggtcctgaactcctgacctcaggtgatccacctgcctcagcctcccaaagtgctgagattacaagtgtgagccaccatgcccagcctggtctctggttttgagccatgatgtcaggctgaccaggctggcacatttagcctggaatgggttaggcttctggctttgatgttaagaaaggaaactagtgccaagtgcagtggctcctgcccataatctcaagactttgggaggctaagccaggaggattgcttgagcctaggagtttgagaccagcctgggcaacatagcaagaccccacctcaaaaaaaaaaaaggtagtttggtgtggggcatgcgcctataattccagtgctttgggctgaggcactttggggagattgagactgcagtaagctatgattgtgccactgcagcccagcctggttgacagagtgagatcctgtctggaaaaaaaaagagaactggctggtccttcctgaaatagtgcccacaggctggcagagcactgactgacacctgcctctttcagaggtggggtcaggatagctgtatggaaattctccaatgtgtgggttgtaggagtgtatctcatatcccttcaagcactgccaggccagaacccagtggagtttgcaaagaatgggtttcttgttagaagaaagtattacgtacatgtaagtaatcttgggtatagctgggaagtgatgaataaatttgaccattaaaagattgtaatgtctgtatcaccaaagacaaaatcacaaatataattaaaaaacaaataacagactaggagaaaatagaccatgtgcaatacacaaaggataaatacagagtatataaagaagcttctgcatattaataagaaaacactagaataaatgggcaaaagatataaaaaggcattgacagaaagggaacaaatggccaataaatacaaagagatgcttaacttcattaataattagtgaattacacattaaagcaactagatatgattttatcccatcagattggcagaaattaaagagaataatattctttggcggcaatgagaaaaaatgggtgtactttcatattctgagcatataaattgttcagacctttttggagaaggtagtttggctgtatctttgaaaataaaatcacatacttttaatttggtaattttgtgtctagtgaaatacacctgaacacatgctcattccagcactggaatggtgaaatattggaatgattaaatgtacagtggtacagccagcatatagaatgcgatacctaaaaagtgtgtaagagtgtggtatagatctttatgcagctgatgtgggaggctctctcagatacgtttttagtgagaaaaaatataaaattattacatttatatttgtaaacctcaaaatttatatgtatttgtaaattctaaaacatgcttttcagattttttaacatttctgaaatcagcgtatctaacaattggtgacatagtttactaatttaaactcttggtgaagcatagtgcacattacaagtgataagatcttagatttgatgaaggatgatatgtaaatacgtggataaaggactctaagacagacatgggacgagattgaggaagtgtcagtggagactttgtctgtgtcatctatgttgtcaaattttttttacagtgaaattatattccattattgtgtaacgaaaaattttaaaaatacatatttatattttttagacaagatataattttagacaagataaggttgcctggatgtctctgatgtctgatccatttctctacttgggtgattatgcttgatattcagctttgagaactttaaggcctggatggttgatagagcgttcagcttcattaagaagttaagtagctgtgaagattcagtgggagagaattgagaactgaggtccaagagaagggaggagccgaactccagaattcagggccagttgcctcatggggacctttgcatctgtgtaaagaggttgaaattctctccccacaaggtggtgccaggctttttatactggactgggcataccctggagcaaggctcagtggatgggaggcagaaaatagatcaaatcaaggagccttatccaatgtcattgaaaggaaaattcattgttttgggagagagctaagccctagtgggaaagagccaaaggaataaatgggcttttaaatctgaggaatttacacaaggcaggcaggagatgacctgccataggttggaggcaggctctgcttggatcctgtgtaaacagggcatagtgtgagtgtctccccataagtaaaagctgtgttgtgaagatgaactcacagtttagtagtgactttttgaccaaagatgactcttcaagaagggataaggtgtatggagtatagctcattgccaggactgtgggaggcagaggaaggagaggacacttggccaagatgccatttgagctggtcactgtaggaaagggagaatttggacatgtaattttttttttttttttaagacagagtctcactctgtcacccaggctggagtgcagtggtgtagtcttggctcaccacaacctctgcctcctgagttcaagtgattctcctgcctcagcctccccagtagctgggactacaggcacatgccagctgcctggctcattttgtatttttagtagagatggggtttcgccatgttgcccaggctagtcttgaactcctgacctcaagtgatctggcctggacatgtaatttttaaggagatattcagaagaaaagggaggtgagcccaccatttacaaatgcacacaggaggccgggtgtggtggctcacacttgtaatcccattactttgggaggctgaggcaggcagattgcttgaggctaggagtttgagaccagcctggccaacaatgcaaaatcccgtccgtactaataatataaaaaattagccgggccactgcactccagcctgagtgacagagcaagactccgtctcaaaacaaacaaacaaacaaacaaaaatacacacaggagaatgtgaggagctgagtagtacagttttctcggagtacacgtctattaaagggaagcagtaggaagtaaaatagaaaaaggtaggctagggccggaccatgaagagctgagaatgccaagtttagaaatttgaccttgagtcagtgaactcatgttttacatttaatcttttggttaccaatttttttttgtaccatcattggtttgatttttaaaatacagtcactttgttttctaaggattttatgatatatgttcaaatcttgagttaaaggtaaatagaacacagtttgggtttttttttggcatataaatggttgaatttcaaaattatatttgtgttacaaactttgtttttactctctgccttccagcatttgcaaataaccatttctctttcaaaggaaattctagtatgtattcccattcaataaaagcaaagagctgagctctatatgaataagaggtaaaattgaacatgaaaattactgagcaagattagtgggggatgaaatggatgaacattggggaaagctgtgatccttgttacctttgctatagtgcaatttggaatggcttctttattcctggcaattcctgacagcatttcttttaaacctggccacctttccattgccagctcgaccttgatgttagctggtgctgctactgcaagggctgcctttggcaggaagccttcagtcaactttctgggctctggttttggctctgcacatgccttgctgagaagaccttaagaatctgaaatgtggagggtcattttggggtagggaaatgtggtggcaactcttgagttttctgccacgatgtaacttaacagatcctcttgtttttccttaaatggtacaagggtttgcaccgaaatggtaattcatctgtgtctgtgatgctttaaaaaataacagtttcactaatgtgtcacaacatgtattatttatcattttagtaaatggatattttaacaagcaacaatttgcaaatttaagcatggcagttaacatgatctgacattaaaaaattaaataatctcctgccatctttgttatcagccttgcattaaggattttagcccttctgggagcttttatttttttgttgactctgactgatgatggcagattgtggtagtgatcagagctatgcttttataaattattttttagttggaacaatattggcatgtaacgtggactggcagaattaacattgtttatcattaccagtgttgttttgacagatattctcagttctttaaggaagcagatagggaatgtctgtaatggacatctgctgtccactataggttgcccaataatgagtcctggtaggttctaccttctgctgtggaagccagcagagttcaaatgggcattttctgttcttgcctcctaggaactgcaggggtggacatgcttcttaggcttagcctgttgactgcttccacctggagtttgaatctgaacagtgttagaaaatgcagggacaggctgagtgtggtggctcacgcctgtaatcccagcactttgggaggacaaggaaggaggatcacttgagcccaggagttcgagaccagcctgggcaaaaaagcaagacccagtctctacacaaagtaaacaaattagccaggcatggtggtgtgcacctgtagtcccagctacttgggaggctgtggtgggaagatcctttgagcctagaagtttggggttgcaatgagctatatttgccccactgcactgcagcctgggggacaaagagagaccctgtctcctataaaggcagcgacagttagtagtggcactagagttactaaaattatcaagattttcttcctggatagtcctggttgcacacatcagtgttactataggtggacttagcctttacttttgtacatttcgcactgatacctctaaccaccttttgtgcacatagcagctattataccccccatagcataaccaacctgtgtaagagaagagtataagtcagttgcttgcaaggaactcttaggggtagggagctcttgcctgggggaggtgggggtttctcctctttctgtcctcccctagtcattagagaaaggcctcaagagaataactcagagattacggttgaattcaagagggtagattgacatctcattgagctgcacagaggtaccagccaggtgctgctgtgggattagaatggactcctgagaaagcgttcttgagtgagtgtggtgtggctttcctggagtttggggatgtctgtgaatacagaggcaagtatcttcctctcatctgaaagccccccatgtggctggagctgcccctggggacagtgtatggagagaggacagcaaaaacgcttgacatttcctgtgggcctggtggtctacatggaggacagctggcctgagtctttttgaaagacttgtcctgcctgcgaaggctgcctgccagggctaggcccgcagcagaaagaggttgtgggtgaaccacagaggcaggagctgagaggagactgagagctgagtcaaagggcacccgttgcctgcatcaggcagcatggaggtcccagcaaaggggtctcactagagagagctggcatgtggactcctgcaaatggtggaagatattttacaggctgcaggactggaccacagaaaagtgggcagacctttccctttcctcacacttgccgcctttcattccttggacccctctctttttcctcactgctgttcttaggggaaaagcttgacattggataaaatgaatttggatttagactaaatagactttttaataactgaaagtttggctttatttaagataatattttctttttaaaacactgtctagaaatcagtgggtttttttttttgttttttgtttttttttaaagacagagtttcgttcttgttgcctaggctggagtgtgatgacgcaatctcagctcactgcaacctccatctctggggttcaagcgattctcctggctcagcctcccgagtagctgggattacaggcatgcaccaccacgcccagctaatttttgtatttttaatagagatggggtttcaccatattggccaggctagtcttgaactcccgatctcaggtgatctgcccacctcagcctcccaaagtgctgggattataggcatgagccaccacgcccagccaaaattagtggttttaatgttactaaatcctgaaatagctttccatgatgacaaaatcaatcaacaatctcaaccccagtagactggagtggattttagaatttagcacactttcccttatttatactctgcaggtttcaagcatacaacttgccagcaattactgtgttggctgagaaatttgaaattttactagcttgaacactaaatttgttgatgtaacatacagctaataataaaggtcacgtccccatattggcatgagggaccccttatgaattagcctgaaactttgcagcctttaatcatatttttctctcttttttcccttgagacggagtctccctctgtcgcccaggctggagtgcaatggcacgatctcggctcgctgcaacttcgcttgccgggttcaagccattctcctgcctcagcctcccaagtagctggaactataggcatgagccaccacgcccagctaattttcgtacttttagtagagacggggtttcaccatgttcaccaggctggtctcgaactcctgacctcaagtgatccacccacctcggcctccccaagtgctaggattataggcatgagccaccgtgctcggccatgttgttatttttggtttgtttgttgattatggtttaaaaaaaccacataacattaaatttaccatctttgccatttttaagtgtgtagtatggtagtgttaactgtatgcaacagttagtgcaacagatctttagagtttttttatcttgtaaaaccgaaactctgtacccaggaagcaattcctgattccctgcttctgccagcctctaccaaccaccattctactttttgttgctaagagtttgattactttcgataactcacatcagtggaataatgcagtatttgtttttttcttactggtttatttcacttagcttaatgtcctcaaggttcatccatgttgtagcatgtgacaagatttccttctttttaaggatgaataatattccattgtatggatagaccacatttgctttatctagttgtctgttggtgaacatttagggtacttctacctttcggctcctgtgaacactactgcagtgaacatgggtaagcaaaaatctctttgagatccttttggctatatacccagaaggggattgctggatcatcattctgtttttaattctttgaggagccgccaaactgttctttatagcagctacgccattttacattcccaccagcagtgcacagagattaccattgcttcatatccttatcaacacttggtttttttttttttgccattttaatgggtctgaggtgatatttcattatggttttgatttgcatttctctaatgattagtgatgttgaacatctttttatatgcttcttgcccatttgtatatcttctttggagaaatgtcttttgaagtgctttgcccattttttaattgcattagtttgttgtttttttgatttgtaggagttatttatatattccgggtattaatgccttatcagatatttggttgaaaatattttctcccattcataagttgccttttcactttgccctttaatcatattattattattattattattatggttaaaacattaattgtgtaatactgaaaagtttaggaaataatatgacagattttgatcaggtcttaaatatcttcccaataggccctatgagtaaggcataaaaagcttgaattaattccatagtttcaccaaaacgctcttcttcttaatcttattccttatttttttgaggcagagtctttctggcccaggcagcctggagtgcagtggtgcaatctcagctcactacaaccttcacttcccgggttcaagcgattctcgtgccccagccacctgcgtagctgggactacaggtgtgagctaccatgcctagctaatttttgtatttttaataaagatgaagtttcaccgtgttggccaggctggtctcgaactcttgggattcgagtgctgggattataggcatgagccaccatgcctggcccttaatcttgttcctatcaatctttccagctttaccttccccagcatgacttcctcttatccccttcctatgtccaaagattccctaaaaatattctagctctgtaccattccacacactgcttttttgttgttgttgttgttgttgtttttttttgcctgaaatatgggatatgtacctttccctcttgtttaaccttgtttttcagactccttctttttcttttcctttaaagactcagcccagatgtgaaaatgttccagtcagccagtcagctgcttttctctcctatagcctcttaggtacagcccaggttagcacacttgtctgaaagtattgtgaggacttttataaaccccctctctccaggaccatatgctgctagatcacctagcttagctttgcctttttattcctctttgtcatgggcctaccataatatctagtccataatatttgtgtactttagttttttatttatttatttatttttgagatggtggtcttactccatcacccaggctggagtacagtggcacgggatctcggctcactgcaacccccgcctcctgggttcaagctattctcctgccttagcctctgagtagccgggactacaggacacgccaccacgcccagctaatttttgtatttttagtagagatggggtttcactattttggccaggctggtctcaaactcctgacctcaagtgatccacctgccttggcctcccaaagtgctgggattacaggcatgagccacaacacccggcctatttgtgtactttaaacgattatgggtagaaagaaagagcaaatgcctttttagaaataagataacagaactttttaccaattgtgcttccaaatatgctttctcttctaattttatctgctaagattttggcagctaattgtagattttatgaacttacattgggttgcctttgtcttctgttataaaagcaataattagaggaaatgatccttttgagaggttgtttaatgaattctgcttgttttaaatgtgctgctttaaatcttatttcacgtaaactgtactaatgcccaaattatctcaccctagatcagcattgaaccaaagtattatgatgattaatttccttctgttaaatcccttatagtcttttctttggtgtgtgtgtggggtcaacaatcaaagaaagaatttattgactttacatttaatatggtttactctacttgattatattgttcaagtgtgaatttgtgtatggtataagattatgccatactgggattctattttctgttaaacaaatagctttgtgttttattaactgccagtgtttaaatttaatggtttaagatttcagagagccctttttgtaagtatttgaaagtttttattataatcctgagcctaaccttcttctggtttcactgcatccttctccagccttgaaacaagccctggcacagacgcaaatcctggcgtgcaccacctcttcctctcccccgctccccactctaacatgacaagaagtgtctgtcccagaagtaatctgattgtgcacctagagtacctgttttctgcctggggaagaatgcacactgctggacctagagcggtggcaaaagtgccctctccactgtgggggccacagtggtaggcacaacccttatccctcagccccattagttaattaagtcattttacctgcattaaactttacgggcagagaaaattcagtaagtcaccactaccaggtgactttcttttttatgttaccccctagcaaggcatgtagtttgcatcctacagaatataaaagatggggccagcatctattctgtgtcttagcagtgaacttcatccaatagatacttgatttttaaatactttcaccttgtgtcatgattaaatcactaaacaggaagtttcagcttttctttaaagaagtacatcctattaaaaatttaaatgtcttcataactgcttacgctcagtaaatgaacactaggaatctataaacaggaatctatggctctaaaaattgaaattttgggggctgtttcattctttagaacttgaaaacgccataggcaattagctataattcatttgcagattatttttgccatgttaaattaggaattttagccatagcaagcataacagacaagcacacttttaaattattttgttcagcaaaacaccataggcccttatatgtgtttgctggaatttttctttgtcaacaataaatctatatgtttctttagttaaaaaaaaaacagcaacaaagtgtttattgtagaatgtttactttttaaacaaacgtgaaaggcattggtacaaaaagggaaaagcacctaggatttggatcctcagtgggtccaggagtacagcttccttgttctgcagttactggaggcagtgtggtgaggggaaggatgtgggctttggactgagctgctgcttctacctgtgctatgactttgcacaagttaggagtagcctttttgagctttgttttctccttagaagatgactaagatcatgtttgcacatagcacatgacacaaactcatgatactggttttgttttttctaacattgtctcagtgggtcttcactgccttctttctacaattttttttttttaagggaatagggtcttactctgttgctcaaggctggagcgcagtggctgatcattgctcaccatagcctcaaattcctattcactgccctcttatatagtggataatgtgggcgttagtctcatgcagttaagagaacaggttcaaaagaagttttgaactgtctgttttattttcacaaggccagtcagtgacagagaaagaacttccacttgggtgtcctggctctgtgtcccatggttttcctactgaaatactattactgtgctatagcagaagaaagaaggctaagacagttctgtgcttacagtcaccttcagtttcaaatgtaatcatatcctgggggaggggaaatgaaactttgagtttcatctcccaaatcattcctttatttagaatcaaccggctgggcacggtggctcattcctgtaatcctagcactctgggaggctgaggtgggtggatcacttgaggtcaggagttcaaaaccagcctggccaacatggtgaaacccccgtctgtactaaaaatacaaaaaaaaaaaaaaatagccgagcatggtggcaggcacctgtaatctcagctacttgggaggctgaggcaagaaagttgcttgaacccaagaggcggaggttgcagtgagctgagattgcgccactgcactccagcctgggtgacagagcagtactccatctcaaaaaaaaaaaatagtatcaatgaattcaaagaaataaaatgtttttcatgtactcatggaaacaactatttctaaaattctaaatgaattattattattattattattattattattattattattatttgagacggagtttctttcttgtcagtcaggctagaatgcaatggcgcgatctcggctcatgcaacttctgcctcttgggttcaagggattctcctgcctcaccctccccagtagctgggattacaggcgcctgccaccatgcctggctaattttgtatatttttagtagagatggggtttcaccacgttggccaggctggtctcgaactcctgacctctggtgatccacccacnnnnnnnnnnnnnnnnnnnnaataacgtccactacatcagtgcataacgtccgtgccacacgggggaatagccaatgcgtatagttatctcctacgaatcggaccataagaatcttcagtgctcgggagtaacgtcactaacatcccgacattgtcagcaacgaccataaaagacgggacccaaactgctgtctagcacaatacgagatgccccccgccaaatacacaccgcctcaggctacgttcaaaataagggttagatgggtaatctcagatccaccgaaggcaatagagcattatattcccgcgagaggaaataacagttagaacgcgcaccgcctccaaccataattaaatcctcggcacaagggggtggtacaaaaaagggcttcggacccgtaaaaaaacaggacaaaaatggacttctaggccgccctaagcaaccaaccctcctggcgggggcaccaattcaacaagctcgtttgtcggcaacaatgtcaataaccttctttagcaaaatgaaagccttcctcatagggagaattttgccggagaagttaggtaacggggtaagtcccgatctacacccccatccacctgggttgttcgtgtctgcaagaatatatcgaccgagagccaatcaaaaaagccggacataccgtttctcacaatgctgtcatcaggggcatattcttttgaaacaggaggcatgatcaagatggccagagtcagtctccaaaacctttctcatggtagtgctagcaccttagctagtcaaagtattaggatgcaaggtatgagccaccgcgcccgacctctaaatgaatttttaaaactccagcatctcacaaatggttcttgaataatttttccttagcctgcagtgtttaagttgggttttgaaggttttgttactcaatagtcacccttttttgggtgtaagtttgtcctctactcctgagtaagtaagtgaccttagggcagtattaccatgaaacagatctcacaaataacattgataccaacatcattatttttggtcaaatgttaaatagttaaaatttgtcatcctagtctatattgaactaatttgaaataccttatatttaagcaaactttattgtttttaacatagcaaaacaattaataaaactttaaatcaattacacatgaaacagtaagaaagcagtgcaagattaaaatctctaggtaagtgttctatagtgtataagtaagttctgtagaacttcagaaaaaagagaggtcagtaggattcttagagcaaagtgtgattttatctgtactttgggtcagaataacttttctgattttttttattactaacatacctaaacacagataatgttaacattaattaagtgaccttagggcagtatcacaatgaaacatctcacaagtaacattgatactaacacaattatttttagtcaaatgttaaatatttaaaatttgtcatccttgtctatattgaactaatttaaaatatcttattgaaatatattattaattaattcatatcagacttagctagagacacctaatgttcaaaacagaaagtagaggtggattgggcccagttggctccagttgctcagaggatgtggtcagtgctgtttttgtacatcttgagctctgctcactctgtctgcgagtaggttttgcgttttgcttgttggctgtcttgttgggggtgggaaaatggctgcccataccttctgccaggtgggcaaccccaaagacttttcttttccagcgcacgtgtaggagcagcctgttggaggcatgtgcccatgctttagactgtcacccaggtcatgaggactgtggtttgaagagtgtgctcactcaactggctagggggtgagggcactgtgtttgacaactgtcaaggactagcgaggttcccagatgaaagggggtgatataccagaagaagaggcatgggtgggaaatgtgcatagcagtcccagccaatagctatcactgcctaccacatagtgctacaaaacagcgtaagaattattcattgagtgcaaatgttgggggagtgggggttaaacagagacctattctaagtgattcttgactgtttgtccaggtgtcattccttgttataggagttttaaaagcagaaaattctcaactgctcattcacctaatactccatgaaagtatatattcttgagtgtcctaagtgtgtgtcctttgaaatgtttatatatataaaagatattttaagtataaaatcttaaatatcttttacacttaaaatatcttttatattttatatttgtgcttttataagttaaaaaatgtgatcaccatgaccctctacttggatgtgacaaccctccattttataaaataattaccgttgaatcaaaatttttgctcaacgtatgctatccagttacctgtcaaagccaactgaatgaatgatgaaaaggttcagatcaaaagcaactggcttaacttcacggaggttttcatgctttaatttaaaatgtgtctatgtctaactgattatctctcacattttataaagaaatattgacgttctgtaaagtatgtagtgacctcacttctggctgtgtgggcaggtttcactgcaggcctctgaagcattgatattcctgtaacctttgaggcaagatgtgtgtgtagtgtattaatgagctgattgaagtgatgtacagtaatttcatccttgggtaaaaacagatgtgaaagattctgttttaatatttaatcagcctccaagcctctgttggcttgtttaagttgacctgacagcattatacctggaaacactttgaattaaactctgagtgcttgaccttgttcaaacagttgtaatttaataaggctgctgtcttggtggagatagtgtcgctaataggcaaatcctcttctgactgggattgttctgtttgtgagtgctggggttggagagattcagagattctcatcagtttgtggggaggaactgggatttgaagaagtaaaaacaaatctaaattaagaaagtgtcttttagaagatctttaaaaacttttattttaatttttagacatatagaagtaatgtttttaatgtcattttgattaggctcattttggttgaaaggaatggaaaatcatttgttaaaaagagagctggaaacttgtcagaaatcaaagaagtgctaggaggactgcatactcactctggctctccttgtcctcctgtccacccatccctccacccacccatccgtccctgcttttctctgtctctgtcttgggcgtcctctgcacgatagcctgtctgctctctcctttcttctgttggctccctcaatctctgtttcgtgtacttctctctagcccatagctcctctttactaatcatttctgttctctcatgccatcagtttgcaggggctcttggtagtttcagctctcttgtatcctttcagctctaagtcttgctgtcaacaagtttgtttccttgttcacgttccagttagctgggtctgaatggctctcctgatcttttttgtgccatatccaaattgcccatgctttccaaagcagggggagctgtggacaagacagtttttggcttgaaggaaagattagttggggcaaataccatgatttgcccaatataaatgcgtgtagatatatattttctggttctaagagtaccatatgcttactggggaaaaatgagaaaatttaaaaaactaataaaaatacagttaaaatctcctgtaaaccgactattcaaatagctaaactactttggtgtatttcctctgattttttttgcttgtttatacataaacataatatacacagtaaacatcccaaaattttagaatcatagtggtaacattttaaagatcttcatatctacttgttaccagtggcatctgtaggaatactctggctgtcaggcctacgttaaaaactgtggtaatttggtgtgaatcttttattaattctttccttttgactaatattaagtgtggcatcattaatcatgttatattatcttcactttggcttgcattacttatcaactcctttgagaagagttaatattattttcatatttcacagtacttgacatattgtctcatacttagtagatgttcagtatttggtctatagtttctgcttaatttttatgaaacttgatttctgtgagtgggcaaaatacattcataaggttccagctcagaagaaggaaaaagtaacaatgtatagcactaagaatattggaaaacaacggggaaatatgctaattgcttttaaacgaacagggattttggcagtattgtggtatatgaagggtctcctgtaggaagctgactggctcttctcttttaggagccctcccagggtggcattcattaccttgtcggattgccatggtccagtgtgggtagcagaatcctgagagacccccagtgaccctgccctttgtattatatcttcccctttgagtataggtggaacctatgcatgtttgagatatcacccatgattctactaccttgcttggcagagggagactatccaggtgggctgatctaatcacacaagccccttagaaaccatattctccagcaggtgggaagaaagagtgatctgaagcatgaataggatttgatgttgactgcgaagatgaaagggaccatgtgccaagcaatgtgggtagcttctagaaactgagcatggtccccagctggcagccagcaaagaaacagggacctcagtcctacaaccgctaggaaccgaattattctaacaacctaaacgagcttggaggtgaatttttcctaagagctcatggataagagcagagtctggctgacaccttgattttggctctgtgagaccctaagcagagaacccagctgagcctgactggatttctgacccactcagctgtgagctcatgaatgggtgttgttttaagccactgtttgtggcagtaagactaatatagtccagggtctggctaattcttagctttgtcagattttaacttgattttctgtggatatcaagggtggagctgtctctcaggggtagacttacaggagcctagctgaagaaactggtgtatggaatcaggaggccagcatatttatttgtttatttacctgaaaagtaaatgttccagggactgagatactccatgtggatggtcagtacattatctcccttaaggcagacctgtgtaggaggccaggtgtgtattagtgagcatggcatccaaaccatgagttagatgagcacagtttccatggcatcaaacacctgtctcacaacaaggatggccttctctatgtctggacaatgtttagatgggtactgccagcttctctggagactcactgtattagttttcaattacagtgtaacacataaccacaagttagcagcttaaaacaatgaaagtatattatctcacagtttctatgagtccaggcacaggtaactgggtcccctgctcaaggactcaccaggctgaaatcaaaatgtcagcagggatgtggtctcataagctcactggttgttggtggaattcagtgccttatggttgtaagactgaggtcctcttctcccagaggctgccctgccacatggccctctctacaatgtagcattttgcttcttcaaggtcagctggaaaatctcccacacacttttggtctttacaatctctgaccccctttaaaagcctagccctgtgtatgctcatagggagagattgtacaggggcccaaatcttgagggcattgtaaaattctgctcccacacttgctttcccctcagcatcccttgatgactggccagctttctgtttgacacctcctttctttagctgtgttaatatatccagtctttgggagtccaggcttggttggatatttcacatctctgaagtgactacatagttcttctcacattcagtatgtattgatttttaaaatttaaatttgtgaacttaatcacacctttatttctgtgatcctcccccctttagtaactggggaatgggatgaggaggaatttcttcatcttagtttcagaagtcttcacagcagtggcctctatttgtagtttgatggtctaaggagtttagattgttagagaacttctaccttcactagaattttgaagacgtaacttaaaattacacttactagatgtagaaactggggagacaaaatgagttatttgcacagttaaattattagctagtgaagaagggtttttatttcttatttatatcctgccttctctcaatatgatgatgtccagtaaaaggcatagatagtctaaaagtgaagcaattaaaaatttttctattatgggaatttgacagtacaaaaaaacacagatgtccttgcccattaaagtgaacaccaaggagtccaaaatattttcatgaggtagttttttgccattgcctgtcagttgtgagagatcattgcctcaggccacagcgactaggtgtgtggcagagttaacctgcctgctctctagggaaaccgtcaagaaatgggcaataaattaataagtagaaagtgttctctgagctccaggcagttgttgattgactgatggaaaaggtaggcggtaggctaatagacgatgacatccaaattcagctgttgcctctcagctgaacccaaccctgggcttctgctgccttttgctccttttccctgagtggtggtggcctgcaggttaaacaggtgggcttgggaattgggctgcctagggtaaatcctcattcccccatttaactcagtctgccagactctgttttcttgtctgtaaaatgagggttaaaagagagtctctgtaaagcatttaatacgttgttgggcactagcggtggattaaggagaagagggctgtgatgggagctgtcagccccagcaggcaggagttagaattgtctggaattgccggtgtagggtgataataaaaagcaaactgactcttggtcggtttattactatttttaaattccctactgacaaggccctccctattgcctgcactctgagtggaccactccttccatccatgccttgcaatgccactgtcttgcacataagggctcaaaagtgtatgctgttgttgcccttctcacatttcggctgaggtgtatattttcattaaagaggattatgtagaaaaattggtttaataaaaatgatgagactttttaatatggtttgtacaccattaagagtgaaatatggcaaaatctggtctgaaaaataggaaaaaatatagcaataactgattaatagaaaaccataggattggctgggcacagtatctcacacctgaaatcccagcactttgggaggccgaggcaggtggatcacctgaggtcaggagttcgagaccagcctgaccaacatggtaaaaccccgtctccactaaaaatacaaaaactagctggacgtggtggtgcactcctgtaatcccagctactcaggaggctgaggcaggataattgcttgaactcaggaggcaaaggttgtggtgagccaagatcgtgccactgcactccagcctgggtgatagggactccacctcaaaaaaaaaatcttttttttccctttttatatttttgtctggatcctaaatattgggacatttgaaagatgtgcatatttagtttaagcaaattctggtggatttggttggttctctctgtagtaagagtagagaagaatggtagatgtgaaaagaatatattctgaaaagaatatgggataagagaaaatcaagaaggcaagaaaataatcatttccacccttttatctactttgaaatcaccacttttcttactttggtcttctgtttcctctataaactatgcttaagagaccagagtgagcagacttcttcgtgaaaacctgagcttgggagttgggatggtttacagtcttggcttcagtccacttttctgacttaacacccagacccctttccggctaaatttattgtctcctgttcctgctgggcctttctggagcgtccgcctctggagtgccctctgctcttgaggtcccaaactgcccatcccacacctacctggtcacagctttgcagtttaagtccccacatgccagtgactgcttcctttctggacccctttactgcatttcagcagtgctgtcaatccttcctttaaatttatgtcactggtttgtagggctcattcttccagcctgcagacgtcagttgagattccactgtgatcaaagcaggatatttaagttctgcagcgggtgggctgcaagtggtagaaatagttattttcttgccttcctgaatttctcttgttccattctcttttcaggatacattcctttcactacagagagttgtctgctctcactacaaacagaaccagccaaacccaccacgatttgcttagacataatgggcaagaactttcagaacatttggaacttttcagaacattgggtggtcttagagactagccagtacagaaatctcttgagagggtgttactgtgttccttctggacacctccagtttctgatttggctgtcctgtttgtcagcagtacatccttcatattgagcccaaaacctccattcattctggtgttcttcagtgcagtcacactgcttcgtgatggcttttcttcagtgcagtcatttgcttcatgtgacttttcttttttctttttctttttctttttctttttttctgaggcagagtttcactgttgttgcccaggctggagtgcaatggcatggtctcggctcactgcaacctcctctgcctcctgggttcaagcaattctcctacctcagcttcccaagtagctgggattacaagtgcccaccactatgcccgcctaatttttgtatttttagtagagacagggtttcacaatgttggccaggctggtctcaaactcttgacctcaggtgatgcatctgtcttggcctcccaaagtgctgggattacaggcgtgagccactgcacccagccatgatggcttttccaatgcaaaacattgcaatagttattcctttgaaccttataaaattactgattgttatgttttgaatatttgtcccctccaaaacttacattgaaatgtaatccccaatgtggcagtattgagaggtggagtctttaagaggtgattggatcaccagggctttgccttcatgaatggactaatccattcatggattactagattaatgagttaattcatgaattaatggactgatgggttatcatgggagtggacctggtggctttataagaagagtatgagagacctgaaccagcacattcagcttcttgccatgtgatgccctgcactaccatgagattctgcagattcttccccaccagtgggaaggtcccaccagatgtgaggcccctcgaacttggacttctcagtcttcataactataagaaataagttcctggccaggcacagtggctcatgcctgtaatcgcggcactttgggaggccgaggcgggcagatcacgaggtcaagagattgaaaccatcctggccaaagtggtgaaactccatctctactgaaaatgcaaaaattagctgggcatggtgctgcgtgcctgtagtcccagctactcgggaggctgatgcagaatcgcttgaacctgggaggcggaggttgcagtgagccgaaattgcactccagcctgggcaacagagccagaccccgtctcaaaaaaaaaaaaaaaaaagaaagagaaataaactccttttctttataagttgcctagtttcaggcattctgttataagcaatagaaaatgaactaagacactgatattcaattgttttagcctataaaaatgggaattttatgtgggtcaacctagtatattccccctgattctctgcttttccagctcatatacttttgtagtttagataacctcctgtcagttaaatcatgatataagttcttcgttccttttttttcctttatagtttaaaaattattttatgtgtatctttcctctggtagccccctgagacttgcttactgcaagcccacatgctgccttgactccttttccctgaatcaactgtgaattgttccgcagcttctctcctttttggtctctgaaccaaggtttcttaattagagtatccacaagtctatatgtgaagaggttgagggaaaagtaaccactggggacatgagaaatctgaaaagtaatagttagaaatggccatcttagccttattaaaatgtaagtaaggccgtgtatggtggctcacacctgtaatcccagcacgagaggccaaggtgggcagatcaccttaggtcaggagttcgagactagccttgccacaatggcgaaaccccatctctactaaaaatacaaaaattagctgggcgtggtggcatttgcctgtaatcccagctacttgggaggctgaggcaggagactcgcttgaacctgggaggtgaaggttgcagtgagctgagatcgcatcattgtactccagcctgggagacagagcaagacaacatctctaaataaataaataaatataatgtaaggcaaggccttttcccttatatctattttagggtttacccttgtgtatacagaaaaattgttccctgtccagcttattatgggctggatagcaggcagaactcctcagtttgggttagcattgcattaacagaactgccacatctttctggataatcttcctttgtgcataagctccaggctcaccttctctgcctcacagctgtgcgctggtttcccttagctttcttgggttctggatggatactggccttctgggtgagaagggggttctttggcaaaaggtgtttttgacataatttaggaccttcttaagttctacagcagacctaaatttcttcccccaagttctttgtctatatagagtactcagcactcattacccattctcagttctgaaggaaatcttatggagcagttgtagtatttatagggtaagcagagtgcccagtttccatgccccaccccaaaccatttagatttcagtcatgtatgtcaagggaggagtgagtacatttttgtggtcagctgcctcttcttttccctaacattctcactttttcatctttcctgctttcttgaggtcatttatctattgaataggatgtctattgaaaggaaaaacctcccctaatcgcctttaaactaatatttcttactgggcatggtggatcacctgaggttgacagtttgagaccagcctggccaacatggagaagccccatctctactaaaaaaaaaaaaaaaaaaatattagccaggcgtggtggcgcatgcctgtaatcccagctatttgggaggctaaggcaggagagtcgcttgaacccaggaggcggaggttgcggtgagccaagatcgtgccattgccctccagcctgggcaacaagagcgaaactccatctcaaaaaataactaaactaatatttctcttttctcaataataatggcatgaaaagaattttttctgtgccttttcaaaatcccaataccccctcgtggcatttcctatgttgaagttttcaacagccttatcaggaggagaaatgagcttaatttttgagttttagtgcttagggactctgtcttggcttctagagataacttcactgtgggcacccacaaataatatgtttaattttttttctaaaccttttgctgatggtcattgcaatattttcttgattttaatttcctgagttttcttctttcacattttttcttttttttttggtgatatttttccatattccattatctgcatccttctcactctccctgatttttcaaacatcatggactacagatctgcaacctccctggtaattcctcttgggtttgagaggaagtttgtcaagtactggaaacttgaacttgtataaaacagatgtcaccactcattttaatggaagaaggcatggagtaaatacagatagcacataacagctatatgcattctcttaaatttctttcccgatcttgggcttgaggtatttttatctaatctagtctacccttgccattttcaagatctttttctttgatacttgatagagaagtgtcttctgtatttttcttccttcttggaagaatatattttaaaaaatgtattttgagattgagtattttgtgaaacatctttcctctaaaatcctcaaagtaactttgcctctctttgatttctatgggtagtccagcggagagtgatacacataaggatatttcataaacactgcttgcattcctctgggatttgtgctcctagatgacagcatatatatgcatgtgattctgtgtgtgtaaacatgctttaaaaaatttattgaacatagttttcagctgtcttcactcactttaaaccttagtctactttctttttcttttttttttttttttgagactaagtattgctctgtagcccaggctggagtgcagtggcgcagtctcaactcactgcaacctcctccaggttcaaacgattctcctgcctcagcttcctgagtagctgggattatagttgcccaccaccatgcctggctaattttttgtatttttagtagagacagggtttcaccatgttggccaggctggtctcaaactcctgacctcaagtgatccgcctgcttcagcctcccaaagtgctgggattacaggtgtgagccactgtgcccagcctttagtctactttctgtttttacaattccatgccatgtttattgaaagcatgttgttggtttcttttgatgcctcccctgtctttcttctcatcatgattttaaaaattaatactttgtaatatttgagatttttatatctatgtcaagttaacttttcctgaaaaatattttgatacattttctagaatgttagtgtattgtgtttataacatgggggaaaatgtactgtttcatttttaaatttatttttatttatttttgttattattattttttaagaaacagggtcttgctctgttgctcaggctggagagcagtggcatgatcctggactcaaacaatcttcccacctcagctttctgagtagctaggactacatgcgtatgccaccatgcccacctaatttttaatttttttgtagagacagagttttactatattgtccagactggttttgacctcctgggctcaagggatcttcccaccttggcctcctaaagtgttaggattataggtgtgagttatcacagccaggtgcaataagtgtttatgattaatttaaaagcagatgctgtgcttttcaaaaattatgctcaattttttttttaatattacaaaggacttttagactggcttcctcctaaacatttcttcaactcctatcaagttcagtctgcaaatatcctaatttctaggttgtttgggaatgttaattgattgtctcatgtatgtatgtatgtatgtatgtatggatagacagatagatgaaggttgaaggatggatggatagattaaatggatggatggatagatagatagatagatagatagatagatagatagaaagatagatgaaggttgaagggtagggctggaggaggaattccagctttccagtagattttctatcaagcagtcattcatatatataacttcctatattgttagccaaagttcatccatgtctcttgtatttagctctctgtctgtattgtagaaagcttatttattatgtgagcattttgctttctcctatccctccctctttctttaacatcagttataacagctgtgaatacagtttataatatgagcagccatattcagtttttaggctttcaaaatcacaaatacaaaggaggatataatacatagtcctatattttatacaaattgggacacttttcttcatttcttatttcgtggcattgcctaactatagtcaagctaatgacccatgtagatgtagtgttgtacctggtgtccgtgtccctgtgaatgtgtcatgttgtgctggcctgattccccaacatcagccccagggagccagcagctggagcagctgtcatcttgtgaaagcagagtgtccttgttgctattgattgggttgttcagtcaattgcaaaaaagtggatctaactgtcaatggtagttatatgataatcctggagataaataagtgtcaagtgaagtattacttgaatttaggacttgaagagagagaaaggggtatgagtagttggaggggaagatttgctatgacaagctattattcagtgtggttattttgtatgacaggtaagtctacaggtatcttttgttagataaatcagaaattaagcattccctttgtaaactccaaacaagattttgaaacaccatggtccccccttatccacctccaagatctccagtggatgtctgaaaccactgatagtactgaagtctctatatattatgtttttcccctgtatgtaatacatacctgtgataaagtttaatttataaattaggcacaggaagaaattaacaaaaataagtaagaatagaacagttataactatatgttctattaaaagttatgtgaatttgttttctctctctctcaaaatatcctgttgtgctgtgtgttcacccatttttgagctgccgttgactgtggataacaaaccacagaaagtgaaacttcacataaagggggactactgtattctcataatgttaattgcttctagaattcacaaggattgaattcaacttgaatcttgctaaagaagtactttattattcgatgttagtccagcaacaacttatagtgtagaaatttgcccttttgagggtgaatacacaaaggggaaagaaaacttgtgtgcccacggtccactaacagataagcttctggaggccaggagtaaaccgccctgcaggggagccatctcccagggtttccccagcagagagctgtgcccagtgccggggtctcatgcttacctatttctctgtgccagtatagtagacctgttttcaagcctagcatgagccttaagtattactggctgggagtggtggctcatgcctgtaatcctagcactttgggagggtgaggcaggcggattgcctgagctcaggagtttgagaccagcctgggcaacatggtgaaaccctgtctctactaaaatacaaaaaattagccgggcgtggtggcgggcacctgtagtcccagctacttgggaggctgaggtaggagaattgcttgaacccaggaggcagacattgcagtgggctgagatcacgccagtgcactccagcctgggtgacagagcgagactctgtctcccacaaaaaaaagaaaaaaaaaaaaagtattacttatttagtaagtccatagcattttgttcacacagtgtatcattgtgcttttctgtttcaaagtgtaattatttaatctagaaattttaagtcctgtgacagaaaacaaatgctgttctcacaaaatatgagaaatcaaattccatcttattatttaaattaattcttttttaactgaagaattgttatgtgggtagctttcaacataattttttcaatattagatgcttataactaatgtggatttagttaattcgatgtttatcacatttaattcttatttactacaaaggttaaagcaattttatttcttctggaaacttttaggatcttgtgagtgagggacgtcagccaaaattggcaactttttcaagcaactggctcaagaaattaggaatttctctaataatgagccatcgttttttgaattcaacaatttaaaagggctgcatagttaggatatgattccagtttcccctcagtgcaaattgatatttttttctgttgacacattctactttgttttcgaagactagtttatagtgttcttttaaaagcaaagaaaatatctttaaaaatcccagctttttggctgggtgcggtggcttcatgcctgtgatcctagcactttgggaggctggggtgggaggatcactggaggccaggagtttgagaccagtctgggcaacacaggcactccatctctttaaaataaaaaataaaaaaataaaaatagccaggcttggtggcccacacttgtagtcccagctactcgggatgctgaggcaggaggattgctggagctcagggattcaaggttgtagtgagctatgattgagccactgcactttagcttgggcaatggagcaaaaccttgtttcctttaaaaaaaaaatttattaaaacatgctcttactttggcaaaaatatatgtttcttcatagtgatgataatcataatgatacattattactatatgcagcttataagaatcagttgtctaatgtatccgtgtaagtttctctgtggttttaagaatcattccataggctgataaatgcatactctcttcaccccattgcacatccagcattctgaatttttctcacttccttgaatatgccatgttccatgcacttgtagatcttccatcacagaaggtgcctcatctgtccagaacccctgccatacctctgctccctttgtctagctaacgctcactcatcctttagatcccagtgaaatgtcacttgcatctgggaggactttctgactaggttctgagcttcctttgcattctgtttttcattgacataatgacatcacatttattagtattgtctcattgtaaaccccagtaaggcaggaactgtatctctctgtatccccaacactaccacagtgcctggtgcatgttaaattgcagttaatatttctagaatgaaagagtgcttccatccttcatcatccgtctttcagataaagaagtatctagttacctttgtcttaaattaaaacaatttcaaaaggttgcatgtgctggtggaccagttgaaatccacagctcccatattgctgctcattgccactgttattgatgccctggagatgatttaaaattcagttatgttgcttgtgatggtggtatttaaaaatctataattttggctgggcgtggtggctcatacctataatcccagctctttgggaggccaaggcaggtggatcacaaggtcaggagtttgagaatagcctggccaacagagaaaccccgcctctactaataatacaaaaattagccggtcgtggtggtgtgcacctgcaatcccagctactcaggaggctgaggcaggagaattgcttgaacccggaggcggaggttgcagtgagctgagattgtgacactgcactccagcctgggcgatagagcaagactctatcttgaagaaaataaaaaataaataaataaaatctataatttttatactcatgtgctattatagtgaccctgtgagacatcataatgccttaatgatagcttgtcttgtttttactttcacttacatctatagttccaaatgttttattgaattgtgctttatttgataattcatagttgtaaactgacctcatcccatatttgtatttttacaatctcaacagttttatcagggacatatttttatattctgtagcataatacagtgccttctgtagagcttagtttcatgtgcagtgatgtgtcagaatgaaatatctgcccagtggtattgaatttcatgtattatgatttacatattcttctgtgtatcaactggttttatattacccagagaatgcttatggtggtggttgagagttgtgtattgctattgactgtacgggccatagacatatttgtaggtatattaaatttgctttgtacttctcacacaattgatttggtgggcattcttcttaattatacttgatgggtgcatacataaattcattcttggttaaaaaaattcagatagtgtagatatggcagtggttcctttaatccctccaattatttatttaccttatatatctgggaactttgtataaaaactaaacactggcctggcacggtggctcatgcctgtcatcccagctctttgggaggcccaggcgggtggatgtcttgagctcaggagtttgagaacagcctgggcaaaatgtggcaaaaccctgtctctacaaaaaaatacaaaagtgacccaagtgtggtggtgcacacctgcagtcccaggtactcgggaggctgaggtgggaggattgcttgagcctgggaagtggaggctgcagtgaactgagatcacaccactgccctttggcctgggtgacaggccgagaccctgtctcaaaaaacctgaacacttctttgttatgtttctacaatttgacacaataattcaagtcagccaagcactttaaaaattattttgaaataattttagatttataggaaagttgtcaaaatagggtagagttaattatatataaccttatgcagtttccctgataaccacttatataaccatagcacagttataaaaaaattatcaggaaattcactggtataataccattaactaaactgtggccctttttgactttcaccggtttttcacctcctgtatttttctctgttccaggatcccatccaggatcccacattaccttcagttgttgtttctcctttatttcctgcaatctattaaagattctaatcctttctttgtctttcatgacttcagcaaacagttttagttggatgcttagtatataccagtcactgagattggtgcttgagggaagggagataaatgaatggatgagacatggcccttacctaatgaggtgagccaacacatagacaagtaatgctaaaacaatgtagtgcctttaaaaggcctttgtactatctccctagagaagagagagttgctgactcactgaataacagtgttgaggcagcattttcagaagaaatgacattgatctgggtcttaaagaatggggaaacttttccttgtggagaaatggagtggaagaggagttcatcatggacaggcaggggcatttggcatgaaagtgtgaaagactggcttgtttgcagactggcaaatcacttgataggaatggagcatagggtatgtgaagaacacagtgaggcatgaaactagaagagtagttacaaagctaccttttttcattactttttattaataaatatatcctcatatttgtagggtaagttttggcttaaattttttttaaatctcattattcatacttaatgagcatttaattgtaatcagtgtttctagttttaaactgcacaacattaagattgttactgtacttttggaaagaaaaagagaacaaataattatgcttagctgttgcaatagcatctaatagcatttaaattctgttaataaagaatatgaatttattctgtaatgcctattgggcacctattatatggcaggcactgtttgaggtgagagagatatagcagcaaagaaaagagaaaaactcctgctcttgttctaatatattctagtggtcctagttgcaatatgtttgaactaacatggtagttcagtcaacaagtcaaatgttaactgcctagcatgttatctagatgctcagcagatttttaaaaaatgaatagatatatgactgggtcttgaaggagtaaaagaatttcaggctgggcacggtggctcatgcctgtaatcacagcactttgggagaccaaggcaggcggataacctaaggtcaggagttcaggaccagcctggcccaacatggtgaaaccttgtcttttcaaaaaatacaaaaattagccaggtgtggtggtgggcccttgtaatcccagctacttgggaggctgaggcaggaaaattgcttgaacccgggaggcagaggttgcagtgagctgagattgtgctgttgcactccaacctgggtgacaagagtgaaactccatctcaaaaaagaaaagaatttcattgagtagaggtttgctggcatgagtaatttttgtttatttcatatgcattcttggagattattcttaggtagttagaacacattgaagatattatttcattgtcttttgacttcaattgtcaatctcaggtaattgtcttttccctggctgtctttaaaaatattttctctgggccgtgcatggtggctcacgcttgtaatcctagcactttgggaggctgaggcaggtggatcaccagaggtcaggagttcaagaccagcctggacaacatagcaaaaccccatctctactaaaaatatattaaaaaaatgggccaggcgtggtggcaggtgcctgtaatcccagctacttgggaggctaaagcaggagaattacctgaacctggggcatggaggttgcagtgagccaagatcgcaccacttcactccagcctgggcaaaagagcaaaactccatatctatctatctatatatatatatttttttcctctggttcttatttttgaagtttttgtacaatatatcaagatacagatttatttttatttattctgctaggtatctgaggattggtattttagttcaggaaaattcgcagccattatttcttcacatactgtttgtgcttcatcctctttttttgtttgtttttttgagatgaagtcttgctctgtcatccaggctggagtgcagtggcgtgatcatggctccactgcaacctctgcctcctgggttcaagctatcctcccacctcagcctcccgagcagctgggattacaggtgtgctccaccacgccctgctaatttttaaatttttttagtagagatgggatttcatcatgttggccaggctggtcttgaactcctgatctcaggcgatccgcccacctaggcctcccaaagtgctgggattaacaggcatgagccaccatacccagcctgcttcatcctcttttaatctcattttcagtctccaattaaacatatgttaaaatttctcactgtatgctctatgcctttaccctcttttgtgtttttcttctttttctgagctgtactcagtttactgattctctcttcaactatatctaatctgtcattagttatagaatttttatttagttatcaaatttgtcatcttttatagtttatagttccctgttaaaaccatttagtttggtttttatctctttgaatatagttaatgtcattgtttttaaatctttacctgtattttcaatatctgaagttcctgtgggtcttcttctgtagtttcttgtttctgctggttctgactcatggtgtttgttttttcctgtgcctgattacatcctggatgttgtttttgaaaaagtatttatagaaataatttgaggttgagaattttcatatgcttctgccttctgcctaggttgtacagtttaaggcctcctcaagccaagttcatgattcaggtattgtgagttgggctgcaaacctgtgtgcaggctggttacttacagttcactttccctctttgaagccccatttacaataggggttggtatccttgagaccccacctgcttaggctccagatgtcaccagaatttcacatcagctttatttcctggattggtaaatataaccccatgataaaagtggctctgagtgttgggtttacctcttggacttcctgtcctcaccaatttttgaccgaaaattcaaccctatgttgttagctctttgaattacctattctgtcctcattagaagagtgcctccagcatttattgcctaaacatgacagctgagtatttttagtttgattttttttttaacatttgctaataatacgttttcaaccagatcataaactttgtggataaggtccctgtctgctatttctttacccttctcatatagcatttaatacaatgataggtggataattggttctcttggccagttgactgatcaaggggcaattctccaaactctggtgatttctccttttcgttcgtaagactgcttttataccccaacaaagaaacttgttataatttaatagtggctgtgtccatttttcttttcttctctgctgttccatcccaaggtgggatggccccaattagactaaccactgaaaccctgggcataaaatggtgcccagggagcttttcttcatattaatttgtgtgtactctaaaaggaaagattatttggcttgctcataaatccaaaattttggtgatgaaaatatgtttataattatttcttttgagcttgatttgttgtggattttttcctttattttggtttaagatcaaatggtttcctaatgtgtatgggtcactgtagtctaaatttttttttttttttttttttttgagatggagttttgcccttgttgcccaggctggagttaaatggcgagatcttgcctcactgcaacctccacctcctggcttcaagtgattctcctgcctcatcctcctgagtagctgggattacagatgcctgccaccacgcccagctaattttgtatttttagtagagacaagattttatcatgttggccaggccggtctggaactcctgacctcaggtgatccgcctgccttgaactcccaaagtgctgggattataggcatgagccaccgtgcctggcctctaaatatttttaaagtatagatgtttttaaacttgtagctcctgagtgtgaactgtcccttgctgttttttgggcatctatcaaggcatttgttctaaccactgagtaagaaggacatcactaagggggttgtagctatacctttcttctttttatctttaattaacatgcattgactgcctggtatgttagaaacagacctgcctattacagtctcattcccttccatactcatccttgcttgtgtggctacctcccaagctaggactgcaagacccttatcactcctgcttactattggtttttgtgtccttttggcaattttctagtggctgcttgaactattggttgtcagattgacctgatttgtttcacttgtaaacaaaatgcttaagccactgttgatttttgtggcagctcagttgcttagagcaaggtgttaatgagacatcggtcataggtccaggctctgggttgactggtaagctttgctctggcccatggccacagaccctgactcccccttgccagctgtcttgcacatgtagctatggctcattatggggacacagcagggggtggagataagacaaggcaaatctgtcatctctgccagaaaagacaactcctactgataggtcagtaaccttttcattggaagaacagcacgttagtattagcttctgtagatgtgtctaactgagtctttttcttaaaataactcatgtgattgtatgggttgtctgcagcaagtttagaatactgctcacattttaaagcatgtttgaatataaggatggctttttagtttgtgaagattattgtccttaatcagggattcttaatatcattctctaaagtagaaaagtgagctttagaagtcaaatttgataaagctctagaaaacaactgcaaaattgctgttataaagaaacctgtcaaatttaggaagtgccctccaggagcccttcatcccaaccaatcctctcctaaaagaaaggaaaaaaagaagaaagatggctaggtagatggaatagtgatcagaaaaaaagaacttttctagaaaagcataccagtgtgctctttaccagagcattttagcaggtaatattttacaaaggacccagcagataattgggcaggttttttctttaggaacttagtgttgatggcctgaattaatctgactaggaatttagacatttcttcatgatatattttgagtccatagatgatctgattctaatgtgacttcagtttttaacttacatagcgttaagcaaaaggatgtgtgtgtatgtatgtgtgtttgttttacatcctaaaggtattacaggccccatggtaaactttttggctcaagtgaatccagagtttggtatatgtaacctccagtggtggttcatgaacaaacacttcatttctgtagtcatatttttttttaaagaataaaagtgagccaggtttaaaacttgttaagaaaataatagcacaggtgatacacagatgaagcaaaattgccgtggatggtctgggaatgcctgaggattgagaaacactggctgaattatacactgtggcagaagaaattataggcccttagaaacaggtagaggttattggaaagattcaagcacctaatgtttagttagaaggtaagtaagctggtttcttaagttcttgtttatttattgggtgtgggctcaggataagttagtttgaaatagatcttagagaagtaaatgcaagacaactttatcaatgagtcatgggcaaacaattctattattagaagtagtatagaaaaggagtaggagaagtagaagggaggaagtctagtattcattcatttatttattcattaattcagccactatttcttgagcacctggtgtatgtcaggcactgttgtaggcactggggacacagcagggagcaaaacagacaagtctctgccctcatgaaattcatttacatcctaatgggaagagacaaataatgtaagtgagtatatagcatgtcagctgtgagaaatgctatggagaaaaataaagcagagtaagggaattaaggagtgatgggatggggaggcattgcttttttaaatagtttgatgaggaaagacctctctaagaaagtgacatttaacttgacttctgagggaagtgagggagcattccaggcatggagaaggagtgttctagatggagggaacagcaagtgcaaagagcccttgacatgtctgagaaacagataagaggccagtgtggctggcgtggagagagaggggagagtcgtcaagtagtaagaggtgagagcagatgggaggaaggtctcagcacaggtcaggcctctggctttgctgagagtgatggatgcctttgcagggttttgaacagaggaggcacatgatttgacttaacgttttaacaagctgtttcctgctgctgtgttgagaataagctgtaggcggcaccaaggtggcagctgggagggtattgccacaaaacaagcaagagatatgatggtttaggccagtggtaatggtggagagtgtgagaagaggacagattctggatgtattttgaagtagagcccgcagaatttgttgatgaacttgatgcagagtgttagaaaaagagaagacttcaaggttattggcctgaataactggaaggatggagttatctatcactgagataaacagaggtaacagaagtaaaggggagagatggccatggtagaaggtggattacacctttaaatttttaaaacatatttttatttaaaatagccctcactccctggcccagtgcacacaaaggacctgatttgcttttaccctgagtttgtcactgtagatatcctggaatacttcgttaaaaactataaataaagtggccataatacggctcattttgttcagattctaaaaaaaaattccttcataagcagttggcttccaaatagcaatgcatgctgtcagtttggtgactaattgggttagaggttaatagcaaggcagtcctataaacatcaacgggagtggtgtatccaaatgaaagcttgcattaggcaacaattcaaagaatgagaatgactaaataccatgttacaagccaagtgaattatattaagagttttaactttgagagaaagggacgttacccctgaaataactatcttagttggatcttccctacttaatactcatagttgggttgtaaaaatgtaaaggttaccatcaaaacagcacttcttaaccatgaaattgactaactttgtaaaattagaaattctgttacttacttcctactatgctgattggacattccttcttttgccaaaagaacagaaagttggattttgtgccttctagccaagagaaccacacacctctctctctgtagaccagctaaatgcttcctactgctcggtgatgaaatcagatcatggaatcagtcagtttgctatactgaattttttttttttcagctgtgttctaattgaacctttggggaataaactaattcttaacatctgaaagtttaaaggtctgatactagaatttatggggtggtagaggagaccttttagtctctgtatccaaaccaaaatgtaaatttacttttatttattttttattttttgagaaggagtctcgcttaggctggagtgcagtgacatgatctcggctcactgcaacctctgcctcccgggttcaagcaattctccctacctcagcctcccaattagctgggattacaggtgctcttcaccacgtctggctaatttttgtattatttagtagagacagggttttgccatgttggccaggctggtcttgaactcctgacctcacgtgatccgcccacctcagcctccaaaagtgctgggattacaggcgtgagccactgagcctggccaatttctttttttattgtgggataatcattccatacttctccctcctctctagtccccacccccacccccctttttccccccacaagtgaagatgatttcctgtgctggtctaggattagttttgttacagtctgtctttataagaacatttcttttccataatccagaagcattttgtaaaacctatgcctggaaattgagtcactttttattgcttagattttcttcacagaaaaacataggttctgttggatgagtatttgttgtgaaagcaaattattaaggggtgaaaattgtctatacaagttgatgtataggaggatatctgaactggattagttgctcttttatctgtgttttcaaagctctttaatagtaactcttataacacttataacagtgttatcactattgtttgggcatcattccattctgctagactgggaattcttttataatacagtgcctgataggcatccattcattccttgaaataatgtattgagtgctcattatgtgcttgaaatagagtgtgtgcaggagccagagcagtcggcagaacagatgcagcttgtgtcgcatgtgcgtacagcccatggcagggtggggggcaggggacccagcaaacaagatacagataactgcgcagtacagtgccaatatgcacaggaacagtgactgtcccctacctacataaatgcatagacctcatatgtgtattgtgaatcctctataattgttgaatttgactttgaaattaaacacttgatattttagactagtcaaaaatgggatatgttattattttaataaaaacaccattgtatccagccgggcacagtggctcacgcctataatcctagcactttgggaagccgaggcgggcagatcacctgaggtcaggagttcaagaccagcttggccaacatggcaaaaccccgtctctactaaaaatacaaaaattagctgggtgtggtggcacacgcctgtaatcccagctacttgggaggctgaggcaggataatcacttgaaccctggaggcctaggttgcagtgagtcgagattgcaccactgcactccagcctgggcaacagactgagactctgtctcaaaaaacaacaacgacaacaaaaataacaccactgtatccatattgcctacaggagaaaatgcagatcacttattttatgtatgtgttgaatcattttaaataacctgacggaggtcctttcttgggcccatgcctctgcacatgttgggcatgttgtagttgtcgttactagcaagacacacctaccctttaagaccagtctaaatgccaccttgttccctccatgtaatctcagaacttctttaagggcaaggaccaaattacgtctgtgaaaccctagagtttgatctaccacttcacgtggaggcatgggacagaggttttgttaatgagtgaatgtatccatttaataagttccttcttcagtacactcttgagacctattctggctttcccaggaaacagctgaaggagtgacctccaatcaagtcagctctgtgtcaatccttcattttcggatgttttttcttccttttctcacagggtcataaggatcaaatgtaataatgatgtaagagttaagcgtattcaataaagggaggcagtggaatcatcacaatgttgatcatcacaatcaacattattattactgcaccactatagttccttgtaatacacagtccagaaatattatcacaaaatctcactgaggatgtcattgttctgggtttgacctagatgttgatgtaatgaacagttctctatcagttagtgtgttggcctagcacaggtgcttgacaaaggccctattcagacttctgtgcattacttcaaacccctccctttgctcccatagtatagtaatgaattaggagtcatatcttttgactggcaagggactgcctaaagcagatccctgcagattggggcctcactgtttctgtgggtataaagaacctctcgggagagcctgaatgatcaggagatctgaactggggagccatcggcccagcaggaggtgcctctgcttggccaaccagagcctgctgcaagaaaccttttttttttttttttttttggttctgacaggcttgttggggaaattgaaaatctcctgtttgaaagccagataatttaaaatcctttctgattcagaatctcagcaagtagtgaagggctaggttattgattgtgggaaatggggcagcctcaaagggctctgggctatctcagtaccccatctccctcacccctcacgcttcctcaggtttctctctcatgctagcttggaatggatggtgtatttcctacccagttgcctttgtttataagcatccaccaccgctgcagtagggtcaggaaactggcaatttcctcagtgatccttgcccttgaaccctatctcctccagcctaggaagtattcagaccaagtactcatgtgtgactctccagtgcttctggatagagaagaccctctgagctgccctaaactcgcaagagaatactccacaggcttatgtaagccaaaccagatcatgagtcagacatctgaactcatcaacaaaaagtgctccaggaaaaagaaatggtctacctggcatattattgtttgaaaatttattttaagtcaatcctctatttcattaagggtaataataatcagtctacaatgcaaaactcagggaaaagtaaatttcattttgtatagctgtaatataacattttttactctgctcaaaattcttgaaattgttaatccaactctataaattaggatatttgagtaaagtaagtatccattgtttgactgtgccagaagcaggagttaactttttctttctctggttaaaattatcacttacttgatagctaagtaattttttgaaagtctcttatatcctgatggtacactaaggccctgaagagagtataaaggtgcaagattcagtcccctctctcaagaaactagcagtatgattggatggataagatttatgcatgtgaaacagagaatgctagatattttgggtggtaatcaagtgtaatagtatgtgattttagttataagcgtgatgagtgcaggaagggagatgaaaaataaataatatttagtgaactccactactacagaataaatatttataatattttctatttcatcaggaagaacaatttgaatcactggcttaatcactggtggggggcctggtttttagtctgtgtcttaaaattcttagctcacttatgtcatttgtcatatgaactttttggagaaagaaatatttagtttttatacgtagtttttaagactttaaaggttttataacccttttcttgaaaaattaagacatcaaatcagcaagtatttattgagcactgaccttggtctgaggcatgtacattttttagtttttagacaacagtaaagtaaccctgaaataatgcctacaatgactttgataagtacaagatggtgagttgaggttttagccaagaacctttgttttctcttgctgaatatttttctctttggttatgtggtagaatttagagctcaaaatgttcagactgtttctgtccaagtagcattctcaccatggtcaagatttgtttagtgatttataattaattagataaaagtacgcaaagctttttgggctttgtactgggaagtgctacataagactgcgtggtagtggtttgggcctcattgcttatatctgacatagcttccaggatttatgcctgtctccaccaagattcttttcctctttaatgaatttgaaagtaactatttatcttgaatgaaattagttttttctacctagagctgggagtttcattttctaatcagaatgtctgatttatttatgtgcctgccaaaaaaatcccaaaatactggccgcctgagttctggctaatgtttccaggtgctctgttttgaaaacattccgtttctaccctgtattacagatgctcttgcgtacagtgaaatcttgtgataaatatttttcagtgaacataaagtatttaaaaaataaacgaatggcagtattagtcatacattgaccgagtgccaccagtgtattatttatcatcatatacaggacatagtccaagacacaatccttatttagtggttctgtagtctaattatctgtaaaatggtcatgtcaaaaaaaaccaaggaaccatcagttgggcaaattgtttgcaattatgattaataacttgctgtggttaattaatgggaaaatatatatggcttctaacgggctgctagtttcacatatataagcagtgtgtattcaaaagaatttataccaagtaattatttattactacattctaggtttaattcttacttgtgttttcaagccattcaaggaaagtgagcacaagtaggtgatagccaccattctttatggtaatattatttaggtcttaaaatcagtcagaggcaaattatattatttgaaaaatgattgcttttcacagactaaattatccttatattatttttccttttttttttttttttgaggcttagtctcaagctgttgcccaggctggagtacagtggcataatctcggctcacctcaacctctacctcctgggttcaagcgattctcctgcctcagcctccagagtagctgggattacaggcacctgccgccatacctggctaattttttttgtatttttagtagagatggggtttcaccatgttggtcaggctggtcccgaactcctggcctcaggtaatccacccacttcggcctcccagagtgttgggattatagctgtgagccactgtgcccagcctctttttttattattttaacatactttgaaaatacttaatacctatctagaccagacctcttttgtaccagatatatttattttggtctagagaaaatgaagacaacgtattaaagttgggtgtacccaatgcaaatatctgtttaaattcagtgttcagattggagttttgtgggcaaaatatttaacaagaattgtatttaacttacctgtgattttgactcacatagacttagctgaaatgaaacatagtaagtacagatttaaatatgtatgtatttgagtagaaatctttccacctgtatgcaggtagttttttgtaataatgaaagaaaatgatttcattttagttcttttatttgatgtgacaggaattgattggttagtcaagaaagttggttaaaagcagggaataaaaatgtgcatccactctctgtatgtgttaaatatttattaatattttaacttttgaaatatatcatgtatgtgtatttgccacttgtttgatggaggttccaggcttttctttgagcatgggttggagtttccatcttttttctcaataattttcagtctcagtttctttaaaggcatttgtgaagaatctgaatgtagagttcttctagattgtaatttccccctcgaccttttacagtttttttcactgttaatcaaatccatctaaaagcattcagctacgtgtccatagagactgcaagtctttttttgtgcacatagcttattggatgttggataacaatatttaattaaggttcttgattatagtaacaggcataactgacacaaacaggtttgagaacaagcgcaattaagcacagaactcaacagatggaagcagaagtgcctgggtgccctagacaatagcttatttgccactagtgttgaggattttgtggggaagtaaagagctctgggctggtgaggctggtaggggcggtcagtgaagagggctttgttttccttgtctgaggcttgtctccaactgaaaggcctcctttcctctcctgtccctgggtgaatctttgctcaagtcccctgtattttcatcacagccatcacccctcccctttccacccgtgtctactgccttttcctctgcagtttgtttctgaactgactgaaatctctgtcagtctccgtgttaaaattcccttcaagactcacctccttagagaagccctgtggatggactatacccagcttttacccttctattgatgatttttgatccatctatatagctttaatgaaataaaacttcaaaaacctgaattttagtattaaatatgctgccactcatataataagtgttcaagtatttctttagccatgtgaacttacattagaaaataatgaaattcttgagatggttaatttttaaagctgtttaccatacctttcttttaaaagggatggaagatctggccttttagaatatgatttgccagccttccatagagtatactattgaagaaagcaagaaatgtgtgtttgcgggattctgttgctcaggctggagtgcagtggctcaagcttggctcactgcaacctccgcctcctgggttcaagcgattcttctacctcagcctccccgagtagctgggattacaggcgcatgccaccacgcctggctaatttttgtatttttagtagagacagagttttgccatgttggccaggctggtctcaaactcccgatctcaagtaatcctcctgtgttggcctcccaaagtgctgggattacaggcgtgagccaccacgcccggctgaaagcatgttcttgaatgtatatgtgtgttctctccccatgtgatttgtaaaccctccaaggcttgggtctcacattctcattctttgaatcttttatggcataatggatagagagtctgtgctcttgtccagttgaagtaagtagtgggcgctcaaaaaatgttgattggccaaaatatctacatcaagtacagtaacgactcatagctgctaacatcttttgagcaattaacatgcaccgtacactgtcttaagcactttatatatgtcacctcatgtaattcccacaacaactatagttatccccatttcacagatgtagaaactaaaacttagaggagtcagatacttggccaagatcacacgaccagaaaatgatagagctaggaaagtagagacaggaatcaaactcagtgagtctgattccagattctgcagccttgactcctttaccccatgcctggtggatcagtaacctttcagaaaatttttgtaacaagttctgaaaacatagatgaaataggaattttcccttaaactaaatggaaaactaaaaaagtaatcattagatggagcagatttctgctaaatgggaagtcttgggagggcctcattagaaaatgagggaatggggggccaagcatggtatcatctgctacccagtgagaaaaatatcgacttacgctgtgaacccttttattttatacatgtaccacctgaatgaggatggtatatttatgagctctcacatctcattgctgggtgacatcagggagctcttttttgggatagctgtccatctgttctcctccaggaactcctggatccgtgccactgccacttggctgctggcttcaaaagagcctgaatcagtgagttgcttacaccagggagaacaaacaggctcttctccttaaagtgtctgtaattatatgaccataattagaaataaaaccttctttatacaatttgagctcacaaggaaagactttctgcatacacaccattttttcctgtgttgtttcacatgctgatcaggaaacaggtcacttggcctaatcatccaccattgaatagagtggagagagccagattccccacaaccccctaggttgctgcatgtccttgaggtagtctcctgccctctctaaacttttgtagcattatgtatgatgaggttagtatagccatgtaggaaatgttatgagaaccttagtgcctgctattagttccttggaaaaaagagatagcctagacataagtaactcatgagtagagactaccagttttggtgcagttagggttttgagtttgttatcattttaaacagtaacattgtttgggtggttctgtggtgttcgaagagatgtaggtcaccgttgatttttgcctgatgggttttgagtttgagtagatgttgattaattcatgagccccaactgcaagatagatgttcagtattgattagacacatgcccctggttgtatgctgttaaaaaggagtcagctgtgaaatactcctaaagctaaatcaataaactactaaagttgttttcccccaataagtgtttgtattttatccctttaagtgagaaaggctgttaggaatttctgtgatctggccgttaagaaaactagctgtatctttggaacaatatgctcatatgttagccattccaggtgagtataaattattcatatatacatcttcgctgaggataacaatggcttaatggaggagaaaacacaacaattttctttgaaaaattgtctttattctggtgacataggtagacaactttgctgagagcacacctaagtactaataaaaatttcaagggattgagacatacatcctcacagagtaagagtttaaaaatgcctacaattggccgggtgcggtggcttatgcctgtaatcctagcactttgggaggccgaggcgggcagatcgcctgagttgaagagtttgagaccagcctggccagcatgatgaaaccctgtctctacaaaaaatagaaaaattagctgggcgtggtggcaggtacctataatcccagctacttggcaggctgaggcaggagaatcgcttgaacctgggaggcggaggttgcagtgagccgagatcgcaccattgcactccagcctgggcaacagggcaagactccgtctccaaaaaaaaaaaaaaaaaaagcctacaatccctgttataatcatggccagtaattgctaagcaattagctgtactattagaatgagtcactaccaagttttctgccttggcaatttttttctgaaaactttattgaatttagaacaatttctggatgactttttttctctcaacatacagacattgaccagtcttcataaaatccactaaactcagcaccttctaggcttgtctttctcctttccttgccttctcttccaaattcctagaatgggccgtgtgaacttcctgactgaccatgccggctgcatcctttaaatctttacagtggcttctcatttccttttgcatctactctggctgttcacgccacacatcagaatcgatcaccagcaggctctggagtctcatttccctcatctgctgcgtgggtctccagtcttctccctccattcattcattttcagttcctctaggcagcaccttcttccttgagccttttctcaagagctatcgttttcttagactctgttctctttttttccttctgttccaagtaactcttgaaatcccgtcttccctaaaagtctttttgaattaactagagagttgctgatgggctcttcttcattcaggtctgacaataatagacctcccatagcttcttcctctaacatccaccccaattatactcacctctgcttcccacttccaaaatgacccttgctcttgacttatatctactgacagaatcccttccctgtcctggttactgtttctaatttagagatccacacaggggtgaagaaagcaggttctgagatgaactgcctgagttggattctgagctctgtcacttgcagctattctctttgggcccattattgaacaatttctgtgctgcacaatttctgtgcctcagcaagactcgagcgtaacactgacctcacaggattgttgaaataatttaagcacttaacacagtacatggcatgtagtaaacatgcaataaacatttactgttatttattaattggagagaatgaagagcacacccgatattatacatatgtacatacatttacatacacacacatatatatatacacacatctgtgtactcatatatagctacataatttggaaaagtatttagaattatatcttttttagaaaatgaaaacaatatatctttttttttcattttttttttgagacagagtctcgctatgatgcccagaccagagtgcaatggcatgcgccaccatgcctgactaatttgtaaaactttttgttgagacgagatcttgctatgttgttgctcaggctggtcttgaactcctggcttcaagcagtcctcctgcctcagcctcccaaactgctgggattacaggcatgagccacagagcctggccaaaaatacatctttttaaatgcaaaacataccaagtaaaattgaacaaaatcctggctggtgaggcaagagtttaaacaagggaggagaagcactgtaccagttgtttctacacacctatgaaagatctggcatgaatggcttggtctttgtttaaaagcatagagcgccatgtgtatgtatggacacttgcatgcttttgagtgatgatgattagggtgagagattttccttaggaaagtttcaaaagtagtcacttatctactcagttttaagtaaatagaaaataattttttttaaaaggatagtgtgaggaagtaattttgtttttaaaaggatagtgtgaagaacaccctaaaaatgtttgtagaagaggattattcagataaatctgtagtgagtttatgcatacctcctttaaaatctatctttagtacagccattatttagcatgaagatgatttgttgcttttgttttccaagttttgttgcttgtaaataatctgttaagaaattttgggccgggtgcggtggctcttccctgtaatcccagcactttgggaggccaaggcaggcgaatcatgaggtcaggagtttgagaccagcctggccaacatggtgaaaccctgtctctaccaaaaatacaaaaaaattagccgggcatggtggcaggcgcctgtaatcccagctactcgggaggctgaggcaggagaatcacttgaacccaggaggcagaggttgcagtgagccaagactgcgccactgcactccagcctggcagacagagtaagactccatctcaaaaaaaaaaaaaaagaaattttgtaaaacatgctgaagggaatcctgggccaacaggtatttttaaaaaataatatactattcccaggtttatgttgattatttatatttgaaaatgttgattgtagatactggtagattactttcaaattaatcatttattcctaattgaccagggatgagtgagatgtttatttagaaaacaaataattttagataggaaaattgaatctttaaaaaataatggtgatttaatatatcaatgtgtggtttttgtgtgtatgtgtgtaatattggagcatccaggagtgtgcggtgtgtatatgaccttatttttctactgtatcttagaggttgccacttccatgggtataaaacttaattggatttctcgatttttattttgtttatgcacttttacaacttatgtcattttaggttgtttattaatgccagttttgtataataaaattattagagaagttatgaaggaggatggcatgagaagggtggccagagtttcactgtttcatgtttgtaactttcattccttttgaagtgtacatttattcctagtgatagaaattgatgttttctttggcaagcattagaagcaagtctatgtgaaattatgtaatgtctgaaaagttatattcatgattaattggcctatccaagaatggtatttgtgtgtgtggaataaggcgatcatgctttttatttggcagtgagttaaagtgcccctgctcagatcgggttactccacagggctttttgactgagaattgtatgtttagcttaatctctaaaaagcgtaaaatgtagcttcggagccaaatatgctggaattcatattgtaaccaaagttaatcttaggataactttaaaagcaagctgttccactctcacaccttagttaacaaataaagccaagaggtttaaaacaacatcatcatcataatagtctctgaaagcacagccagccttcattacccaaagctagactgtctgcactgtattgtcaaatattaatttaaaatcttcttgaccttgacctaaactgataagttataatgatctatttatttatccaagctggactttacaggaatgagaaaaagaaggtctttaaataattgcctcctcctgtgtgtcagcttgagaaattatgacctccattactaatattacagtgatggtgaacttgatagataactagagacagggtaatgcaatggttctaaagcctgactaccctgggaaagttaacttcagtttctcatgtgtaaatggagataatgttacctctcttcttgcattttaatcattaactaaatgcttaccagaatatctgttcatagtaagtgctcttaaatgtttgcttttgctcttaaattattgctgtcgctgcttctgctattactgctatgataactactactaactactgcaattgctgtcaccagcaaccactacaattactattattccagttcctcctccagggctttcactatagggtttaactctttggtgaatcctcatatcgaaatggtaaaacataccccaaacataccccagagttgaatatgagttgttttggcaagatcatagctcactgtaacttcaaactcctgggctcaagccatcctccctcctcagcctcccagagtgctggaattatagacatgagccgcctcacctggctgtttcgttgttgttgttgtcgttgttgtttttaaatgacctgtattcttaccattcaaaaatgtggaccgcaggtcagcaacatcaatctaacctgggagcttgtttgaaatgcaggattttggccccatcctagaaccactgtatcagaatctgcattttaacaggacgttaaaagatgttctgtttgcatattaaagtttaagaagcactgatctacaccatcctccccaccccccagctatcccccaaatcatcttaatgatttagggatggctccctacatagactaccagcagtatcatgtgaaccaggccctcaaagtagatagggcaggtaattggaaagaagagaagatgaagtggaaaaagagaagaaagaagggagagaggaagaaaaaccatgcctgacaatactgatattttacctgtatagatgggtctatgcttactgattattctttgagtctttagattattctttgttgtgacactgaatatggaaaggaatactgaaattttatgggctggtaaaaaatttccatgcccttgtaatttccaatgatctgtcaaacatacatggagagtttcctgttaactcatggtctcagataaattatgcaccctttattttctctttttttgtgagacagagtctcactctgtcacacaggctggagtgcaatggcacaatctcggctcactgcaacctctgcctcctgggttcaagcaattctcgtgcctcagcctcctgagtagctgagattacaggtgcccgcctctatacctggctaatttttgtaattttagtagagacagggtttcaccatgttggccaggctggtctcgaactcctgacctcaggtgatctgctcacctcgacctcccagagtgttgggattacaggtgtgagctgccgtgcccagcccctttattttcttaacacacacacacacacacacacacacaccagtccccttgtattcatgctttagttatctttttagtgtgaagatggtgtgcttcctatgctgatcctgcaagatcactggataggagagcagagtttggtttactactctctgcctgtttggtagtgcttctactgctgtttgagttgattcttccaatgtaaaggctgtgaggatgtatgggaacactaatctttgatattaactatgaattatgggtgcttgtggaggtacagctttatttgtattatcacatactaggggctaaggaaaattacccctttttgacttaaaatatgaccttggagtctgtttttttgttgttgttgtttatttgttttttgagatggagtctctgttgcccaggctggagtgcagtggcacaatcttggctcactgcaacctctgcctcctgggttccaatgattcttctgcctctgcctcccaagtagctgggactataggtgtgcgccaccacgaccggctaatttttgtatttttagtagagacggggtctcaccatattggccaggctggtctcaaacttctgaccttgtgattcgcccgcctcggcctcccaaagtgctgggattacaggcgtgagccactgtgcccagctggagtctattttttaaagttgatttgagaaacaagtttatggtatgattttaaacaactaaattggcaaagggaagaaatttgataaaatatgttggaagtgtgcagtgatacaacctgtcgcaatttaaaatgcctgtttccgttacccagcaatttcacttgtaagagtttatcctatagatgtatttgcacatggaagtgtacatgtgtacatttttatgtagaaacaaatgagtagtaataacatcaatattaattaggatgagactgggactgggttgagaagttgagactgctgcaacttctttttttaaggtgttatttgtgtgtgtgtgtcggggctattaatgaaagtgtcttaatgaatctggttacaataactacctttggagacaggatttgaaggtgttagaccttcaaatgtgagggacacttactttctattaaaatgtctttgtactgtgtggaattttttaagaaaaccatgtgtatgtatacattaaaatcaacaaaatagtgctcacattgaggagtttaaagctatatgtactcgtaattacacttacatatttttcccctttttttttttttttgagacagagtctcgctctgttgcccaggctggagtacagtggtgccatctcagctcactgcaacctccacctcctgggttcaagtgattcgcctgcctcagcctcctgagtagctgggactacaggcacgtgccaccatgctgggctaatttttgtatttttagtagagatggggtttcaccatgttggtccgcctggtcttgaactcttgacctcgtgattcgcccgcctcagcctcccagagtgttgggattacaggcgtgagtcaccgtgcccggcctttgttttttttttttttctttctttaaagagaagttcttgctctgtcgcccaggctggagtgcagttatgcagtcagctcattgtaacttcaaaattctgggcttcaagcaatcctcccacctcagtctatccatagctaggactacaggtgtgcaccactgcacccagcctttcccccatttttaaaacatgtttatgtacctaagctcatttatgcctttgagtccctaaattaggtggtaggcaacaaattcttggtcgcctcactgctctgtattttctctccaactccttagactcttcttagcataaactgtccagtgttctgatgattcagagctgtgattccaaagttggggtaccatcagaattcttgaagattggttacaaattaagattcctaagttaatcccagacctattgagtcaaagtctgtgggtgagacttaggcatgtgcattttttttagaagatccatgggtaattcatcagaatcaggttaagattcttcgcacctggttaaaaagcactgtctggagagcaattcttggtaggaatcttcttctactaaaatgccagctgttatctgtgcacccgcacccccagatcccaggagtgatgtgcatgtggcatatcaccaggctgaatgagcagatcctctacatccaaggaaaagggaatgttattctgaatagtcacatggttctctctattgaattagaataataatggtaatgacagagatgataccaaataagatgtctatgttagaaccaacattttctgccaataacattacaagtaaataggagaaatcaagagttggtcctttgaaacatcaataaaatttagaaatctgtagctagactaatgaaaaagaaaaagacaaattatcagtaacaggaatgggagaggagatagcattgaagacataataaggataataaaggaatattatgagcaagtttatgctaaaaaattgggtaactgagatgaaatcagaatttgtggaaagcccaaattaccaccaacacacaaacacacacacatgcatgcacacatgcacaatctgaataggtctatagcgagcaaagaaattcggttcataatttaaaacttagctacaaagaaaactccagactcagacaactgacaacataatagtgatgaaatctatcaaatctttaacaatacaaatgttaaattctttcagaaaatagaagaggagggaacacatcccatttcactttatgagattggctttgctttcatactaaaactagccaaaaactggccgggtgccacggctgtaatcccagcactttgggaggccgaggcgggcagatcacttgaggtcaggagttcaagagttcaagaccagcctggccaacatggcgaaaccccatctctactaaaaatacaaaaattagccaggcatggtgtcaggtgcctgtaatcccagctactcaggaggctgaggcaagagaatcacttgaacctgggaggcggaggttgcagtgagctgagaccatgccagtgcactctggcctcggcgacagagtgagattttgtctcaagaaataaaataaaaacgaaacaaagactttgcaagaaaaggaaactatggaacattcctcatgaacataaacacagatttttttaattagcaaattaatccagaaatatataaaaaggataatacattttgagttttacctagaaaagggtttatccagaaatacagttgatttaatattgtgacatgaagcaaatatatgatcatcttattaagataaggaaaaacaatcaacaaagctaaaaatccattaatgatataaactcttagcaaactaggaatagaagaaacttttgtcaacctgataaaagacatttataaaaagccatatctggctgggcatggtggctcatacttgtaatcccagcactttgggaggcggaggcaagcagatcacctgaggtcaggagttcgagaccagcctgaccaaaatggagaaaccctatcgctactaaaagtacaaaattagctgggcatggtggcacaagcctgtaatcccagctactcgggaggccgattcaggagaatcgcttgaacccgggaggtggaggttgcagtgagccgagatcgtgccattgcactccagcctaggcaacaagagcgaaactccatcgcaaaaaaaaaaaaaaaaaaaaaaaaaaagccatagctaatgtcattattaacagtgaaagactaaatactttcttcctaaggtcagaaataagacaagaatatccccctttcatcatttctattcagcattgtactggagtttctagccagtgtaacaaggtatgaaaaagaaatgaaagtttgggaggaagaataataatgtctcttacagtattaagtattaatgataatactaatactatgtcttacagcatgcagattgagaggaagaactaatagtgtctctagttttagaccatatggtcatctatatcaaaaatcctaaggaatctttaagacagctgctaaaactagagaggatttagcagggtcctaggatacaaaatgattatttttaaagttgcatttctatatggtagcaatgaagattcagaacctgaaataacatttacaatagcatcaaatactatgaaaatatatacagataaagttagacaaaatataggcaaagcctgtaccccaaaaactgtaaagcattattgaaagaaattaaggcagccctaagtaaatggagaagtgtcccatgttcatagaagactgataatgttacaatgttagtacttcccaaactgatttatagagtcaaaacaagcccagtaaagatcccaaaaagctttttcctaaaaattgggacgttgatgaacaaatttgtgacaaaggatttgaaatagtttaaaaattttttgaaaaagaacaacaaagttgaaggactagttcagtgggaagaagaaaatctcaacaaatgatcctggaataactggttatacatatgggaaaaaaaatgaaccttgacccttatctcacctcatacacaaaaatatactaaaaatggtgtatagacatataaaaaactaaaactataaaactagaagaaaatgtaggataaaaccattgcaactttgggatagataaaaatttcttagattgaacacaaaaagtagaaaaatcgataaatggcactttatcaaaattagaaactgaagtttttccaaaagaaattggtaggaaaatggaaaggcaagccacaaactgggagaaaatattcacaacacttatatcttatgtgttatatacatacatacaaaggacctgtatccagtatatgtaaggaactcttacaactgaataagacaaacaacccaattaaacaatgggtgttacaggttgtgttcctcaggaagcagctacggataaagctcaggtatgggatatttagtaagggatgcccttggtattaaggcttttgagaaggagggcaacaaagcagcactggatggagggagatgttgagcagtgatgcggcccaggaacagccttggatgacttcacagattgctctgaagctggactggaccttcggaatttccctgagttgggccctgatggtgcctttttatttctgcatcactcagtaatgtgggcctgtatcactggatatggcccatgctaggaaggatatatcttggccagtgtgattctctgcagcttgaggcaatccctggagggagtgatagctgaatactgatttcccatagcattcttagctgagacaataggtttttcactgaaagaggatctgacaatatattgcagtgaccattgtaatgggcaaaagattctaacagaaactgtacaaaagaagatatatgaatggccattaagcacatgaacaacgtcattagtcatcaaggatatgcaaattaggccgggcgcggtggctcacgcctgtaatccagcactttgggaggtcaaggcgggtggatcacgaggtcaagagatcgagaccatcctggctaaaacggtgaaaccccgtctctactaaatatacaaaaaattagccgggcgtagtggcaggcgcctgtgttcccagctactcgggaagctgaggcaggagaatggcgtgagcccagggggcggagcttgcagtgagccgagatcgcgccactgcactccagcccgggcgacagagcgagactccgtctcaaaaaaaaaaaaaaaaaaaaaaaaaggatatgcatattaaaatcacaatgagacacttccatacactcgaatggccaaaattaaaaacactgataataccataccaagtgcaactggaagtgtaaaatggcacaagcaccttggaaaacactttgcctgtttcttataaaataaacctacacttaaccgtatgcctagcagttccactcctaggtatttacccaagataaatgaaaacatgtacacaaaaaagacttgcatgaatgttcatatgaagtttattcatagagccccaaactgtaaagaactcagatgtctgtcaacaggtaaatggataaacaaatttagatatattcataaaatgaggcactgagtaacattaaacggaataatctactcacacatgcaacaacatggatgaatctcaaaaatatgtcaagtgtaaggttaagtcataaaagagtacggattgtatgatttcatatatgaaattttataacaggcgaaactaatctgtcgtgacagaaagcagatgagtgattgcctgggtctgaaaagggaagagaatgcaggaaggaacattttggggtgatgagagggatttatgtcttaattgttaggattattacatggatgtatcatttgcccaaacttttgtttttttcttttttttgagacggagtctcactctgtcatccaggctggagtgcagtggtgcatcttggctcactgcaacctccgcctcctgggttcgggagattcttctgcctcacctgagtgagggattacagccaccacacccagctaatttttgtatttttaatagagacggggtctcaccatgtttatcaggctggtctccaactcctgagctcaagtgatccgcccgcctcagcctcccaaagtgctgggattacaggcatgagccactgtgcccgccggcctgcccaaactttaaaaggttgcgtgtttttgcaaataaattacacctcaatgtaattatacttaagtaaaggtgagttgttttttaaagtaaaacttttcataatggagattattttcatgaaggatattgactgcacttttaattttcttttcttataatgtcttcatctgattttggtatcagaattatgctggcttcataaaaccaattgagaaatatttcctcctcctctattttctgaaatagatcgtgtaaaattggcattgtgttcttaaatctttgaaataattcaccgctaaagtcatctgggcctggtagttcttctagggaggttttaaataatgaatcattttctgtagtagatttagggttattcagattttctgtttcttcttgggttagttttgataattttgtctatcagtgaagtccatttcttatctctgttgtctaatttattggcataaagttgttaataatatttcccattattttaccgtcttaatggtctgtagttatatctctactttacttcctgatattggtgatttgcattttctttttcttaatcagtctagttaggggtttctaatgaagttaaacatatacccatctaatgacccaggtgttccactcctaggtatttaatcaagagaaatgaaagcacatattctaaaaaataatgttcatagtgatttttaaaattttagccctgaacttaaaacaaatgctaatcaattatagagagaacaaataaaattttgtatatttacagtaaaatactactcagtgataaaaattaatgaaatactgacagatacaacaatgtatgtgaatctcaaaaatattgtggagagtggaagaagccctacataaaaaaatcatagtgtctgagtccacttaaatgaagttccagaacagacttaatcaaatcgtggtggtagaaatcagatttgtgattgcttaggaagggaagtggaaaggtatgagcagggaactagcaggagagaactttctgggttatggagtggtctgtattttgataggggtgtgggttaccagtgtatgcatttatttaaagctcatcaaactgtacatttcattgtatgtaaaatatggctcaacttagttgtacaacaacgggaatgtagtcagtgccacttaactgtatgcttaaagatggttaaaatggtaaattttatgttatttatattttgccacaattgaaaaaaaaactgtttgtttgttatatttggttttttttgagacgagtcttactgtgtcgcccaggctggagttcagtggcacgatcttggctcactacaacctccaccccctgagttcaagcagttctgcctcagcctccctagtagctgggattacagccgtgtgctaccacgcccagctaatttttgtatttttaatagagatggggttttgccatgttggccaggctggtctcgaactcaagtgatctgcccgccttggcctcccaaaaaagtactggaattatagggatgagccaccgctcccggctgaaaaaacaaaaacaaacaaactaaaaacaacaactgtaaatgggaagatgtgaaggttctaaatgtgcaaacatttaaaatgtgtatttccccccataaccgtgtgctgttctattattatttatttaccatttatatgctaaagtaagaatgtaatttagaaactgataagaaagtaccaagtatgagaaatgttacattcgtatattcaacagatattaatcaaacatctactgtgtgtataattctttattatgtatagtaattaagataaaccaaacaaggatcttccaagagctcaccatgtactaagctatttaagatatgcaaaattttaccaatgtcaccaaaataatgggctttttcttccttcttcctacagtttacccttagtaggctttctactgtttacccttagtaggctttctactgtttaccctagtaaagatctaggaaattaagtttaaaatcttcaccctcaggggaaggccttgtcatgcctggtatttcttctcctggctttgctgcagcttgtattagtatgcagggaggggctttggttttgtgcagttccaacacaccttacagtgaagctgtggtgccagggagcagagtctgtccaagataatgctcatgtaagtgcccagggtggtgcctggcctaaagcataaggagatttagaaactctgccacaaagggggtctaagaatgagtcttctgctacacagaattaactccaaaaaacaaggtcagagctcttgaccttcaggtagtaattatccacataatcctcttttcctactgcttatgaatactgcaattgaaagggtcagaggtagtctgaaagcagggaaaacaaaagaagtcaggagcatggaaattctgcacaccagatggtttgtgtgcccagagggcaattgagaattaagtgtagtaatggaattacactacttttattggttctatgaggacaagcacttggagtaccaattatattctgcgtggcatactttgggtgctgagtaaatattagtaacttattgaatagcacataacatctcaactgccatgtaaatctctgtgagtgcagggcattgtcagaggtggtggtgataatattattgagaaagtgactagtgtctgacttttctagcttgttaataaccacttacctatgtcccatctcctcattctactttcctgtttggatctaattacattcagttgagttgcctgtgtctcctgagcagttagagcaggtttctcttggcaggattaatagtaagaatgtctacattcagttcacagtgtgcctaggcagtgttttgtagcaccatatctaaattaaaatgaatgccttggggcaactgcagaagctcctagctgcctctagctgatacacagctctactaagtatcagctcttgcttgtgtttcttgtaaattgttgttatgcctatcctttaatctatgcattactattttgcttctagcctcacttggaaaacattcccaagtcatagagatgaattacaatacagaatttctaccaatggcagtacttgcattgttttcagaatctagtgcccaggttttcctactgtttttcttgccgtctttaagacagaatttctatttacatccttgtcgatttttgtatccctaaataaattatagtcttgaagtctggacctgctccagtgaaggttcctacagcactgaagttgggaatcactagagaggcactttgttaattttctttttaaaaaggaatgactaaaggtttgtgacacttgaatgtaagttgattttaaaattccatttttctaaatccagagtagggtttatattgctaatatcatgatatgcttgccaaagagaatagtttgtaaatcctaaacagacttcctgtaaccatgtgttgaatttccagctgtgttgaatcagactttggtccctcttcagaagataaatccaatacctgcagtttctaatggcagaagtggaggagagaagtccctgtccagataagaaactgaaggccctggggcaagcaattgtttcatgaatgtcctttccccagccccgcgccccacccctaagaaatttgtaggcttcatctaccaggaaaacaaaacaaaacaaaacaaaaaaaacaagaaaacacacaccacacaaatgagatgctattgttaaatgcagtatgtaggattagatttgtttccttccaatagaatcactttccttaatcagcacttttataaatggcacacctgcctgattagaacaagttctagactacaggatacagtgtgagcatttcaattaagtccacacaattaaaaactgttgtggttgatgttcttagaaagactttccttctctcgtcttactccgttatggctaagctttattattttatacttctgagtcagcctttgatcatgggactttcccactgtgtggtcatttatatctttttttgtttctaaatgatttctttaaatgaaaaaagaagcgatgtattttagggatatatgtagggatgcttttgaatatttttattttattagattttcctgcttccttactgtcacttaaaatatggagaaccctcatcctgtgacaaggaggtaaaaatacagcagtcacattcaagatctccatacattaacaataataaatccttttgccctgagtaatacagatacttaatccacagagctcggggggatgatatagtgctccctcacagaaccaattacccacagagaagtataatgagcaggggaggtgatacaataaaaatctatatagggagagtagaattatgatgacagtgttgcctgtgtaaagtcttatagtaagtatatctccaattatcttttagaaaaaaattgtttggtgtctacttatgtccaattcatgatgaaattgcaagaatagccatggaataaaacaaaagggtacaggagtatagagaaaatggcgatagacttgtcgtaaacagagttctgttctaccccgaaggatgtgaagtagacccagggctgctctgagggagtgctgggcatgaacctccctgcagaggaatggctgtcctgaccacagttactgttactgcagatgcagacgggaacaaaataacgctctggaaaaaaaataagatgatttagatcatcacaggaaatccctacttttagagttagtgtgtttccgaagaccatatctgaagcagattgctgtgagggaaaatcctgagtgtgcatgatctctatcctaattaggagcaaacttgatctgttccgacagacatcagttgcataagtgggttaagtggcaagaaataaagtctagttctttattaggtaagtgtcaaatagagttctgaagtagcaaacaaaaaaaccttagtaacaacaggaagcagttttcagcctttgttgcagtgccatcagttgtgaagtttgtggacaataattcattaccagtaataaggcaccaaaatttgtaaaatatttttcttttaaaaatagaccataacaggccagacatggtagctcattcctgtaattccagcaccagccgaggcaggtggatcacttgagcccaggcgttcgagatcagcctgggcaacatggtgaaacctcatctctaccaaaaataaaaaaaaaattagccagtctcaaaagcttgtctcaaaataaattgaatagattgaaatgaaaattaaatttaaaaagactaaaccgatacatagtcttgttataattttgttaccattgcagtgtattcattttacttggcttccttctttttctttttttttttttaatttttaatttttgtttcttttgagacagaatcttgctctgttgcccaggctggagtgcagtggcatgatcttggcttgctgcaacctccctctcccgggttcaagtgattctactgcctcagcctccagagtagctgggactacaggtgcgcaccaccatgcccagctcatttttgtattttttaagtagagacggggtttcaccatgttggccaggctggtctagaactcttggcctcaaatgatctgcctgccttgtcctcccaaagtgctgggattataggtgtgagccaccacgcccagcgaccctttttttttttcttttaataaccttgtattctttgtagagatggaaagaaatagcgggactggggagggggagtgccaccacaactaggtgctggcaactggtcatgctccaaatctgtcttatatagtgactattacaacctatagtgactattactaagcaagccctaatagtgaatactgggcagataattttcctcccaactgattttaaaattttggtcccgtcttgtcagtttatgcccagggaagtatatagcaaacataaatgtcgtttattatgtgtgtcagagtaaaaaaggtttcagattagacaatggtggaacccaccttgccattgatggtttctttacatgtcgtgtttgtggtcattgaggatatacatgaaaataaaagacagttgacaatattttgggacctgtgaattggagaaaccagttcccaacttcagagcagtttattcatttgtttattcatttattcaatagatacacttttgaagctggggctacagcaatgaacagtctctgccatcatgatggaacttatggtttagtaagggaaacagacaaataaatgatatgcaatatttcagataatggtcagtgcaatgaagaaaaataaagccaaggtatggagccgagcacagtggctcacatctgtaatcccagcactttgggaggccgaggtgggtggattgcttgagcttaggagttcgagatggcctgggaaatgttgcgagacccccatctctatgaaaagttaaaaaattagctgggcgtggtagtgcgccagtatagtcccagctacttgggaggctgaggcgggaggatcacttgagcccctggagatcgaggctggagtgagctttgatcacgcccccgctctccatcctgggtgacaaagtgagtggtgtctcctaaaaaaaaaaggtatggagattctggagtggtgccagtggagtacagtttcagagagggatggtcagggacagcctttctgctgaggtatatcaagctccaagtgaaaggagggacaaaccatggggaaagccagagagtgaagggcttggcatcagcaggctggaagttcctccatctcactagttaggtgaccttagagaggtggccttgtagcatggcattcgtatttgggacttgggaaaagcattgtggtaaacagcaaagcattacctaaacttcacatttcagtacagtgtaacaagggagagcaaactaaagagacacagaagagtctttttttttttttaagatggagtttcattcttgttgcccaggctggagtataatggcgcggtcttggctcactgcaacctccgcctcccgggttcaagtgattcttctgcctcagcctcctgagtagctgggattacaggcaccatgcctggctaattttttttttttttttttttttttgtatttttagtagagccgaggtttcaccatgttggccaggctggtctcgaactcctgacctcaggtgatctgcccacctcggcctcccaaagtgtggggattacaagcgtaagccaccgtgcccagccagtattcatctttgcttgcttttgtagtattattcatttaagattttgtatttgtttatgcttttctttctccaacatctttttcttttcatttagtttgagttttccttttattaaatagttgcaggccttttggctctcagtggaggcattttctactctgttcctgtactccctgattaattcattctttaaaaaaatcctctaagattaatattcatcatgggggctcagaaaatgaaagtcttttatagagtaattctaaactccagaataattcatttgttctgatgcttattaaggacttgaagttgtttgtttgctctttctgtttttatagccaaataaaattttgcaatactcataataatatttgagtagaactttgtagtttacaaaatactttccacactcactcacatttgaactttaacaacccgagagctagacaacacagacactattgtgcacttttacagatgaggaaacctgaggcttagagagcagcgtttaaatctgggtctttctgtggtgcaaatatgaacatatgaatgaaaaatgctgaactgttttgtttttaacacttgggattactaaaatggtatgtttttttaagcagtctcatgaaagatgtagatgacttaagaagtatggatctataggggattatggagagagagggttatatgtccctgatcattgtgaacagataccatggaaatggcttacaaaacccctttttgtgtcattgtcaggaggaggatatgaatctaaatactcctggctctgattttgtgcaggaattttcatttatttttgtccagttacttagactaaggctaacaaatatatagtttccttctgggcagaaacagaagtaatcacaaagtaaaataaagcttcttaaaaatgcattgtcctagatttaaagaatgtttccttagaaaatgctatcttattttgagatcaaaggtcttgaagactcttaaaatttctaaagtattatagaatcaataaaaattagaactgggaaagtccttagagattaactctagaaccgttaaaatatttgatctggaaggaacctttgaagagtcccagatccccaaattgtgtgaggtgaaattgtatactgttgtgtcctcagcatcctgatggggcccatccagtctctccatggcctcttgattataggggcctcttattgcctcaagaataatccattccacaaatactgtatgatttcacttatatgcgatagctagaataatcaaatgcatagagacagaaagtagaatggtgttttcctgggctgggggaagagaatatgggaaattattgtttaatggatacagagtttcagttttgcaagttgaaaagagttctggagataaatggtggtaatggttgcacagtattgtgaacttacttaatgccatttgaaccacaattaaaaaaataaaaactaagcaaatgaagcggaaaaaaaaaagaatccattccattgctggacagctgttggaaaggctctctatgatgactcctattggtgtaagttttgtactctgtaaccacaagaacgaatctaaccctttcacctggatgaagacacccagcgagtccaccccagtcttttaaagctaagtagcctttgttccttcactaggtcataatattttgttttgttttgcttatactttgtttgaatcatgatcaagatatggttcacacattgtgattggctgatacgccctttaaatgtctattaatctagcgattcttctgtatctattttttgctcgcctattcacttggtctcctgtttaatttgttgaagaaactgggccattttttccgtagtgttttggtactagcatctccccgctctatagattaacatattcctctgtcctctgtatttcctctgagtcggtaatgggcttgagagaccttgatttataaatgtttgtagtccaactactgtcatcctttggcatctgtgggggattgggtacaggacccctccctcacccctctaccaccactgataccaaattccatggatgctcaagtcccttatgtaaaatggtgcagtatttgtgtataacctatgtacattctcccatatactttaaatcatttctagattacttacaataactaatacaatataaatgctatgtgaatcattctattgtctaggggataatgagaagaaaaaaacatatatgttcagtacagacaaaaccatcctttttcttttcaaatattttgcattcatggttggttgaatccacggatattaatcccgcagatatagagggcctactgaaaataatgattcagtttagatcttttttgagagtaaagggacacaattttatccccccccccccaactttttgtttggaaaagttgtaaagatgaggaaaaattatagaatgaacacccatatgccttttacatagaataatgtaatgaacacctatatgccttttacatagactccccaactgttaacattgtgtcatgtttactctctctctctgtgcacattaacatacgaacacccttaggtttgtttttttctgaatcattggagagtaagttactctccaatcataacactttactcctaaatttcaacataaagacatcataacactttactcctatatttcaacatatatctgctaaaaacgaagatattctcctacataatcagaattatgttcactcaagaaatttatattatatctagtttatatattgcctaattctgagtatacattaccctaattatcccaataatatccttcatagctgtggatattttgtaaaagtccagaatccaaccacggatcacagattatatttatatttagttttcatgcctgtttagtcaccttaattggtcctgccccctgcctcccttcttttgagaaacagggtcttgctctgccacccaggctggagtgcagtggtgcaatcacgactcattgcagcctcaacttcctcagctcaagccgtcctcccacctcaactccccaagtagctgggaccacaggcatgcgccaccatgcctgcctaatttttttattttgtagagctggggtctccccgtgttgcccaggttggtcctgcccttttttgggtattatatgacattttttcaagagtacagaaaagttgttacagagaatatcccccaatttggatttgcctgattgtttctttatgattggactcaggataaatgtttctggcaagaatactatataggtggtgctcagtcctttaggataggcacttggaaggcacatgatgtcactttgtcccatacttgtttataaagtgtccaccagatttctccattgtaaaggtaccttttccccatggtaattaatacataatccatggtgtttagtggttacctttttaatagttttaaaaaccatatgccattggtcatgggagaaattgtatggaatagattatgaacacattagtaaagagttattgccactgatggaaagataattttagacatttgttattctgaggaatggaggggaggtagcaaagtaagaaatgggctctcatgaagacagacttgtgtttgagtacagctctacacctgaacctatgcaaccttaaaaatgttacttaacttcttagatgctcaatttcttttctaaaatagagataatactcataccgggcaagattgttaagatgattaaatgagatagtgcaggagcagcctgtagcctagcagctgccccagggccattgcatgggagacaaggagatccttccagagcacagtttgctggatgtattcatctttagacttattcatgagccttccttcttgggattagtttaaaatattcaggcatgttgttgggaaaatgtgatcaacaggttaggtgcctttgtgaaatttcaaagaaaggaattaagaatttggagatttttggtatcattttcagacatcttaaatataacttacctgtagtagatttgtatagaatcaaattgccatttactcagacctttttctgactggaatccattttactttattataagggatttttttaaacacagtttatatgtagtctgattgagaacagtgaatcataataatcctgtgacccatttacatgcgttactgtaaaagtttcatttcgtacaagtgacaatttttaaaagttaattagacttggctacacggaggttagcaaaaagtgctttgaattatcaataattcagcagggcagacatttctgtataatgcagtggttttatagagtattgtgagatagttatccttaaaataaatggttgtgagcatacatcagcatggcggggttcgcttgaatgtagcgtgaagtgataacatctatgctttctattattggacagagcgcgggacatcagtctttctggccatgaactactagcaacctttgtcctttgtgttacctttagttaaaaacgaaaaatgagcatgaatgctggctgatggccatgtctctctcacagctaaaaattcatctgggaaagaaaaatgggtttggagatttggatttgtttcattgcatgaatgatatgtgacattctgtaaattatttatcagtgcaaggatgacagcagtagcttgaacattgttatatcaaatgaaagcaggaatcccgttagtaagaggaccgggttttagctcaaatctatcaggggaatgttgtcactttaaagccagattgttcttttaattgctatttaaaggaacaaaagtgttcccaaggtactgcagttgagcagttgcaagtaataactatggatccataattatgcagtgctgattatctggcatttaaaaaactgtggctacagtcagtgaccaatttgttatagcttgtctcttttcgtttttctagtacagaatgttttataatctactttttaactggggctacagaaatacatttgcatagctacctcagaacgtaaagcctgtgcatattataagaacaaattaagctgaaagtaaagggaagataatgaatgcccttgtaagatgagatttgcagtcatattaaacaatttgtgaatgtttggtcatgagatggttttttgtttttgatgacatgttgtcccaaggaactaaggcatttgttggaatcattataaccattgattttttttgttcttaactagcatatatttccttcatgtattcagttagcagatatattttgagtgcctactatgcaccaggaaatgcattaggcatttgggctagagtggctgaacaaatgaagtttattctatgctgatgtatatttagagagttagacctagcaaaatcttgtttttaatttacatttaaaaacatttgtgattatgttgggtgttcttgctctgaatttttgattcatgagattcaaatatagagacatcatagtaacattcagatggctagcagacaacatgtgtgaaggcttggaatatgcggtaaaattacagttttcgtagttttggctgttgaaaataatgtgaccagatctgtaggcactgtcagctattcctatggatgggaatactagcattgctgatagtagtaaataacaatggaaatactaaaatgtatgtagatttatacattgttaaaagcaattttcatacgagagttaaagggtgctaggggactagacaaatgttttgttgtttcttatataaagtgggaatgtcaggccgggctcggtggctcacgcctgtaatcccagcactttgggaggccgaggcgggcggatcatgaggtcagaagatcgagaccatcctgaccaacatggtgaaaccccatctctactaaaaatataaaaattagccgggtttggtggcacgcgcctgtagtcccagctactcaggaggccgaggcaagagaatcacttgaacctgggaggcagaggttgcagtgagccaagatcacaccattgcactccaggctggcgacagagtgagactctgtctataaataaataaataaataaataaataaataaataaggtgagaatgtcagagattcaaggtttatcttttttgtttggtatggtgtggtttacttttgaagaccttcgtggcacaaaagccttgttaataatgaccttttcaagtgtcccacagaatcctgctcattctattattctgtcacctaaaaacatatagatattttatgtcaaatatttagtaggtgaataatagcaatctgcgctgcaatatttaataaagtcttaacagtctatacatgatattcatagactataatgctgaacgaataatttattttaagcatatagataatagaaacaattgagatgtccaatgaatccttaattatgttcatttcaggcaagctatataatatataaaggtattagatttcactggtttaataaaaatgacttctgagtcatacattatactgaaatgtattcaggtagtactttagtgtcaaataatttaagagatttatcccagcactttgggaggctgaggcaggtggattatgaggtcaggagatcgagaccatcctggccaacatggtgaaaccccatctctactaaaatacaaaaaattagccaggcatagtggcgcgcatctgtaatcccagatactcgggaggctgaggcaggggaatcgcttgaacccgggaggtggaggttgcaatgagccgagattgtgccactgcactacaacctggcgacagagcgagacttcgtctcaaaaataatataagagtttttttactagcagaaagtgtttatttaaatacgttatttagcagtttttctttgttaaagaaagaagaagctttaagtgaaaaatgtaaaaagcttttgattttaatgtttttacttttgaaatggaaaagtgacagtattttttattttaattttgtcatagccccgtgctgatcccattccaatatgtagcttctgtttggggactaaagaatcaaatcgtgaaaagaaaccagaagaactcctctcttgtgcagattgtggcagtagtggtaagttgtgtttttcctatgtgttgtacaatgacttcccattatcatagcttcatgctatttgtctctctattaaaactgtattgttatttaaggcagttatatggtaatagcataggctttaaattttaaaagaaaaagtaaggaatagagaaaaaagcgtgagtatgttagtactgacatatggatattatatatgcttatataatactatacatatttatgattaagcttttattttataccagcattggtaattcagtgtggagatgtctgcattataggtaaattccatgtagagaattctaagctttcaagctgagtacaaccccatctttaaaaattaatagcaaaaaataagtaaaaattaagctttttctgttaatcttcaaattttttccccagactacccaaacttttttctccaaagtcttgttttaaaattcatgactatttctctagttatagtaatctctaaaaaaaaaaaacaaaaacaaaaatcgacagaacaccatagctaattcttgtttgggaagtcttgagatatactggctaggagcaaactcaagagccagccatagcccagttcctctgccttgagttagttacttgatcattctgagcccctgtttcctcattagaaaattagagataatggcagcaccatcctcttgggttttatgggaatgaaatgtgagggcacaagtaaacaccctggcacaaggtctgcagaactatggtaagtgtactacaaatgtcagcagtgttatggtttagcatgtttgatattgttatccttgattgctgcacgtaatttaaaatcttatcatcacttatgacagctgcttgatggttgggtagaagaaatgtttcatgctgaggaatgacagtgttgtgtaatgattcttattccttatatgaaggtttaacgtgataggccctttgtggttcagcagctttcaggtgctgactagaagggagagccttggaaataagacatttcaaaccctgcttgaaaaatgcattctgacagtctttttgatgggctttacagattcattaaaattcttttacctggccatggcatcatggatagtgacaaaagggcatggaaacattatctgtacgttcagtttaatacatttcagccccacgatatccctgttttatgctggtgaggtagtgcctcactcatcagttctgactctgtcgttatcttttgggttttctcacgaggctcattctgaatgaattattcttttgtgtaactgcctgatcaatttagtggtgttcacttgtctagggtttaccctttgtggcttttaaggtggtactttaaaaacacccttccctgtttttatttctttaggatctatttgtctgggtgcctagacagattaaagatgtacttaaatgtgggaagaaaagttcccttcatatatttccttacctctggtgatacacttacttgagttgataagaagttcgagatcattatcttctagatcataacttcaaggcctccttcacagggtataaaggtgtaattctaaacaggtagatcttagattttctgatgtaatcaatctccctttgtctttcccggattgaagacctgccagaggggaggttgatctcctttatgtttgaggtcactgaaaatttctttcccctggtgtttcttacttttcgctcagactttttcagggtaaagccaggggtgtttaggtacagtgttatgttttctctgttcaaaaatatcctcttgttttctcttttaacaaatggagaataatgacttgaggatactgtccagagggtttatgtggctggtgtggttttgtgagccagtcttcaagtggagagagccagaggctttggggccaaggtatgggtcatggcagaaattcaagccctggggtcaccatgtctctttgttggggataaaggatgcctcagagtgcttctctggactctgcgatgggatccggctctagtgttgaagttcacttaatcttcccttgagtgtgctgtgccagcctggatttggctgctttagtcaaaaaaactattgttcctaacgcagggaaatgctttgtacatatttattcatctgataaatcagaagaatagactttgttgttttttcctctttaaattgaagggtcaaaataaaatatagttcattttagggagtttgggggttcttgtggttctaaggctctgttttgacaccttggtaattctaaggaaaaaagaaaacaataggccagcatacctcaacagtgtcctcaaataatggcgggagccctgttgtcacagttcagcatttcaagtgggaattacagattagttgggactcctagttgaccttatggaaatggctgccttctcactctcagaagagtctattggttctgggattgaattgagaccgttcataatgttcaaagggatcccaaaatgtaagttgtttatgtgaaaaaatacccatagcagcataaaaccagaaaaaggaaatatagatggcagcctgtggggaggatcattcttaaatgtgtttcccatatgtgcctgatgcttttcagtcgtccctatctgaagtaccattcatatgatgtcacatttagactccgcttagatttcatagatgagagtaataaatgtatccttctgcttacatcataaagtaaagccaattagaaatttatctgtttttaaaggggctcgatgctttaaatgggcagtattttctttaacagtttttttttctactaaaaattctttaaaaaaaaaaatcattcaagtttatatgtagtaaaaacgtgaggtgaggtatgtagtgcccggagctctgaatgtggtgtccctagcctgggttccagttctcttccgccacttgctgggtgtgtaactttggttttcctcatctgtggggtgtaaaggagaatgtctgcaccctccatccacagagctattgtgggatccagtgagaaaatgataggaagatgatcagtaactgtaaaacatgagacaaatgtgaaggattattccagccactaatatgaatgtgggaatcatcagatagtctaggtctgtggaagtgttagaaatgattttacttgactttcatggatcagcctactttgaaattaacactgttatattctctttgcctcattaagaccaaattatctttaattagcttcacataagtattagatattataccaaatgaaattttgtgtctgctgctcagattgctgggtggttaaatcttacttacagatgagttgtgtgcatgtgtgttttcaaattagcaaatctaagataagtgtacagttcaaaattacagcatcattctaagtggaagctcattgaaacgggagacagaagaaaggctgctgtgatgcagctgggtgagtgagagaaatcccttttgtacaataaagggagcaagagccgtggagtagaatatcagtgcaccctcgggagacctgaagtcttccctgggtttgtctttatttgtgtgttaaccctgaacaaaatttgcatgctcatggagggaactggtaggggcagtgtgtggatatatggacatataaaaatattttaaaagaccactagtttcttaaggtcaccccaggagttggttgcttagtcatccagtttcacattgactagatgcagattgaatcattaggttggaaagaagactcttgactagaaagaaacctaaagatatgatccaaagaagaaaagaggccaggcgctgtggctcacgcctgtagtcccagcactttgggaggccaaggcaggtggatcacctgaggtcaggagttcaagactagcctggccaacatggtgaaaccccatccctactaaaaaaaggaaaaaaaaaaaattagccgggcatggtagcgcatcctgtaatcccagctactcggaaggctgaggcaggagaatggcttgaagccgggaggcggaggttgaggtgagccgagattgcaccactgcactccagcctaggtgacaagagtgaaactctgtctcaaaaaataaaaataaaaaaacaaagcagaaaagattgggggttgggggaaagaaggtgagccccatccctgcaaaagcccaaagcatgattgaccatccaaagagatgtaacttcactaaaactgtgcttgtctgggtaatagtgacctctttgtagcaaaatctaatgatcatttttaagtgtttatcaaaatctaattggtatcttttaatccacaccaaataatttctcttagtcatatttgatcttgtagagaatcttttttcttgaagtgttcttttcctttggcccctgtgacaccatattatctgtgttttttctctaccacttctttccacatatttttgttagccccttggtcctctctccattccctaaatgtttcttcagatgtctgtcgtggccctgtgtttgttactttgccttgtagcttctactgagcttctgaccctagatacaaataactatagagcttttccaacgagtctacccccgaggcacctcaaagttaatatccagaacagctcatcaaccttgcactgcttcctccacccaaaacaacagccacaacaataacaacagaaatcccagcaaacaaacagtatcccacctctcctggaggatttcctatattcagcaagtggcacaccgttcgctactcactcagttacacaaactagacatttggagccatcctctgtcctattctttcacaccaaggaatcaccaaaaacacattgattctaaatcataatatgtatcttgaatgctaaatttatcgatgcatccccaccagccagccccactcagatctgctgttataatgacctcaatctaggcttcaccctttttcctccaatccattttccatactatagcctaagttacctttttaagttataaatctgatcacataatttcataagtggctatcagttgctcttaggagaaatccatattctttaatatagcccccaaaaacttctggattgggctctggtttaaccccatcttacatcactattctgttcacattctgcacattggttacattgaacaacttctctctccttggatatacctcgttcatctctccctctgttcatgccatcttccctgctcttcccctcttctggtcccatccaatcacattcatcttttgggtctcttttttagggaggcctttctctaacttcctgctagattctcccatatccctaagccaccccattgtaaggcattaatgctcattcttgtttaatgtttgtctttcctgctgggctatgtgatctggaagggtgggaaccatgcctctccttttcctcactgtatccagtgctcattaaatattagttgaagggaggagagatggacagatggatggtcaggtagccagtctgaggggcttagtgtctgagtcgttattagttttccattgctactggaataaattactacagacttagtggcttaaaaacaacacatttttaatcttatagttgtaggttggaagtccatcatgggtctcaccagattaaaatcggggtatcagcagggctggctcctctctggagactttaagtgaggatccatgttcttttttttttttttgagatggagtctcactctgatgcccaggctggagtgcagtggcgtgatctcggttcactgcaagctccgcctcccgggttcacgccattcttccacctcagcctcccgagtagctgggactacaggcgcccgccaccacgcccggccaattttctgtatttttttttttttttagtagagacggggtttcaccatgttagccaggatggtcctgatctcctgacctcgtgatccacccgccttggcctcccaaagttctgggaaggagaggatccatgttcttatccatctgggttattggcagaattcaattccttgtgttgacaggaccgagatcctggttttcttgctgtcaggtgaaggtcatggccaggttctacaggccacccacattccccggcttgcagccccctccccatcttgaaagcctgtgatagcaggtggagtctctctcatgctttgaacccttcctcctccttttgccatttcatttctaaccaagtccgtaaaaggttctctgcttttaaggattaatgtgattagatcaatcatgcccactcagataatccaggataaactccccatctctaggtcggtacccctagtcacttctgcagagttctttttgctacaacaggtatagtatgtttacaggttatgggaattagagcacagatggctggggcgctgctgttgttgtgcttactacagagcctgtgttttttcttcctcagtactttctccaaaaagcttttccactggtttgtagttccattggtacttgtttaattttaaatagtattcctttggttttgctagataaaactattgtaagctactagtacttgacaatgtatttgtgtaaaattgaatgagtgaatgaatatgtattatggctctcaaatctgataaattgcaaaatacaatagtaaaacaaactccagaaagacaaagcaccatgaaacgtgtcaacagagagaacaagaattttagaggaaattagctggacgtggtggggtgtgtcagtagtcccagcactttgggaggccaaggctggtggattcttgaggccaggaattcaagaccagcctggccaacatggcaaaaccccatctctaccaaaaaaatacaaaacaattagccgggcttggtgatgcgtgcctgtagtcccagctactcgagaggctgaggtgacagcactgcttgagtctgggaggctaaggttgcagtgagccgtgatcatgccaccgcactccagcctgggcaacagagtaagaccctgtctcaaaaataaaaaaataggctgggcgctgtggctcacacctgtaatcccagcactttgggaggctgaggcaggtggatcacaaggtcaggagatcaagaccatcctggctaacacagtgaaaccctgtctgtactaaaaatacaaaaacaaaattagccaggcatagtggcgggcgcctctagtcccagctactaaggaggctgaggcgggagaatgtcgtgaacctgggaggtggagcttgcagtgagccaagatgacgccactgcactccagcctgggcaacagagcgagactccgtctcaaaaaaaaaaaaaaaattaaagtgttagaggaaattgttgagtttatgaaatcgctaaaccagaggtaaggaattacttgatcagtagcattgctttcctttatctaattactatagattgtgcagtagtatatcaagacacgttacggtcttttgtgttattttaaagttggccatgagaaaataaaatggaaatatttcttcatccctcagcatcctttacagaatcatagaaatttagaactgtaagggatctatggccaattctcttgagctaaataaaggtaagattgctgcctaaaggaaagataggctgaagattttagaatttgatagggtagcttaaatagtagtagttgagatacagtattgcttaaagtgagagaaaccattaagagaaagaatattccttgcccctgattgaaaatggctgaaatccactaattttcaaactgcataattattaaaaagtctgtctttcataagatacctgtgagaataaatagtaagctgtaatatgatgtgaattaccttagttactgaatattaagtcacaaagtacaaaagcagatttgaatgtagagaaaaattcagtgcgtgaaattgaggtcatatgtgcccatgatatatgccttacaggaagtaataaaaaagaggggggaagtaagtggtatacttttaagctgatgggatccattttaagggtggaatttaaattgctgttctttaaaagttaagtttttaccctcctcactatataaggggacagaggggagggctctgatcaaagtagacctctcccctccccgcttcagtgtgcttcttagaagtcgacaagcaagctgtctttgtttgccgttcctgagcagaaagaggagattgataccatttttatctattcagactttttccttgcattcatttgaatgagagaagcctcataaaagaacagtgtcacaggttaaatgcatctgcctgggtgtctctcctgcctgaggtcataatcctgtgacaatattttattttctcaacatcttaaatacagatgtttagagttttttttttttaactcaggaatagtgtgcttttattaacggtattggtgattgattttgaatgtttttacttcaaaaagccaaatctcctggtgggtggaattttatgaagcacctgttaagctttagggaggaggacctttttggcagcaatccaaaatacatatttaaacaatgagcctgccaaagtcaggaaattataaaacagttttgaaattgcagaatctgcttttttttattacccctcaggtttcctttgcagcttggttgtaagttctttcacatgggatttactaatgttcttactatttaaagaccaggtttaaaaaaataaaatcaagtttggagatctcttcgggtttatgtgataaaagaccattagattttaaactgtacagccttccaaagaatctaggctcacgctccgcacacctcttggaggaatctattacacactggctcatggctggctcctttgaatggcattgcccctcagggtctccagttttcctctgtgaagtgagcagtaagacctggtgtgtggagcgctgctaggtgaaaagtgtgccccaaacaggaaaatgggggaacctgctgaggccacacttcttggtgggtcctgtttaacctggatctctcagcttcttaactctgtctctcaaattcactgttttctgctcctgcttccagagtttaaactcagtgacccaggggcaagatggcaatggaatatcctctgtctagcccagcaatgggatgttctttgtgtgctattggatttgggtgggggagggcatctgtagttatgttaagcagcctcaattttttatttagttatctgttgagttttatgatttcatcacacacagagagcaggaattgtttgaactttggcaactcccctcagtgtgtggcaaaccaggaccccctgggtagatggtggttgatgaagacggcaagtacaggtgcaggagtaagaatgcctgagcctgtgttatcttcaagttctcaaaggcttcagattggaattggtataaattaagttctcttagggaaaacattcgtacagtcattttgttacatacagggaaagaaggcaaggggaaaaggcagaaaggaaaatctgtaattcggattctctgatctgttggcattttcaagttcctaaggttcattggctagcctcatcagctatctattaaatattagggaatgggagtttaaaaaagtcaaaggcaccattcccatcaagcaatttgctttttattctcataggacacccatcctgtttgaaattttgtcctgaattaacaacaaatgtaaaggccttaaggtggcagtgcatcgaatgcaagacatgcagtgcctgtagagtccaaggcagaaatgctgtaagtatggctcccgtaatccgcctccaggtaactcgctaatttccagtgttaaggtgttttcatttttatagagtatggctactttctttctaaagctttaaatacacatgatgtcaaactgcaaccaggatcttggtgcactttccttatattgtattaatgttaatccagtaacaaaagaatttttggccttttacagttggtttcagtctcaattagtctctaatatgttatattacaggataatatgcttttttgtgattcctgtgatagaggatttcatatggaatgctgtgacccaccactttccagaatgccaaaaggtgaacttctaaactgtactaaaaatgtattttattacatattggttagctttgtcctgaggtctgacagctcagaggtatacaggttctttaagcatttttttcatccctcccaccttccctatacttctgagtttagcacaggttgtgaatagaggagtataaaagcatagaaaaaaatacatatatatatgtgtatatatatacatatatataaaataaaggctctaattcagacccagggatgaaaagaccatctctctctccaaaccattcccctattagaataagattagattattaaggtcaaaagtttagaacactttccatattattcagcacagtgttaagagcttaacaaattttatatttttgaggatgatagtgactccaaagtcctacaacaggaagccatcaccattttcttggccattagttgatattttgaacacgagcatctgaatgatcttatagctgattgtgtctgatggaatgtggattttcttctgtttattgtgtaaatcagctaagctcagccttttcccctcattttgcaatatattaaacatttaaaaataactttgcctttttattataaaatccataatttacattgtggaagatttaaaaagtacagatagacaaaaaaggaataaaaataaaaatgaattggaaatttccttctctgccttcacataccctttgaagggaaatggaacattctgtacatgtttttgtaatgtactttttcctccctcttaatagattataagcatcccctacatcattaaatattctcctaaacatagtttttaataagtatgtagaactccatagtatagagcagggattacaaacctggcaactatgggtcacagatatgctttgttggtacaatatttttacaagtttgaatctgagtcctctgggtggtgcgtgtgtgctccagtttgccacaatctcactactccctgctgtcttacgttccaatttgcttcagtcacatacattatacaatctaggtccttcctggaggtatttgattttccaaccctctatataaatgaactctaatttatttaaccagtcccttagggtggatattacaaatgtttccaattttttccatccacaattatttccttgaaataaattcctagaggaggaactgttggatcaaaggctagatacatgaaaggctgtatcagttttcaggctgtccagcagtatagaaggatacctattttcctgtattgtgaccagtactcaccgttactatatctccttgagtctaagacacatttttttaatgttttaatatttttgaagtcagatgcatcatacagtatcttagatttgattagagtattattatttttaaaattttaccagtttgataatagaaatatgtctgattatttctttttaagtagtcagattgaacatttcttgtgttttattcttggctgtttgtatatcatcttttctaaagtacctctttttatccattaatcatttttctcttgggatttttacctttttcttcctgatttgcagaagctctttttttgtgtgtagtcatattcatgaatctttttatttatggcttcagttttaaatgtcagtcatgcttagattatataaatatccacatatctttcctggtacttataacattttattttttcatattacaatattcatctgtctagaatttattcttgtaaaggataggaaataattcctcttccagatagatagctatttgttctatcatgcttattgaatcatttcatcctttctccactgatttaaaatatgaccttttgatatgctaaacttttctgtaggctttggttgttctggtctttccattcttatccattgacctatttctctatgctagatgtatagtttgaatcattgtagttctgcagtactcaaaacttttatttaaattttaaaattatattttatactgataatttttttttagtgttggaactttccagaaagagatgataagacaatttttttttcttctagaaattccaaaaatggactgatttgaaaatgtctccctcaaatcaaaagatataatatctgacaggggcgagttttcatgtgtgtttatgtgttggtgagaggcttaatgacatgttgggaacagcttcatggaaggattctgagagaggggccacctctgccctcaccaccttcactccagggaaattgaccttagtgatggcttcctaaggaaaatgacaaagggaatgacgcattttttggagtaaagttcagcatacaggcatccttgagcagcttattacagctacaacttatatttaatatcttctcttaaaatgaaacattaaaatatttttctcatatatatattaattcagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtaggttgagatcttatcaaaagaaatcatttatgttttgctttaaaatataggtgattgttattctctcagattcctttaggggttttttggcatcattttttcaaactcaagggttgaaaaatacttttccttttgcataagctgtggaaattttttgaaaataacatttttaattaccattggcattttggggtcttctgttggcagtagctgtgatactaagtgacatttttcaagcagcaggatggaagcagaatgtaagaattggaaacagtcattcagcctactttattactggctgagcattagagcttaattatgtaaatattttcataggaattttaaaacgagagggatttgtccatgtctatagcaaatctcttttgtcactccagataacattttagaaaaatacctctctcttctgatagtaatgtagcattaccactttttaagatctcttttatgaaataggagcttctgaaaaacctgcagatgaccacttacctctgaagagttagacagaactatttgacaactgcactagtgcagacatatatataaaataatatattcgcagtggcctggaaatctactatgataaccccattttcactatcttgttgctgtataattgccattaaagcccagtagagcatttagcaggagttagttggaaaagcagagaaaagataagaggtgaaatgaatttattttaacctgtgtagagtatagatttgactatcagcattaaggtgtttacgaatgggatcagtagacttgcacatctatagcagttctaccaacagactaccaccatcttttcaggcttagtgaaagggtcattgtgatggagaaagaatacatgctctgcacacaccttgaacagactccaagaatctcactcccttgcttactccttttcccctaattttatctgaagctgctctcactatcttatttgctctcagaaaaatagtattctcccgcacctttatctcctaagaagaagtaagaaatgcaggctcctttctagagttttctatgaaactttgcaaaaaccctttaaccagtagacattttcaatagattttgaaaaaatttctagaggcaaacatgaaacatttatgaataaaatctttcatggtagtatcatttgaagtagaaattatatgtttttgcattcatcctgtgtaagcattgttcccaacatgggtccatatcctcagggcccaattaaaaaaaccaaattaggatataaactttctaaacagaggacacagctgaaaattgcatctggcaccaatcctaactttttgtttgtccaaaattgtcctttgagcttaggaatttttaagacagtctagggagttttcctttttacatgctttataagcatattatcctttctgggcaatcgattccagatacaatccaaatgcagctttctgatgtgaaacatttttgcctggatgagttccttgttggtaactctcactgtgtctctagtgacactagagatctctagcgttcacctgacttggctgaattggtggtgccaggcagagtccctggcagtagagccacctcagatgagcctggtagctgcacctacctccccttcaactaacagctgaaatctggtcattaaatctttgtatacaagatgatcactaaaatatactcttgtatttgtaattacttaagatatttttataattcagtattgtatctttttaaggctttcattttgtcattattcacctttagctaaattgatcattttgaaagtacattcttgggccccagcattgtcataattcatctgcaaatgtttctctattgtataaaactctgctacaaaatgggtagcttcgcaaaccctagcctgaggtgaagacagtcggccgctgttcatgtaagcagctgtgttagcgagtgacctctagtttctagaactactcaacagtatgggcagaaccagggtacaaagattctgacgccaagtgtctgataatgaccatggtaaatgtgccgcttcttcaccagactctccatgtcatgtctgacccgctgtagcttttctttaatcatttcttcagttttttgctattgttgtccttttttcagcaatattttatgctgtagttaattgtcttctctcctaagagagtattattggttatcttaccatcctaagcacaaactgctgagaggaagaggatgtctttttatgttttcttaaaaaaaagtacaaatttatagccatatccaaactctatttatataagtttgcaaattgaattaaaaattacttttaactagagattagataagcttcttcttttgcttctggataacacatatgacttatttcctcctaatactttaaaaaagacatttcaggaaatcataactacttgtgacaacaccaaaggatagcttgtttttatttaattataattaaagcattgggtgttcttttagtctcttcagcatttttcttgcttatattgcccttgggtccacatggattcttccagtacctggtggatgggccctggaagaaccatgacatgtaaatgcagttgctgctgcctttccaacagagaaacatctaggtggtggcacacacaaaaaatacagttcttaagtttaagcccattgaatgcatctagttgcaataaatttgtttttagatacctttataattctatttattaaatgctgatactattctctaaatttctgcctaggtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatatctataccactcagggacagtctcgcaaaaagggacacccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatggtaagcaaaaggtcaaagctccaaccaaacctgcgtcccgtccctttctccccaaccctgaaaaaaatcaaccaatcaattcctatttgtcacataggtcttagctatttctcttgttctcacttcactttcatacagaagcagtgaaactttgacctttttctaatgctgactaaacctccaaaatgttgtttttccaactaatactctcccaccttttattatttatttccattcgtagtgacactaggacccccagatgccttcatagcattgcttatggctttgtagtcccgcatgagtagccactgccatgcttctgccatgctctcccccatgtcacctctgcagccacagcgctgttcagttgtgtgctgtcagtgcttccaacagggggtgtttcagctcttccctctgctccattgctttctcatgacaaagttcatcctgcttccgtctcagcaaagcctgatctgtgactctgtgatgtgtgcttttggatgtgagtgtgtctgtgtgtgtatccaccttagggagaaaacggatttcataatttcattgaacaaattggcccattacatttgctaccctttatcaaacaaaaaccgaaactgtgtcatttggacaaagtggtagaatttattatctcaaaagtgataatgggaatgctataactagacatcgataaaacttctaatcttggttgaaaaatatgatttcactttgtattgctcttactttccctcatatatttattaaagctgtaaaaagatgacagtgataaattcaaataaaaatttgagtatagcagggaaaggatactgctggatctatgagcagtgcttagatgtaaaagcttatttataaagctttaaaaaaaatccctatttgcccagtatgctaatttggtgccattttggtaatatatggtggttactcatgattcaagtcagtgaatacactttctgctggttttaaatgacagatactgaaataaaaataaacatcaaacaagaaagtgcagatgtaaatgtgattggaaacaaggatgtcgttactgaagaggatttggatgtttttaagcaggcccaggaactttcttgggaggtaaggcgaggatcccacattgtagtagcaagtataagatgtggcttctaactattaatatggaattactgtgttgattttatagagaatccctttcaacatcctttgtgattctttagccgttatcatgcccatttctactgactgtacattcaaaagcaatgacttagtagaattgtcgccactcttaaaagtaggtatggactcagctggtctcacaaaataaaacagagtagcattagttgaggcagattttggaaaacatttctaggtgtgaaggaatagatttctgatgagttttgcctaaatttagaaaataacaatttaaaatcattaacaaaaagaagaacatcactgttaaattcaccgatgtttcttccaacacagatggccagccatatgaaaaatgtctcatatttttagctcttctgcattgatgaaaacaatattttgtttcacaatcagttgtagtcagttttatttttattgtccagtaatttctttaagtgattccactttaattctgcttaagttattaccacccagatattgacaggtgaggctgtcagacttctcaaagacgaatctaatatgaattgtgaatttgttgtgtcagtgactacattcggtttctatgaccagtgtggtcaggtagactccctacccaaccccacttcctgttttgtggggaaaggggttttctgtaggctcttaacgctttatttttagtagcagccagttgggctaaatactcctgacagtttctaccttcagagctattgggtatttccaaccctcattctgccccgatctatcaggatgccttgtatcagctttcctttggctaagataaatgtcagatttcccccagttattaaggttggaagtccttgaaccagcccaggttggaaatggagcaggtcaaaactcctacgttgatcagtagtgggattgtgcccttgaatggccactttactccagcctggacaacacagcaggatgccacctcttttaaaaaaagattcgaagtccttaaatattatctttttttggcctacttctgacattcatatgtaaacatgaacagtaggccattatctgaaagatactgctaattctaaagttttttcattccaacatggtaaaactggctttttttattcaagaaatattcttgttctgtgtcaggcactgtaccagacaccagggataccacagtgaatctggcaggcagagttcttaacctcgtgtggcttactacatggaaataagggaaataagaggagacaaatgctaagctgcagatttcacaattgattatttaattacagttgtgataaatactacttcgtggaggaataggaaactgtaagcttctgtaataaataagcctgtgtaatagccacatcatttataatcacctaatttctaatctgttacaacagattgttaaatccagttctatcgacatttgtatgtatttataccatacttatttcctttgctatattgtttcttagggtattcgtttgctgtgaatcttacacaaaggtaatgttaggttggtgcaaaagtaattgtggtttttgccattgaaaaaattataaaaacagtaattacttttgcaccaacctatttcataagggtctatagtgttttaaggccatgcaaattcacaattaagattagtgttctgatcttgataagttttgatagtcactggtgaaagaaccaaaatgtaagtgaagtatatatattattattttccttttctttctatttgacagaaaatagagtgtgagagtggggtggaagactgtggccggtacccttctgtgattgaatttggtaaatatgaaatccaaacctggtactcctcgccttacccacaggaatatgcaaggtaatggaataagtctggcaggtgtataacttgaatgtcacatatgtgagaaaggaaaattcttgattctaaagcaggaattagggatgattttaggaaataaattttggtagtcaatgccaagtgcttcccaaactattgcttttgccagcacctttttatggtattccttgttctcggtaaattccttatgctccttagttacatgggcattataaattttgccatttagcttctagattgtgctttctttccttggttaattggggaaatgttggttttgtatgaaaccaaattaaaaaaaaaaaaagaaatttgccatggtgaattattgggtagactttcttctccagttgtcttttatattttttaattaggcctgttacttttatctctgatttctggcattttattttcaagtttttaatagaaatttagcaaaagaaggaaaaatgggagaaagtaagtgggaatgggtagtcttaagagacccttccccaaatttttactttagaacatttgtgactttgaagagaaggccaggcccggtgactcactcctgtaatcccatcactttgggaggccaaggtgggtggatcacctgaggttaggtgtgcaagaccagcctggccaacatggcaaaaccccatctctactaaaaatacaaaaattagccagacgtgataggacatgcctgtaatcccagctactcgggaggctgaggcaggagaatcactggaacccaggaggtggaggttgcagtaagccgagattgcactactgcactccagctcaggtgacagaccaagatcccatctcaaaaaataaaaaataaaaaggagaaaataatggtatccaagtttttgtttgtcttgaactcaagattagcctgtgaacgaatatatcccaaaatgggtacattgagaatagatgtcttccataaagtatgtcagggtacactttactagtatcttcaaaaattttttagtctgcaaagttttcagtatttataaacttgattttcttatagaatagatcttattttttttcgttagcatgtgagtgtctggccaatcacgtaactggagaaaatgctaagtgttttctaaaagttaagtgacaaaataagagtcaagaattttggtttctccttccttataccatttggttgtgtgttcttgaacaattttaaaagactatgagctttaatttgcataggtaatgataagccatgtgctctgaaagatttgaataaaatttgtacataagtgcaagatttgaaagtagtctcacctgtgtctgcctctctcttgaaaacctttttccccattcttatactccaaagaccttgcaagtgcttctaaacattttcttataaataccagccatgttcattaagatatggaaataaaaaatgttctgatttttaaggtggagaaaaagtcagcagggaagagaggtgtttgtcttttactcaaagtaacagtggaattggtagaaaacaaattaggtcttttgattttcagccgtgctatttactgcatttagaccatatataaatctctgataataactttaaagttacctcttccagaggtggaaatggtaacaactaagtttgaggacttttcagcctcatatgtatgcagattgtttaaaataataaattcacttctgagtaagatattatatctataccactaaccatatataattggaaataagatagtaaatgtgaattttgaaaaatatgcttggtcccttgacaggatgatatccttattaagttgattttttagggtggtggttccacatctgtaaagctttctttatataggatatttttaaggaaacaaattatttgttcacaaagtaaagggagcacatattatggattatattaaaaaataatgtatggttgtttttacattctgtctttactattggctggctttctttctttctttcttccttccttccttccttccttccttccttcctttcttcctttctttcctttctttcctttctttcctttctttctttatttttttgacggtgtctcactctgttgcccaggctggagcgcagtggtgcaatctcgattcactgcaacctccgcctcatgggcttaagcgatcttcctgcctcagcctcccaaatagctgggaccacaggcatgtgccaccacgcccagctaatttttgcatttttagtagtgatgaggtttcaccatgttggccaggctggtctcaaactcctgatctcaggtgatctgcctgccttagcctcccaaagtgctggaattacaggtgtgagccactgcacccagcctccaatgttattatacagcctttttatgatgtagagaaaattgaacaatatttaatcttccccccaacagtataatctatctgatagattctatgatttttaaactttaacagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggtaagcgcgtgtaaataaaaaaattcagctttttgaaatctagtactcctaattgttgactatgtgctgatttgtgtttagaaggtacaaagtatacttaattttggcactgaaattcagactgccctttaaaacatctccatgttttggaatgtttatctaaccatattaagcaaccatttagactgatgaagaatccctacttcatcacattaacatttttgtcttccccaaaatccctgtctacactagatatattcaccatgaatttatgatctcctcagctctttgtaaattctactttctttggcaggagaaatgagctttgttcagcagctccagccaatgtctggcaggtgctcactcttccagggaattgagcagctgtacatatctcctcaatacacaaccacctgtgtttccatccacttcttggcagtgtggataatccttttggtgagaccctagcagatgttgggactccctcccatctgggtagatggccacccctgaagaactctgctgttcacaggaaccccttgtggccatatgtctgtcattgtgggtttcttgaagacattttgtatttccagaattgatttcgtagcaggcctttgcctctatatagttgcattgtttaattatgtatctgttgtcagtttcagggattccgttaagctgagtcagtttcaccttgaggagaccatgcctttctcacaggttactgtctgtctgcagggcttttcacgtttctcctttatgctcttccctccacttgcacacttctgttgtctgctgcattttctcctctgtgacccattgtggtgtgcattggtgctcattcctaggtgcttgaaacaagcctaccttgtacagcaaacgtgatgtcctctttctctggaatatagtttcacttctggattttctttttctgaattgttcaggctgaaacttattattctgccttacagttctctttatttctggcctgcagtgtcttgccatcctattaaataaagggaaggttgtaggtttctcacatggaccaggctccttctcagacaggtctgggcccactagtttttccccaagactgatcagagaacatgggaaactccagttgtgtcttatgatttttttaaagctttctctttttctatcagctctttcggtaagcttggaggaagaagggtattgttgctgggaagattaggtgatatattagttcttactaaaagctaggcacttttgacatttcaagctggttagttctttgttgtaggggctatgctatacagcgtaggatgtttagcagcatctctggcctctgctaattggatgccagtagcaccaccaccccttccagttgtgccaaccaaaaatgtctccagacgtagccaaacatcccctgggggcgcagaatcacccccagtaagaaccagtgggctagaaggaaggctgaatgcacgttgcctgaccttcctgttggtatgctatcctgccagccccagccagctgaggtgacagagctgctcacagttgaagcttagctaatgtcacaagttcagctttcctattggctccttccttgatgccttagatcttttcttccaaccaaaacattgtttctcaaagctcaaaacacattgttggccttaagtaattatttcataaatcagcatgagtcagcactgggattgaagctctcataaatccatggaacgtcttctcatgggcaagggaatcagtcttgttaggatggtaagaatgggctgttctttcagggcaggtgcttttggaccatccagagatgagaggggagacatcagaagcatgtatgtaaaattcacttatacgaataaggagttggatttgataagtaccgaggtccctattctagaatctgagttaatagagtataacatttgggcaacttttctcctagcagtttcttacaaaacttataaaataaaggaggaataatcacacattacgattttctggccttccctttctttattcctcttacacttttcacaaccaatcagaattttcttcagcactgtcatctctgtatttttctggttcacagttatgtatatctccatctttcctttttgtaatatactaccatttccaaaagggccatactctcaaatacatgtaaacttcctttaattaaagggagaattgtatcctctgtgcccattgcccatatttgattgtgttgctatgtatgggacctaggttccatccgagggaaatagttatatgaaatctaaaaataatttgtgcaagatgagaacccgtatggtccacaggagacctgagaatggtcaagttcattgtttcagagctctggttagcaaatatccatttcccttaagaaaagtgctagggaaattcttcttgaatctgctgtgttttctattttcaaagagtaactacatttgatcaaagaaattggcatctgtgcctagcctcctgtctatagccatcagtatcacagcttgattcttttattttgaagagaagtagactgtaatcatagtgcttattgtaggttgaaattcatatcactttctctgtaagtattcccaacatagatattttatcttttccaattatatttaagatgatgcttgggataaaaccaaaatggaaacctctttgctaatccacacttctgaggaatcagaataatacagttcatttattttagttttatgtgaaacccttttgaaacaacataaagtttaacttacttgagaagtattttgatctgtttatatttccttaatacagatttattcggttcagatagagaggacatgcctgatcatttttagctcagaataaattacaagtaaaaattactcctttactagtggtttggcccttctttggtagcttaaagagaaattttaactaccttaaatgtaccctaatttaagagaaaatgtggaattctgatttgccagtgacagctgttttctggttaaagctgtacttgcttaatagagtgttttaatctctcagtttaggatttggaaataaaatgatgtactttctgaaataccatatagaagaaacaattttatatggtgcagtatttttatgttaaataatgttgtctgtttctttttgctaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggtaaaacaagagccagcatgaccttcattttctttttcaaaatgtttttggtagagcccaattctttgaacagggctttttcattactataatttgaataagtgacatgtgtttttgaaaagctcaggttcttgttcagagctcattttaaaagatgaaaacaaaaaacatggtgcctagtaagtgtgtaaaggacctcagcactgtgtgccgccttgatgacactctaattgctgccttgtggaccacttagcgtctttgattttctcagtgtttagcttatttccgttttccctttaagtggtgtcaacatgaaggtttcagtttagtgtagcatttaagagagaattctcctttctccttgttgccttccctctgtggtcaacagtatctcagtgagttaggacgctggcatttggacagtcaagctgataaaatgactggttttacacttttgtctcttattctctgtgctatggttttaagttctaaagcaatctcacctttagaaagcctaagtatcagccgggctcagtggcttacgcgtgtaatcccaggactttgggaggccggggtgggcggatcatgaggtcgagagatagagaccatcctggccaacatggtgaaaccccatctctactaaaaatgcaagaaattagctgggcctggtggtgcacgcctgtagtcccagctacttgggaggctgaggcaggagaattgcttgaacctgggaggtggaggttgcagtgagccgagatcgcgccactgcactccagcctggcaacagagggagactccatctcaaaaacaaaacaaaacaaaacaaaacaagaacaaagaaagcctaagtatctctggctgttagagtggggaaaacaatcgacatattgaggggacggatatagcttgtcctttttactggttcagagcagttcactcacattcttctgctcaaaggcttctaagaaacaataactcctttgcaataaaggaaaactgagtttggagatgtttaccaggtaatgaccttaacttttctgaggtacctaggaaatagttaaatgtaccaggatggtacataaatagagacaataattatgagacttttagatagaaggtccaaactctcttatttatgatatttttttatattaggtgatacatgaattttaatgaatctgctcttgcacaatgtaaatgggatgctttatagaagtgccattttaatgaagtttcaaaagatagaatatatgtgaaggtacttgcaaactatagctatcctaaatttaagaatcaacccaaagatcataaacaaaaataagtaacagcattcatggaaaactgtctcagtgttttaatccacatatttggtaaagctttaaaatgaaaaagaagaaagttaatttgcacattacaaattcaaaagatgatagagaattaacactgaataaaacaataaataggaaatctatatgattaataaataaaacaccttaccttttatgtaggtttgtcaagatcattcttctccagaaacttaaaaagaatagtggttgcgtccttgctgttagaaaatggtgtttctttcattgtctgtggatttaaacataggcttaacggtgcccaccttcctcgtgctgcactgaccatcccactcctgggtcttgtgttggctgctgagtagcagccatgtgtagagttggtggtgattcttgaagtttgaatttctgcctctcttcctgccagggtacccaaaattttactcagaactagctcaacttttctcatagtttcttctatagcatggcagcagctgctgttatttcctactattctggaatactaatatgccttggcagtatagtgaaacaaaaattaatctaaaaaataagcatgttaaaagactagatgaggccgggtgcggtggctcacgcctgtaatcccagcactttgggaggccgaggtgggcagatcatgaggtcaagagatcgagagaccatcctggccaacatggtgaaaccccgtctgtactaagaatacaaaaattagctgggcattgtggcaccctgtaatcccagctactctggaggccgagacaggagaatcccttgaacccaggaggcggaggttgcagtgagctgagattgcaccactgcactccagcctggcaacagcaagactccatctcaaaaaaaaaaagactagatgaaactaaaccatattctcatgtgtcagctggaatctagaggactctggccctttggggctattcttgaaccacattctagaggttattagaactacagttcaaggatagccagagaagggctggaatgacctggaaaggttcagtgcaaattgttacatgcatatgactttccaagcacataatagatggctgtaaacagaaaggaaagaaggattagttattttattcatagcttagaatttagctgtagtaacatgttaagctgcacggaggggaagaaggatcactactatgttggatctcaaaaaactccgaaaggtggaaatggttctggacaaagcaaggaatggtatcaaggatgaattctcttaacccagagtacatttctttttagagagagtgacccatttgtctaactttgcaaaacagacgaattacttgaacctttgccattgatgtgcacatccagtgagggacaattcatcttcttagaaaaactgacacacattgcttcatcctcattttttagaggctccatagacaactacaaatgtgcaaaagttgggagtacatctttttcacaaagaaatcttcaattctgccctgtagggttttttccacaaccatctcctgtgatctttcaaattggttcattaaagatctgggtgttctgaagtaattctttggtgtggtctgtaccatttgtggtcagtcttatttgtggtttatatttggccagagcatccacgacctcaaaagccttttccagatctctgtgtaggttttggcaacttctttgtactctgaataaaaaaatactgccctgatgccacatcccatgaaagttgcaaattcttctttaactgtaagagctgtttcttaccatgttctacccagtcttcctcctggtttcaaactgttcgtaatattttggtctaacctttgtttggaggctttagggtttcttgttgttgtctttttgtttcattttattttgttttcctggtttgaaatgcagattatttctctagctttttacattgactttttattcataggagaaatatatgtgtgcacatctacccacacagatactgttttagtttcactgggacatttgcccaaaggcagaagacagattgctgttgcagagttgtagattattattatatttagcaagatagccagctaaatcctaacttactccactgggtgactccctgggatgttattttctctatctctgaagttatttgagcaaggaaagcatttcttttatgctgtctatattctgttttatttggttcatatatttccttggattctttatgcatattttatggcactgactttcaagaataaagatgtagttgagaggcatgtcagagtcgatggtttgttgttaattgatagtttgattgattaatatagtaggatttttctgcttgatcctgacctaacccattggctttctttagtggacagttttacaaggacagtggcaggtgcagggaattgcccacttcagcagggctctgacatacttgatctgtttctccttccctcaggaaaagctttgccagcagaagtataatgtctcctgcataatgatcatgccccagcaccaaaggcaaggatttggacggtttctcattgatttcagtaagtgaagtactttatttactttcatgatccaggaagctgatggccgttacaggaaacagtaaaatataaaactttatttaacctgcattgttgtttttatcaatagataatgggctttctatttatatttacataggttagaacatcttcctcaagtgaaaaatgtactgctgctcagtgattgtactctaggaaattgagactagatctctcggcagcaggcctcatgcacaaagccattaccctgaatgaaccgacagaattacattccattttgtggtgctcatgctcattagcaccaaaagaggcaattatttgtgattaaagctaaaggaagtattatttgaaaggattttcagctctctgaaattttgcctataatcttgtacagtacaaagcagaaaaggtatatttccatttagaaaaataattttctaggcagcttatcctgggccttgctagtagaaataactcttaccttattttgttaatttcccttttctattatggaaattaatacagtgtttgtatctagaggtttcccaagaaatatttatcttatatgcactcatatcttctgaaccttctcagttaaaaccggcataatatataaaagtatgcacatggataatgtttttaaaaatggtagttttttttttcctccttgtttatattatactggatgtgtaaatgttgtgttaggggtacatttggagaatcaattcaaaatatctagataacatgatgaccagataacccatgataatagtcatttctcgtcatgtaaaaatctgtcactggccgggcgtggtggcttatgcctgtaatcccagcactttgggaggccaaggcaggtgggtcacaagatcaagagatcgagaccatcctggccaacatggtgaaccccatctctactaaaaaatacaaaaattagctggatgtggtggcacacacctgtactcccagctactagggaggctgaggcaggagaatcacttgaacccgggaggtggaggttgcagtgagccgagatggtgccactgcactccagcctgggtgacagagtgagagactctgtctcaaaaaaaaaaaaaaaaaaaaaaaaaaaaaaaagtctgtcgctaggaaccaggtgcttcttgattaccagattgcagtttatctgattattaactgaaaggaggaaaatttaggactttgcacaatcttcatcagctacatcagatgcaaaaaccacaatgtaaatgcgcttacagaaaaccatgaagaaatatagtgaatctaaatctatattgttaggtattaaaagattaaggtctgattaaagtgtaaaataactgaatagcagttttggactgatttatatgatttattgacattgaagaatatgattcttttaaaagaagaattttgattatttttctctttttagataatatttttagttatttattaattaccctagtcttatctatactttcctgacctaattatccatgaaaccagtaatcccaaggagggccaccttaccaaatgcagtgtaccatttttatttttatagagtcctagctgtaatcatttctgagggcaaaaccatttatcttgttctctagttttgtgtggctaccattcataagtagttcataaatatagtttctggtatgcatagcagccattcaagccttaaatgtttggtcatatctatatgcctacagaataaggcaaactccttagctcaatatttaacgtcttccaacatctagttccagcctgtcctttaggctttttcatctactaatctcctttttctcaaatagtctgagcatggtcctatacctctatttttttgtctattcagtcccttccttgaaatgatcacctcgtcctttcctagactccgtctgttcaaaatcctgcccattgttaagagccagctcaagaatctctgctttttgatcccacctcctggaattttatctcatacctttattttatcttataccatattctatatggtatcacacttacactctgttcacccttttatgataattattgatggaggtttcatacttccaacttctctgtatccactaggacagtttcctttataataatatgtattagatgatataaattaaattttattgatataaactaaatttccaaattgatatatggttgctgtccacaatcattgtctacctaaaattaaaaaggaactggtacttactaggtaaaagttcaagctctaaattcagtagtatcttatttgtacagcatgatctggcactaaggccttctacataagagaacaatctgggtaacaaatacattatcttcaaatgctatgtcttttttttaaccattttagtgaaaactgttactagaaactaccttgtattattaaactacagaacacattgaaaccttttctcagtggctccaggccaccatgatgaatgctgtccaccaggatgtgagcaggcaaagtagtgctgagggtgtggtttttttcttttctctttcctgtacacctagcattgcccctactggagtgagttaagaagtgcagtgaaagatttgaataaagttgaagagactggtgttattccctcagagaaggggaaactaggggaagaattttatagcactcaaagaaaatgggaactggtgtaaacccaatagaaattcagtttaaaaccaaaagaatttcttggctataaaagttttaaggaagatagagtaggctgctgaagaaattaatagcaccttctcttggaagttacttaaagtaatagtagataaatatctttccaaaatgattgaaatccagcctttgaaggtagggatgagtcacatgacctctcatgatcatttttgatctcataatttggagcccaggatagaaagctaactagggttacaggttttctaaaatctgctctggttttttaaaggactttttaatggttaaatttattttatttctatttggtaaatgagcctggggccttttggtcagggatgtattttcagtaagtcaaatgaggttgtaaatcaggtagatctttataattgccagtttagtaagctgaaacacgatacgagcagggagaaagatatagccgcccacttgcacacttgatcacagacatgggtggaatgtgatgcactgtgtgtatatacatgctcctagacttacagtggggctgtgggctgataaacccatcataaagtgaaaatatcataaattaaaaatacatttaatacacctaatctaccaaccatcatagcttagcctggactttaaatgtgctcagaacacttacattaccctacagttgggcagaatcatccaacacaaagccaattctataataaagtgttgaatatctcatgtaagagtgttgtaccacatatcgctagcccaggaaacgatcaagtatggtttttactgatcataccatagtaaagttgaaccaagttgtaagttgtaagttgaaccagttgtaagccaaggactgtctgtataaagaactgcaaatgcagggctttgaacactgttcttcagggcagcagagtgaggtggaatggtcatccatgggaccatgtgctgcttgcagagtaagtcatttgtatatcacttcctagaccagcttctctgggatttgtcagagcaaggctccccaggaggccatttgcagagtttggccagagtgagtaaagggcaccaactcccaatctggttataaactccctagtgggttttatgactctttgcccacaattggaatgggtggaggagagagtgactatcgtggattggttgagaacgcattccttcctcttggattctaggattccctttctcagtcagaaaatttgaaagtcttccccatctctgtctgtaaagtctttctatctctctctccctccgtccccaccagacatctcagaacttcagagaactcccttgcccacaaaacatttgcagttcctacttcagagcctcacaccgtcaaggcaaggagctcttcttctcccagccactgctgagcactgggggcccagagtgctccctcccaagccctggactgcttctgctgctggggctgcccagcaatgccttatccatctcactatttttttctttaattttgaaataatttcagacttagagaaaagctctaagaataataccaaaatttcccgtacattgttgcacatgttcacattttatcacatctgttttctgctctattattctcaatctctccctttgtttctcttctctctcatattttcttttcagaatcatttgagagtaagttgaagatgtgttgcacctttacccctaaatattgcagtttttctacaaagatgctctcatatatagccacaatacaaattattaaaatcaagatattaaagtaatttatgcacatttgttcaaattttaaattttgcgagattatactgatgttctttctggaggaaaagaaaaatctcctactccaggatcacatggagtatgtaattatgtccctggggcctcctttaatctggaatagtacctgcttttttgttttgttttgctttgcttcgtgttttccatgattttgatattttttaagcatacaggccatttattttgtatggtgtgcctcaatttgggcttatctgatgtttcctcatgattagatttaggctgtacattttttggcaggaataccatagaagtgaccgtatgtccttcccagtgcatttcatcaggatcatatgataatacatttgtctcatcactgggttaaggtggtaactgccaggcttcttcactgtgaaattaccatttttcgctttgtaatcagtaagcatctggtgagaagatactttgggattatataaatatcaattctcatccaattttcacctcctagttttaccattcacttatggctcttatctaaaataattattactatgataattaccaaatggtaattttctaattccattctttctacaacttactaattggcattctagaaggaagaattatttcttcttccccatttatttaatttttttgtataattgtgggttttaattttattctataggttataacctgtcattaccatgattgattttgatgttccccaaacatcaaattgtcccagatttatttatcagcaaatgtttcaagtgggttcttgtgccttttccacatgcttccatcctgtggattcttccttcctttctgccacagcatgatgttccaggtttagcttatccttttcttaagccagccctggaatcatccatttctcccaagccttggttccttatggtggagaacagtagttaggaaccaggatctgggctgggtgaggtggctcatgcctgtaatcccagcactttgggaggccgagacaggcggatctcttgaggccaggagttcaagaccagcctggccaacacggtgaaaccctgtctctacaaaaaaaaaacacaaaaatgagccgggcttggtggcaggcgcctgtagtcccagctacttgggaggctgaggcagagaattgcttgaacccgggaggtggaggttgcagtgagctgagattgcaccgagctgagattgcaccactgcactccagtctgggtgaaaaagcaagacttcatctgttaaaaaaaaaaaaaaaaatggaggaaaccaagttctgatcacttaaatgtgcccattgctgcttgggtgtcactgcttctagccctctcagaggacagagctaggatagcatgcatatttatatccatgtatgtgcacatatacatatgggtgttataaacacatatgcgtgtacacacacactcccttcatgagttcagaccattccagatctgcgccaccatacggttgtattctgtctttccctcttcccatgtaattcctttctctgacagtgagaaccctgacttccattacccacaatatacttatgtgctacaccctagaatacacagtaagtagtttcagaattactaactcatgccattgtgaaaaacaaacctcttaagtggaggtcaatatttatatatggttccttttggctttaccccaagtgtatttagtcaaaacactgtgtttaaatgttactagagttagtttttctcccccttcagtgttactgtagtattcattggaatacaattaggcttatttgtttctgtttgttttttattttatacttgttacctttttaaattagaatgtaaaacattaacatgattttaaaaatggaaactgtattaaagggtattctcagtgaatgtgccctctctacccattcccattccctcatcctttcctgcaggtctccaatctcattagcttgtagtttatccttcctgtttctttgtgtacaaatgagcagatagatgtgcatttttctaatttctcctcctttctaacacaaaatgtagcatactataggtagtcttttgcattttgatttttccagtatatcctggaaatgacttcatagagatttcttttctttgacagctgcactctactccgttgcatgcatgtatacagtttgcttacctgctttcctatgtatgggtttataggttgtttccaatattttgcagtttaaaaagtagtgtcatgagtaatcttgggcatattttgactgatagatacttaggtagcagttattgtatattagatatcctttcagttgttaggactctgtttggctaggtaataagtgagcagataatgaattgtcttttactcgggcctgcagagccagaaccctggctgatgggcaggatacaaaacccgttctcctgggctctgacccaggagagaccgagggaacaccaactgattcagcagtaggtgagagaaccaagtgccagatggtggtgagggaggtggcaccatcactcacatgtgtgtttgtgtatatgcatttatctgatgccaaactggaggataaaggaagatgcgaagagtcatgtccttcattttttacctctttactttaaccttattgattgggataccacactctacattctgctaaacatcagcaaccaaaagggaagaagacatagctcttgctgggctgtcaagttcactgacaaatcaacaaatgttgcatagtattttggacagtatgccttgagagctcataagaagttgaaatgaaaacattctaggcagaggggagcagcatattcacaagcatgactgcgtgaggaagcatgttacatacctgggtaactacagcagaaactccaggtagattaaagacttgattaccaaaaaacagacacacagaaacacttaaaaagctagaggagaggtggggtgcggtggctcacgcctgtaatcccagcactgtgggaggccgaggcaggcagatcacgaggtcaggagatcgagaccatcctggctaacatggtgaaaccccgtctctactaaaaatgcaaaaattagctgggtgtggtggcacacacctgtagtcccagctactcgggaggctgaggcaggagaatcacttgaacctgggaggcggagcttgcagtgagctgagatcgcaccactgcactccagcctgggcgacagagcgagactcggtctcaaaaaaaaaaaaaaaaaaaagctagaggagagattatgtataattatttatctgatctttggatggtcaaggacatcataaccatcaaagcaatgaaagaatatgcagatagacttgactatataaaaatatagaacttctatctagtaaaaagtattaatatttaaagcaaacataatgagaaagatgtttgatgtttacaacatatgtgctaggcaaagtttaatatctatagtgtttaaataaatatatatatacttttaagtttggtagcattaaaacaaaaaccctaatagagaaatgggcagaggatcagctatggtggctcatacctgtaatcccagcactctggcaggccgagacaggagactcacttgagcccaggagttcaacaccagcctgggcaacacaaggagaccatctctctctctttctctctctctctctccccctgttctccccacccccccattcccctccttctctcgtctctcaataaatacataaacaaataggcagaggacaggaacacagaatgtacagaaaaggaaaatcactggtggccacgacattgctgacatttactgagtgagtaacatgtgccaacccctttcctaagagtcctgcatttattgattgattcattcagtcctcacggcaacagttgagatatgtgcttttagccccattctatgggtgttgaaattgaggcacagttacacaaataagttgcacagctgcaaattgaacccaagcactttaactgttagccactccactccgaagtctcttaggtataatggctaattcaaatatgaaaaaaaaattgttggtggtttaaaaatgcaaatttagtaactgcaagattacaattttttgcctaccacactaacaaagagtttacaacttacccaaatctaactaagctggtggaaaatggacaccttatttacactgaagaaagtgtatattggtaggcattttctggaactttgacagtgtgtatcaaaaacatctaatggtttttttttttaataaaattttatgtatttaaaaactaggctggggacagtggctcacgcctgtaatcccagcactttgggaagccaaggcaagcagatcacctgaggtcaggagttcgagaccagcctggccaacatgacgaaaccctgtctctactaaaaatacagaaaatagccgggcgtggtgatgggtgcctgtaatcccagctactcgggaggctaaggcaggagaatcacttgaacctgagcggcggaggttgcagtgagctgagattgtgccattgcactccaaccaggtgacagagtgagactccatctcaaaaagtaatacataaaacaaaaaatagagacagggtcttgctatgttgcccaggctggtctcaaattatggagctcaagcatttctcctgccttggcctcccaagtgtgggattcaggtgtgagccaccgtgcccagcctccaatggttattttctaaaggaattcattctagggaaatcagcatattttaatcaacaaacattattttcatagttaatatagcaacattattttgtttcatattattatgttttaaatagtggacttctctttttgcctccctcccccagcccctgattatagcaatatggactcatagtagaaagttaaaaaaaaaggtgtaattaatagaagaaaatgtcacccagagagttaatgttttggtatatttgtccttcacactcattatttacaacaggtaaaaaactaaaacagacttgatatttcaaaggcaagagagaaccattcccacgagaaagttatggcacatccatataatggaatattattagctgctgagaattatgttctgaccaggtgcagtggctcatgcctgtaatctttgggagactgaggcaggaggatcacatgagcccaggagttcgaggccagcctgggcaacatagtaagaccccatctctacaaaaataaataaatgaaattagctgggcctggtagcttgtgactgtaattccagttactcaggaggctgagtcctccattaaggatggcttgatcccaggaggtcaaggcttcagtgaactatgattgcaccactgcactccaacctgggcaatagaaccagaccctgtttcttaaaaaaaattatctgggaatttgtaatgcttgtgataagcaagtggctttcaaaattatatatgtaatatgttctcaattatgtaaaaaatatgcaaagcaaaacaaatacatttctagatgacctctggaattagaattacagatactttttattttcttatttatactttttgctgtaactaaaaagaaaagaggccagagtcaatggaggcctgacagtgaggatgcatggaaaagaggcaggtcctgttcgttccgtagcaggagcatgcctggtgcagagtggtgctcagaaaatactggtatttattgaatgcataactgagcttggagagatagtgagcgcagctttatgtagctttcactgtgcgtttggatgtctacgtgcactttgcacagactccagagctcagcagggggtctgcattagagggagcagctgggagtcgtggacatgcggtggtagctgaaaccatggatgtgggtgagggcaaccagggggaagtgtatagggaaacagggctgagggtggagtgcttggagtgttaacatctaagggactaataaagaatgaggagctcgccaaggaaatttgcaaagggcccagaagtcagaagaaaattgggagataatggtgttaggaaaaccagaagaggtcagtatttcaacagtaacagtcacaataatcatcatagctgccacttctagagcccttgctatgtgtcaggcactgttaccggaattacacacatttactcacttagtcctcacggagaccctatggggtaggttactgtgaccatctctcttctgggacgagacactaagagacttgtctaagatcatcccccagagattcagtgccccagagagaaagtcataagaagtattctttggacaactgtatattaagtgcgattaaaagtagattcaaaaagcttttgactgttttattctgtttggttgggcgtagcgtctcacgcctgtaatcccagcactttgggagtctgaggtaggtggaccacttgaggtcaggagttcaagaccagcctggccaacatggtgaaaccccatttctactaaaaatacaaaaatatggatgtggtggcatgtgcctgtagtcccagctactcaagaggctgagataggagaatcacttgaacctgggaagcagaggttgcagtgagctgagatcaccccactgcactccagcctgggcgacagagcaagactctgtctttttttttttttctttttttaaaacaaagcaaaacaaaacaaaacaaaagcttgactgtcaagggctggggacacaggaacctagttgtctttatttttaagctggagagcctggagcatgtgtatgtacatcagtagggaaaagaaagagcagcgctgatggaaaaaatcgaggggaaaacaaaaagcaacatccaggcaggtggtttattacaaagtctgatctggcatttgatgaaattcaacattctctcctaactaaaatacttaaacctactaactagaactataagggttctaaatctcagattaactttttcttttttatcgggggcagacggacgtgtaactaacgctataaagggtaaaggacagctggatccaagtctacagacttacgtctatagtttttagagaccagataaacttgccattaatattaattaatggcaagttcgtcagttaagttaaatatcagttaattgtacattcaggcatttctaaaattagtatgtttgtggaataatcataaaaatgtgtcagcagtttcaatttttggctttctttattcagtattaaaatattgggcagtccttcatggaacaaggctgtaactataggaagcagaagtgattgaatgaattaggcattcacttcggggaattccctttgctggctcttcatatgttgagggtttcaccttagcttttgtgaggtccgtgtgctatttaaaaactgagtctataattaatcagcgctgctagaagatggtgcaaatggcccagttttgtgcctccaggttatgaatttggctcttgtcttcagtgtggtttgcagcgtccttctacatgtccccttttttagaaatgatactcccctccacccctgccccccacacacatatacagccaaccggatttaaggaaagcaggaactacaataaacttttgaggaaagatgctttagggtatgatttagtaccttagttcctttctcacttgagtattaatcagtgtggttttctgcaccgtcgttctttcctcctctggtttaatgacagagatttcttctttaggtgccacaaccacccacgtccgtagagatccccgggcttgtttctcctttagcctctgaatagttcttggctgatttcttgaggaagcaccgcattggaagagaaaagcatcttctctttggtttcctgctccctgcttctctgcccttttaagtccataaagcgaattaggaagaaagccacatacttcatttctacccaggggggtatcatgtcaggaggctaatcatatccactctctcagagagaaagctgcttcttcccagaatcttagatgcaagctactggtttaaatgttgtattatatgatggctaaatacagaagtacgtgtcatagtagttcaggttgccagctactactagttttcacagtctgccttcagtgggctattttgtttaaaagagcttccacttacaagcttttcaaaatacaatttaagtgaaacttaagagtgtttttaagtagagactaagtggtttcatcctacctgaaaattgccttcttgaaataaatgtttgatacccactggcctatctcctctggaaaacaggagttttcatttagaagtccagttggttggattccagtaagccgtttcacctgactgtattacgccccctggaaccagggctgtgcaggagccaccggcttctcccagagggcagggtgagcacagtatcagggcacatggcttaccctcaggagctgcatcccagcctcaaggccctggtgagaaactgtgctctccagcaagggtctctggccgtctctgcaccgtgtggtcagcttagggctgtgcctcccaagacaggacctgaggatgggtatgggtagcagagatattgctccctttgctcctgggtgtccagagctccagtgcctgtcacctcacctctagcagcctcaggagctgtgtaaattctgtcatatacatgatgagggagatcatgaagcactcacttgaatcataaagtctgtctgggggaggctgcagagtaaatattccactttccccacttacaggccccacaaacaagcctcagaaatgtgtttggagggaccatgacagcatctcttagggacttgtgttatttagttttctctctctctctctttttagtggcactaaccaaaaaaaaaaaacaacaacaaactaggctaagcaagtgcagagtcatttataaacttgcataggtcttttatatacagtcatttatcatttaaaaactgagattcattttgagaaatgcaccattaggcaacttcattgtcgtgtgaacatcatagtgtatgtacttagacagacctaagtcgaagtctataggttactacacacctaggctatgtggcatagctgattgctcctaggtgaccaacctggacagcagttactgtactggataccgtaggtgttagtggttgtaacataatggtatttttgtatctaaacatatctaaatatagaaaaggtacagtaaaaatatgctgttataatcttatgggactaccattgaatatgtggtccatcgttgacctaaacatcattatgtggtgcatgactgtatttattgttgattgcccatgtctttcaccaaaagtaagcttcatgagagtgtggactttgctctttgctgcattctgatcttctagaagagcctggcgcttagtaggttcttattaattgttgaacaaatgttaaattaattatgacgggaagaacttttaaaatgtgctttcccttctagtgtgtgattcttagggacaattttattttattagaacataaaccatcagcactggtttacttacttccaaatgatgctaggtatgccctgtcttctttcgaggtctggtacttttgctgaaatgcagcctctatcttaagatcatttcagttgcatcagaaagaagatgtcactgcctgctctaaaccttgggcggagaaagcagagctgtgacataatccacatttgtacatagcaggttgaagagacacttaaatcttttgcttactttttctcttatcagataattcatttcttgattgcatttatttttgaaaggaaaataccagctttagccataagaagctgtcaagaaagcttctctttgcttagccttcccagcagctacgctcctgggtgagtgcagtcaaggcaatcattaaagaataataagttatgcttttgaaatggtgctcaagtacttcatagccttttctaagataaggagcctcccacctttgcccccatgacacttgttggaaaatactggaccagcagctatatccttgggcttttgctgggttttggaagacacattttgacctatgtaatcaagtataatgatgacatttattttaataggattctagtctgtaatataataaggaaaatggctatttttccttattttctcattataatatgttacactaaaagcttctgccattactgttttattatattggtctgaggtacaatatattttaatatgctaaagataacatcaaggttgaaaattgagctctcagtgatttattcagaggttgactgttgctgaatgcattgaaatgagttgcatgagacagtgcggctaacgatttatttgtgtatctttttttaagctaagcttgtcataaataagagcaaataaatagctcttatagaatagtttgtattcattgcctcaatgaaaacattgtaaatatgaaacatacggtctgcagtctctctcattttttctgaaagctagtgttttgccttacatagctcagaattttttcaagttttggcatgcaggtggttggttttttttttttaccaaacaaattttttgtctgtttggatttctaacgttgactggcatttgcattgagttattttgaaatccactactggacaaattccattcaaataattggtatgagaataacctaatcttcagcagaactggaacaaaatgaaaccttagtgggaccatcaagagggcaggaacttggtcattgctaaactccaagccatgagcacagtgcctagcacatagaggatacagaataaaggattgttgggggaaatcaatgaatgcctgagtctagttaatccacttctttgtatgactgtcaacacctgccagatgcatccagctagcttttgaccagtagtgcttaaactcagatctcctctcagtctttgttttttacactttatttatcccttcatcccatccttcagcaaacatgctttaaatacactgtgccagggatggtctaggtgatgaggacataaggatgaatgatttagtccttgcccatagggaagtagagggtcagacacaaaattcttcccagtcctgcaatttcaaatttcagagaggctgtggcagtgcagaggaggaaatgcttccaactctattttccatttacccagttaagatatatagaagagacgcatttttccttgcttttctttttaaagactgggtctcactctgtcacccaggctggagtacagtggcgtgatcatagctcactgcagcattgaattcctgagctaaagtgatcctcccatgtcagcctcccaagtagctgggattacaggcacatgccaccattcctggccatttttcagggggaggggtggggggtcagctagagacaggctcttgctttgttgcccaggctggtttccaactcctggcttcaagttatgctcctgcctcggcctcccaaggcactgggattacaggtgtgagccactatgccctgagctgttgttaaaacaagatcaagaaagattttgctctgcttggttgaaattagtgctatacctcatttgggtttcaagagaactattcccccttgaacatatattccagcttgtaatagagacattatgtttgagatagaatattctaagataaaagtttgcttccacttacccctctcatgatggcatttcgtttttttgttctttttttttttttcttttgagaccgagtcttgctctgttgcccaggctgaagtgcagtggcacgatctcagctcactgcagcctctgcctcccgggttcaagcagttctcctgcctcagtctcctgagtagctgggatcacaggcacgtgccaccatgcccgggtaatttttgtatttttagtagagacagggttttgccatgttgcccaggctggtctcaaactcctgaatacaagcgatccacccacctcagcctcccaaagtgctgggattacaggcatgagccaccacgcctggccctaaacaacacaactataacttcagctggttgtaaggtagttttttggttggttggttggttggttgttggttttttgtttgtttgtttttaaatataatttcatattgggtaaaacaaaaggttttccttaacttgtttagaattgtttaggaaaatactagttaggaatctgattttttttctcccccatggatttgtggttagcatgtttgtactctaatattcatgctacattttcatgtttaccaatataaaaaccttttttgtaattatttatatggagtcctgctttgagttaacatcatagaggaacgctttttttcagcaaaattgttttaaattaatgtttctaaagtgtataaaaatggttgggtggattaaaagcaattcagtttcacatgaaccatttgtccacatggaaataaatatgcagcacaattacacggcagaaggtacgaaaaggtgttgctgaaatcatgagaaaatgtaatacaggcggacgtcagtctccacaataaatttgcatatgtccttttttgggggcaaatacagtcatcattttaaatgaagtcgaagagttatttctgtaaacaaaacaaaagtcctccttgtcatactagacagcaaggaagcaaaaattgttagggtcatgtcaaaaagactcaggagtcaatttgaagaggttctgaccagacaataaatataataataaagataaaaaattgcaatttattgcaacttgtcaaatgtttaaattcacaagttcataatgatactaaaaaacaaactgatttagaggataataggaaccagtttattttcttgaaagctgcaaaaattgcaattaaaacatttatcctgcctttcttacataaactgtacagtgaagtaatcaagtagtaaaggaggggaaacatcattttattttttaaatttttaaaaattttttgagacagggtcttgctctatcacccaggctgtagtgcagtggtgcgatctcagcttactgcagcctcacctcctagactcaagagatcctcccacctcagcctcctgagtaactgggacttcaggtaaacaccaccatgcccagctgattttttcattttctgtagtctctttatgttgtccaggctggtcttgaactcctgcgctcaagcgatccatctgccttggcttcccaacgtgataggattacaggcatgagccactgcacctggccagaaacatctttttataaacatattccagctaaccaatgaaaataaaatgtacggtggctcacacctgtaatcccagcactttgggaggccgaggcaggcggattgcctgagctcagggagttcacgaccagcctggacaacatggtgaaactccatctctactaaaatacaaaaaattatccgggtgttgcggcatgcacctgtagtcccagctacttgggaggctgaggcaggagcatcccttgaacccgggaggcggaggttgcagtgagctgagatcgtgccactgtactccagcctgggcaacagagtgagactccatctcaaaaaaaaaaaaaaaagaaaagaaaatgacagaattaaaatataaccattttgtaatccccaccaccaccatgaattaatggatctagacaatgaacaacatcaacagttgcaaaaaggacaaccagaaattatctatcttctgatcaaggatatttgtagtcttgccagtggatggaacccaagtctaatcaatcaagcactggatctagttaccattttgcaagagatacagagtaaagaggagcatactgagctgcagtgcaagtaggagatcagcaaaatccagagtgaggacagtataggtcaagtggccccagttcaaccacagatagattacaaggaaaagaaaggggtgaaggtggaacccctagattaaaatgacattaagatttttttttttaataggcaagactgttctagtgcctggactgttttggtgatgaaagtataaaaaaatgcaagagattattgtgaaagtcaggatagtggttacttatgagagagaaaggagaggtgattggctggagcggatagaaagttttctggagtagccggcaaacttctatttcttgatcctgggtgatagttacaaggacagttgccttataataatccattaagctgtgtatttgttttttgtcattttatgtatctctgttttatttttgttttttagaaagcaatcatcttaaaatgggaggtgacatcctatggtatcttagtgcttgggtttttgtaactcttgaaactgaaaacttactcgatttattggtggcatcctactagtcatgttttaaagagagacacagttttcaccttgactgcttgaaaatgaaaacttgagtgcacaagtatttagtgtacgggcatcaactccatgtcagcctttgcagagccatttttatgtgaaggaaatgtactgaaatttacttgaatcaaatcctctgaagtgttgagtctagttcattagagaacagcattcctgtaaatttcactttcactcttaaacttagaaaaacataattgaagggttgtgcgttaacagaatgaggatgaaatggaggattcggacaaggaatggtgatgcagagtgaggatggagtacagagaaaatatttaactgtgagcccgaggagagaaagaagagacactgcagcatgagaactgttttcccatttttctttttttgtgggaagaacagcaccagcagacactgtaagatgtgtacaggaaaattgctctttcctcctcctaggttgctgagcagttctaaaatttgtggtagatctttaggcactagaaacagaacttagagaaaagatgttaaaagttagatttttaagaaagggaagaaaaaggctacgatgacttaaaatgtcctgaaatgaggctctgctatttatcagaaaaacaggcttccttcttcttaagaaggtgattgtctgttcatagactaggagtcctgccctggggttcacccagcgttggagcttttctccatgaagttaaggacattaataagatttttctctaccaaagcagaagatgctctgaagacagcctttcatccctgtagcttttgagttgcatccagttaaaaacttgtagaacataatgaatgtttttagagaggaaataaaatgaatgatgcccgtgaatttgttttaaacattgtttattttacctaataatttatataaatcttccttgaagaggaagagaaattaccagatttaattaataattggaagctttttagaggatttactttgaaatacctccctgccaatttttcataaattaagcataaactttctttgacctcatcacacataattaaatagctgtggaagggttaaaaccaactaaaaagcaattctgtatctcaatctccattctcctgcaaaacttatacaggaagtttgtttcagttctcaagcagggtaattacaagagacagttacataatttacacttccaatctacttgtctataatcacacacttctacctagttgtatatacccccatgagtatgtgtgttgtactttgatttgtaaatgatgattgcagtgtgattgattccttgcaatgtagcatattgaattcattttttaaaaatgaactttagctgttaacatgtctatttgagttcctgttatttacgtagtttgtggttcttgtgttcagcagttgcataccagctaacaaattaaactcccagagctttttttctcattaaatttggaaaatagagtgtctgtatacaacctaaatagaaaagtacctagtacctagtaggcactcaactgttggacatagcacaaaaccatttcaagcctttgcaggtggaatggagattctttgattaacataatataaagtctcatggggataatattagtatattgtggtgaagctctgctaatattaatgtattgttactgaagtctaaaatttagccaaacagtggacagaatagcggttcattccaggggcttagagaaatgtgtcatctacaacctaagaggtagtcattgctgtctttaatgctgctggtgacgatactgcatatgtgtttgtttttctaacagctaacatctactgtagccagtttggactttaagattccctaagattaaaggctaagtccctggccgggcgcagtggctcatgcctgtaatctcagcactttgggaggctggggcaggcagatcacctgaggtcaggagttcgagaccagcctaacatgaagcaacccgatctctactaaaaatacaaaattacccaggcgtggtggtgcatgcctgtaatcccagctactcgggaggctgaggcaggagaatcacttgaacccgggagatggtggttgcaatgagccgagatcatgccattgcactccagcctgggcaacaagagtgaaactccatctcaaattaaaaaagctaagtccctacatgacaccaagtccatgggcaaaccagccagtcacttgtctggcccccctcccaccctagctccgctacccagggtgcctttgtgctgcacagcttcagagggggctcagcaataaccctggggggacacaaccattgatctccagaggcttcttacctcaaatcacgtttcaaagcatttgggagataaataaaaaataagcgaaaagaaaagtagaccagtggagtgggattgtttgtctagataacctgaggacaactagcgacagtttctcttacatttccaacagtggttgatcagtcagattaggtgatgggctgtactttgattttagaaagttatctccaaaactgacagattcctttttgaaatgtactttgtttgaaaacaaagaaaatttctaaggagatttgtattctcattttttctttcttcaatcttgctgtgtatttttgtttgctgtgtgaaagctcatcatccagaattggaattacaacatactttgtcctatttttaaaaattacagctggtacatacacacaacactcccttccacatatacacacagcattttagggggcttgtaggagagcaaatggaaaggcaagttgctattccaaccatcctgtctcccaaacctggttctgaaatcagtggtactgccatgattatgtaaatagcacccctctcccaccctccaccatcggtctgtggggttggaccagaccagatgactagatattagaatgaagtgtctcagctgcctcagtagaacctcagacctataaaagtaggcaaaagaagtctcagtttttgcatttagtgatttagttaaggaaaatgttcaatcgcagtgttttcgcagcaggagaacaatcttaaaggtaaagcattttaagtgcatgcagtcatttgtttggcgcagatgctttatttaaagtgtatatgtgttcgattaagtttgccatcttaaagcctttcagtggtaagttcttgttaccagaattttgtaacttagacatgaaaattttatccaagtttcaacttggggagcaagcctagggggagccaggtatttaaaatgctttcttttagtgaaaactgaagaattaagttgtcttctatttcaattgtgttattttctatttcaaaaactatttctttttttaatgaatctctaatgtagacttttgcctatttataagagaggaaataattttaaaatgccaaattacttcatctttaaatttttaaaaataaatgtgtttttcctaaaatatcctagaatttaaaagtggtttgaactgtggaaaacttaaaaggtcaaagaggaagaccttcctctgcatgcctttctaatttctgtcatgctgaaggccatagcactggggctttctcattacctaactgaaagtgcctctgggtcacaaatcagagcattaacttagtttggtgataggcagtgggcttcgtgaacaatttggttacttcaacaatttggtaagctattcttacatcaacatatttttaaaaattcttgccttccccaattttagtttgggcataaatgatactgacagagtataacatctctcattccatgatcattttatctgtgtggcaggtgcctcattttcctaacaaggaaattgaaggatgaatctatatcatagtcagtcaccttattaaaaaatttttattcttctaatccactagaccaggaactcggttgtggtgacacaccatacactcacaaatactcctcagttgaatgtttaatgaaatgaaactctgtgaagtgtatcacacagttgtttacggagtggccatcctcccctgcgtcagttcagagatttgcctgctgctgggatttctcattaggcaccactgctaccactatagccctgtgaggtggcaaaaatgaagaagtggtgctgtaccccatttaatattctggcccaagtatagtcccccaaggccctttccttactgggacccataatatatctgaaaccaggcaagtcatgaggttgggtggaacacagacatctgtggctttttaaagccccaagtgagtctgatgtgcaggcagggtcgagaaccactgggctatacttgaagacagaagaaggaacaataggccaggtgcaatggctcacacctgtaatcccagcactttgggaggccgaggcaggagggttgcttgagccgaggagtttgagaccagcctgggcaacatggtgaaaccccatctctacaaaaatacaaacattagccaagcatggtggtatgcacttgttgtcccagctactcgggaggctgaggtgggaggatttcttgagcccagaaagttgaggctgcagtgaaccaagatcacaccactgcactccagcctgggtgatagagtgagaccgtgtccaaaaaataaaagaaaaaggagcaattaattctctcactgggtaagagaatcaggtataaatgccatctcacacagatgtctctggccctcaggctgcttccatgtggcacgtgctatcctggcacctccggctcaggagcacatccacagaggtctacgcttctcaacacaggggcggtgcagagggagggaagtcccctttcgtgctgcctgatgccctacttgtgagttcattttctttctgagcacctgtacctttccctgggggactgacatgcagaatgaccaaccccgcaagggagtccacacctacccacagaaccatggaaccatctggtaaatcccagcatggtcagtcagctcagagacacaggcacaccacacggcatcggggagtcacactcctgccatacatcttccactgtgggagttgaaggaagaccattccactctggaatggacttgaaaggatggggacattcagtaagaaaaatcagtggccctttggggaagagctcagcagtggaggtctgctgaggaacttgtgggatcccagagaagagagatctaagagtggggcttagagtaacaggctggtatgtgacccagggcagccagcctccttccccaaagacatgctgtgtccatgctcagggtttcactgggtcaggccattttcccagagacacacttgagtcttgttgaatatttgagtctttcatctgtcttgggactgtccctgggctctgctgaagccctaagcagtcattgtttctgtggttggatgggctagccatttcctaagggtagtccttgaagttaaggactaaggggccaaagggaatttgggggcacagaactgtgtttgctgggaactttgttgccatttcttaagaccactcctgaggcagaattttttttcatagcctctttctttaattcaattgatatctgggtggttagctggggggaggggagaggaaggaagggtgggatgagaggagagcttctgtctgagttcatggaatggtttttaggttcctcaggcaaaagtaggaaaacaaagttagcttttctcaatctgattctatagagcagtctgtctctgttgtttcccttctgtccaaattttatttctttcccctaccttaaggatgtttagttacccaaatgatcaccttgagacttgattcattcagtatgttgaataataatcatagctaacacttattaggattactgtgatgcgtcaagcactgttctgcatgtttcatattaactcaatccttaccagaactgtaacagttaggtacagttattattcacatcttatggatgagggatctgaagcacagagaggttaaataaaatccctgaggtcacacagctggtacatggtggaccccagattccattctgggtagtctggctccagagcccatgctttccacccacccatagagcctctcacgatctgtcgtattgtatgcaatatatgacatattgttttaaaatacgggtgccctgttacccagctttaaaaaactcatctttgtttagtgcacatggtctcaaagtatggttcagggagtctacaaggtcataattattttccaagtagtactaagatactctttttcctttttactttcattttctcatgagtatacagaggagttttccagaatgtcatgacctgtgatatcacagcagactcaataccaaagcaatctatgaaaatctagcaagctgggtgcagtggctcacgcctgtaatcccagcactttgggaggctgaggtgggaggatcgcttgagcctgagagtttgagaccagcctgggcaacatagggagaccctgtcttcttgaaaaagaaaaagaaagaacaaaataaagagagaaagagagaatctaactggcttctcttaagccagaagttaaagagatttgtaaaacatgtaaaataatgccactcttttcactataaattttatttatattttagaaagtataggattttttttaatttaaaaaaatgttacataatgggtttatcgttatcttttagatgaattaataaatatttgtcaaatttctcagtaaaattaatagatagagcccttaaaagcaaaagctctctgagtgctgaggccaaagcatttgaaaactaccgatttaaagtataaaccattgctattcaagtgtggtccatggcacaggaagttgttagaggtgcagaatctcaagccccacccctgacctactgaaccggagtccatgctgttaaccagaactagtttgtctgcacaatggaagttgagaagcagaggtgtagaacatctgcacgaagcgatttggcaactcagtgacctctagccaaatttcagtctggtggggctttggcgagtccattctccaattatcttgcatccaaggagctgagtgaggtcttacctatttgagattcttcagtcctactgtctcttaagtggccacaccctcatcaaagccagcagcttcagagcagggttctagtggtggttttcaaactcgggtacatcagaatcacctgggggacttctgaaagcacagatgctgggctctgcctctccccaccaaagatcctgattcagcaggtctgagataggttctgagaatttaaagttctagcaagttctcaggtgatgttgatgccacaggtctccacactgagatcttgataaacagcatttattcaagttcttatataattatgtcatgcccataggacttatgggagagaggtcttaaacttgtttcaacaccaatctcttaaaagtaaaatatatgaaaaattcaaaatttccgtctttgccaaggaggcacctgtatcttttaataagtggaaagcagtaagatatcaggcaggtcacaggtcatttagagcacggctgttctcttaaaatgatgtgagaactaaggttcagcatccttctgcactaattgcaaaatcaccacaaaatttaaacgaggagatataaatagcctgtcaagttcatttgtcattatttaaactgataacatgccattcatccagttggtcagtgctgctctgcaccagaaaccaggaacagatgagcgtacaaaccagtgaattgccatctccaagcatgagataacttggttagagtcatcagatttcctgtgctcaaaagctgccataaatccctggcctcgtgtctgttcccaggcttgcaaacccagtgccgtcgactgatacagacctttcagcaggatttgctgagctaaacaggtgtctgatgaaaagtgtgtaatcctcaaagattatcatcccctaaaagcagctggtgaccccaaactcacataatccagagagatggaagttgggagtgagtagcttgccaaagtttacactttggtgtttgaggaggttcatatggtttggtttggttccaggtagtggaagatggaggtgtgcaggggtgagggtgtctgcccctgtcgggggagatccctgtccctatccatgcccttgcctgagaacattattctactatggtccatttacactcttgaatactcctagtttaaagggaaggaattttcattttcaatgagcgttaacattacagttattatgctgggaattaaatttaatttgggaatttgggtctgcaaaaacatatcttgaccttgtctagatagttccttccttatcctaatagatctgtctacatgagataactctctaccacttttattttctcccactgggagagagttaaccatttcaaactcagggctagttaacatgagatttgattcttttactgcaagtagttaagccttaacagaggtgaggcacactcgggttccatgcagtacagcttagaaatgcttactttttatagacagaaatcacattgttcttcctttccctttaagcagacatcttgacaatcctttgaattgattatgtggcctgtatactgaaagtcagatgtcaccttccccaggataagtacttccagtaaagcaaaagaggaagccagcttttgctacgatcaagatagttgatgtggatgaggggtttatgggctaccccgttttcaattacaaggctcccactcacagagtaagtgctgttggccagcacctctggctcacagacaagttccagggaataatttcaccagcgattaattatactgcagctactgggatttgtcctccaaacatcactttgttttccatctgaaacagccaggtttctccagggagagctgaggttttctgattgaaagtatcccgagttaaggagaagtgttagagcaccatgggaatctattcaccaggggtgtactgtacttgtttcagatgcttcaggataatacaccagcttctaagataagtgcttttttttttttttttttttgagatggagtttcactcttgttgcccaggctggagtgcaatggcatgatctcggctcactgcaacctctgcctcccggattcaagtgattctcctgcctcagcctcccgagtagctgggattacaggcgcacgccaccatgcccggctagttttgtgtttttagtagagatggggtttctccatgttggtcaggctggtctcgaactcctgacctcaggtgatctgcccacctcagcctcccaaagtgctgggattacaggcatgagccaccgcgcccagccaagataagtgttttttatttccctgcatcttagatcaattatttggaatttttttggtaagttaagagctgtaacttaaaccaccacatctctatgatgtactcaataagtgaaatgttcttaccaaaaatttttcttccaatgggctatatcataattatgttgtgaagagcctagaaaaaaatagaggccgggcacagtggctcacgcctgtaatcccaacacttgagggactgaggtcaggagttcgagaccagcctgggcaaaatggtgaaaccctgtctctactaaaaatgcaaatcttagccaggcatggccactggcgcctgtaatcccagctactcaggaagctgaggaaggagaatcgcttgagcctgggaagcggaggttgcatcgagcccatatcgcaccattgcactccagcctaggcaacagagcaagtctctgtctcaaaaaaaaaaagtacaaagaaacaaaaggtggcaagaaattcgttttttaaaacatcgcatgttatgagggtcagagtagtgaagtgccaccagctgcagccttctgagaggaagtgctgctgctggttcaaatggaattctgtcctacatccaccaagcacgccagtggagtggacatgacacacacttttcttctaagctgtacagtttaacatattacaagtgagttcatttaactagtaaggaatcagaaatgtatctttgttcattttgatcgttttgatggattctgttttctcttacgtgagtagactttgtggacttccaaatggctcctggcataagtgccagttcctgctattagttccttgagggtctcatgagtcagagaggagagggaaaaacccactgcaagccatgcaggggtcccttcggatagtggccttgtgcagtctgcagtgtcggtgcacgtcatccctgcacacccgcctgctgtgctctggctggagcttgggtttgcagttgtcttctttacagcacccagggaagcatggcctcctggcaggtgttggccactccctgctttctcctggcctttgcaagcacagtgcaagggtgtttgctgaaaaagaccactgggctttcagtgtacccacacccatcagggctgatcaccctgctgccacctccccaggactcttccgtgactatcagtcatagcctgaagtctgtgtccaagggagtgtctcaggagacagccacttaacatggtaggagtagcaggtgctaaaaggtttatgcctaaatgctccccatggaccccaagttgcctgctggtttgagtggcctaacccatttaggctcaggccctgacagggtgtgtgtgcaccacttcggggtgtgaaagcatgaacagctgcggaaagcgtgggttttctgatgctggctgctgctgccttccggattagggactgtagcggggagacagaacaaaggaacacatgtgcttctgggtaagctggcccatcatagtgggggacataaggtatgggggggcacataccaccttggtatgaacactttggttgtacagaattctttcagcaaggctgagaggagtggggctttctgtccttgactgctggattcaaataagcaccagtagaggacctggggactttcacactcactgcaggggactttcaattgtgggatctcatggacaaaagggaatggttctatatccacggctctatggttctcacccccccaggagtacaaagctgggaccccccagcctcctgggtacgtttctcagcatgtgccaagcactttggaggcaggtgacggatgtgccaattatctgtattctgaggtgtgggctcccttcatactctggcaacacagagacgtagagagctcttcttcgtgttgacaggacacaatatgggctggcttcggcacagtggccatcactgtgttagcattcctgacacactgctattgaaagccccaatctgctgccaaattacatgtagacagtggtttcactgtaaaatgttgcggtgcttgtttgcattcagtcaaatactttgcacttaaacatgggttaaagagacaaataagtcaaaagaccttagcaaaacctgaagttaaatttacgcctattcttcataatggcattcagattaaagccatcaaaatgcaaaatgctgtgattatacccttcgagggttcaggctggattcttgttttgtatttctgcattactgtatttgcagtgattttgagatgcaggaaaatgcatcagaggcattgatttcttctttaacaaaaaataaccctaaaattgagaaaattcttgagaatgcagccattttggaaatgtagataaagaagaaaaatgctgaagatttgggtggtttatggagccgtatgattttgtcattgctgccacctactgtatgtggttgatgtttgtttaaacttaggaagttcatgaaggtgaggctgttgaaatagataattagagcaaggtagacatcattagcttatagcatttcttttctaccccataagtggctcttaattactgagacagccgccagctttcattcattaccttcaagtggatttaaagggctggtttctttttttttttttttttccatttttaaagttcctttgccaaggaaccttcacagtaatgctgtaaaatgcgttcaaaagcttaagatgctgggggattttctgagcatacatgcaataggttgttttaaggagtttgttttgttttgtcttaatttgtaggagcaatattctgggattggattgtaaattaatttctatgaaagaggtgaaaatggagctagtggagctgatgggagttgcagcagttgacttgaaagacattcttttattagtcctaaaacaaagcttcagatcaacctgctagttaaatgtaacaagcaatatagactctgagtcaacagaggtccttctctttttattaagacccagctgtcaaagggtcattaggtccttcctgtggaaaacaacttgcccattaatgttgggggtggtccctcgacaggatttctgagtaagtgcctgacatttcgtttttgaaagaatctaaagctgtgggagacttagatgttgagacttagcaggagtaatgtcttcaaccatagcttttagtctttgttaaatatgtcacaatatgtgtttggaatgctgctgctagctgcgtgaattgacttagagtgccactgtcaaagattcaggagcgtaaacttcacggagatcaaatcactataactgggaagaggctacattcctaaagcgaatgcacttctctgttgtgatgtttttaccttgtcactactcatattatttctagtggctcctgttctaagctctgggaatgccacagtgaggaatgcccatttattttttctgccctaggctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcaggtgagtcctgggaccctgggcagctccgtggctcaggcatcccacaccagaaagggtccctggagataggtgcattcattccagttaaagactgaggttccctaacagtattatcaaaccttttctcctaaaaataacacatgaaatgacacttttttactggttggattccagtgttctgtaccctctcattgaggtgctttctgatttttcctaacgcagataacattagtgctagcatatgtccgtatgtgaagctgaagtgaaatttcagcttgtgattacatcttgttctgccttatcacattacagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggtaatgattgtctttatcatcctaagttgtgtaacttcaatcttgtagcattcttaagctaagaaagtcattaagatcgttgtcaaaagcttggttatgtagagatagcatgtgaaatgatatggcactaatttatcctaactgaggttgcatggtaagacatgataattttattgaattgagtatgaaaaatgaaacatttatcattgattacaaagcagcatttttcactactgagagcatgtaatcagatcaaattcggtgctgagctccaaggctgcagtgtcaattgattctttgtgtttatgaacttgcttaaagtgctccttgccagtgagcatgtaatgtagtgataaaggactcaaatcaattcgctgcatcattaatactgttaaatatcccatgaaacccaatcttctttgatttgttatcctaactgatgcaaaaggttcctgagatgatgcagctggaatgtgcttggctggctggctgtcctgatcagaaccgacttagagacactttgccattgatcctcagaggctctggctgtgtaactgccctctcactggccaccatttttaccctccccacttaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaaggtaggtgtctgtttagattttctgtgagtcgcgttcaatcaaatcttatttgtcattgcagacattctgtctattagtatttgtttcactctctgttctttagtcgtagtttatgtgtacccagtcccgctgatcatatatcataatcgtttatctcacagtcatgattatgtttacttttcaggtttgttagtgcggtgacaggaaaccagggacaggccagcctcctagtctagtagtcactgccacctgctggtctgcaggagtagagtaactgaggtttatgggaacaaaaaggggccccagaaagcacttaaaccaccctccaagacctagaggccaggagacttctctaaggtcatatgactcattagagatggaagcagaaccaaatgcgtgctcaagactctaagcctgggttgggcgcagtggctcacgcctgtaatcccagcactttgggaggccaaggtgggcagatcacctgaggtcaggagttcaagaccagcctggctaacgtggtgaaatcccgtctctgctaaaaatacaaaaaattagccagacacggtagtacgcgcctgtaatcccagctactcgggaggctgagacaggagaacccagggaggcagaggttgcagtaagccgagatcgcaccattgcactccagcctgggcaacaagagcgaaactctgtctcaaaacagaacaaaaagactccaagcccagtgctcttcatgctgtttctttctcttgttcttggcacagaattgttagaaagcattttaggcccttaattttgatggtgatattttgcatttgtggccaactgcgcattactgaatctcctcagatcttagtagcccagtgatgtctctagatagaccatatcatctccaatggtacagaaagtaaagaattgactttgtttttaggtaactgctcacccagatctgatatctttgtcttcagtatctatctgggacatagaggagagccaagactgatagagatatcacaatacaagctaaggctccgccccaaggccatctgatgtggcatctgttagggaacttgctgttctaactcccagctcagcgctcttctaggcctggcagtcttctggaagggtctccatggggaggtggtagaaaggagcatcccacaaagtagacttcaggcttaagaataatgtttccatttcttaggaggagtgtgtattcatgtgttgtatatataataaaagaaatttgttctaaaactatcaaaaaccagaatcatccaaggcatgatctgaactggactcaacctgaagaaaaccagttctctaccttggcttccctcatattagggaaaattctcatggattaaagagggcaggcagactggggggaataataaccgtaaatgtttaattacagaatatgattaactggctacgtgtgtgcttcagtgagcattcagagcgttaacaaaagtaagacacaagaattcttggaggccggacacagtggctcacgcctataatccccacactttgggaagctgaggcaggaggatcatttgagctcaggagttcaagaccagcctgggcaacaaagcaagactctgtctctataaaaaataaataagtatttttaaaataataataataataattgaatacagtttacctgaaggttagcttttaaccaagcatattgaacccttctttgcagtgtattttcaataatttggggggcaacaattacatcttagcagcaaatctacctgctattcctctatttgaattttgtgtcattaaaaacttttttgctgggcgaaaaacattttataattacaattatggacagtcatttgtgccaacctttagtgcaaacagaaaaaatatttttaggccaggtgcggtggctcacacctataatcccagcactctgggaggccaaggcgggtggaccacttgagctcaggggttcgagaccagcctaggcaacatggcaaagccctgtctctacaaaaaagaaaaataaaagaaaaaaatatttttatatcatacaaataagacatctggcatgtctttaacatttttagattccttctattaaaatattttgccaggttatcagttgctcacatctcagcagccaccaatacttgactttgttaacattttaaacagtaatcctttcttcaggtacctttcctttccttttcatagccctgaagtcctatggaatgagaaaaagtaggctggtcttgtatcatatttcccagtgctgtccacatagtgggtgctccttcaagagttctcaagtattaaatgggttaacccagtggctagttaattacagcaccatttataaagacattagagtctgtgatgaccttaaatgtctgtgatgtgaggaatattgaagccagcaagtaccattggaaaaatatatgctagaaaagcaaagcttagtttttaaaatctccagtcaagctgctaggatgttccctctcagagcatctgcttgagtaaacaactgttttatttggaaaacacttgcctgtgtagttggagcccgagagggatgttagacatcaaatggaaggttaagtacaaaggcattacagaagtcaccacgtgtaagattctcagacacgcgttcagtacatgtctactgcatatcgactcaaccatttaatttctcatgagctcttatgtgttatgtttggaattaatttcagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaagtaagtagaggaatgataaaaaccttacccttgagaatgtctgtatctgactgggtgccaaagagcaggcctctggcgtgatgcccagaggcacctgcgaagtggtgctgatgcacctggagcaagtgcccatctgccctttcccatccttacaagcttctctcccttcttcctggaattggattttatgttaaacaacttctaaggccagaacattcctctaggtgggttcatcttacttaccagaaattggcttatccccaaaaactttgaagtctgttgacaagaaacacattacatttctttgattctaatatgtacttttttttttcacatttagttatttctgaaatcaaggtatatattattatcagtgtgagcattgaatggaatcgtttcttttttcctggaaaacaaatattagtaaatcaatagtacattttataatcagtagtgtcgtagtatatactactataaagattcatctaaactaagctgggcatgatggcttacacctgtaatcccagcactttgggaggctgaggcaggtggatcacttgagcccaggagtttgagaccaacctaggcaacatggcaaagcccctactctaaaaaaaatacaaaaattaatcagatgtagtggtgtgcacctgtagtctcagcacttttggagactgaggcagctggatcacttgagcccaggagtttgagaccagcctgagcgacatggcaaaaccccatctctacaaaagatacaaaaattagtcagcagtggtggtgtgtgcctatagtcccagctacttgggaggctgaggtgggaggatcacctgagctcagggtgagccatgatcgtgccactgcactccagcctgggtgacagaatgagaccctttctcaaaaaaaaaaaaaaaaaaaggaaccatctaaacttacccacacatcaatattagctttgataatattgcataacataaaaatcagtaaactgactttccttttaagttgacagggacacctctaccccatcctctaaaaaatacactgaacaccagtgaatcgtctttaaaagcacccatccttgcctgtcaggttgagaacgtgtgctcccagctgaatcatgagggtttatggtatactctctctattccctggccaagatgactctattcagaacttactttaatctggggaacaggccatctcatttccctgggaaccacaggatcactctagcttttgaaaagccacagttttaagaacatatgcaagcatcttcttgattttcttagttcacagaaatgctattcctgcatacagtattttgctgaaggaatgacttcttaccctgggtatagagaaaccaagccttattctttgggttttttttttttaaacaaataacaaactgcagtgagcgatcattttgtgtgtgaaaatgaggtttatttccccttcttggctgtcttctcatattatgcctgattcctttcaggatgtccttctttcttaaaaataattgtcagaaagctcatcttctgattttgggaggtgttccaacaaaagccggtaggtccagtagcacgtagaataagaatgcagaatccagccaggcatggtggctcatgcctgtaatcccagcactttgggcggccgaggtaggcagatcacctgaggtcaggagttcaagaccagcctgaccaacatggtgaaaccccatctctaccaaaagtacaaaaaaattagctgggtgtggtgatgcatgcctgtaagtcccagctacttgggaggctgaggcaggagaatcgcttgaacctgggagacagaggttgcagtgagccgagatcatgccactgcactccagcctgggcaacagagcaagactccgtctcaaaaataaaaagaatgtggaatccgggggcactggcatggctattacctgccattgtgaatagaaatgtcctgagatgactcttaactcgggcatggtactcggcacttctcaaggaaacattctacatcacatatgtgttcttttcagctggtcggtttgaatgtaatacttgcaggtaagtttatctgtaatccttttattacctaaatcagccagtgcttactctgctgtccaccagttggactagaactcactctattctggcagaagggatatctgttttatgatgattgtgagatcttatttttattctccaaaatagagtttctaataagactattgttctatataaagcttttcctttaaattgaccactgattctagaagattggtgtaatctaaagatcttaagaatacttgggtgcttcatgcatatatttattaatatatatttattaatatgtatatagctattcatctgcttgtataaatatgtacatatttacatttatattaacatgtgcatataggttcagtaaaaagctcacctgaactgaaatgaacttcacaattatggtttgtttctaagtgtctttaatatgcaaaccttacatcagcaacatattgatccagaattcagtgtggacagaattagtgttaaaaagaatacctgtattttaaatgttcaggaatttgctagtaattacattgtagtttgtatcatgcaaaaatgatgatcctaaaaatgatgattacaaatgcatttgttttgggtatttagttatttactgatttgtttcagaggtacacagcttatttttatgccagagagaacattcaaatcaaagtaaataaatcatgtcttccaagatcatttacatcctataaatgtccacaaacagaggtttactttctctaggtagatatgagagttaaggcttctagtcatttttccaggacagtaatgatttgtatataagctagcattaattcctttcccctatatttcctaatttgtaaatgttcaaattgatttttttttttacactgtggaactctgggcttttgcatcagagaatgtcttgttcattaaattcaaataagcacattagcattgcctatatccatgtgttcccaatatgttactctcccaggcctaggttatttacttggtttataacacaatattattacacattagccttgattatgtctttaccatcaacttttaacatgccaaattgaaagcagtgtttgctaattaatttagaggaatgaattcaagttgcccatggttatgctttctaagactgttttttttccttcccgtttttgtctcttcactaagacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttttcttttggactttgatcttcatttgcaaagagatcccgcacaaatatccagctgcctcactcgcacagtctgtagaaacatccctccaagcctcgcaccagggtagcaaacttcctttttataaagattcataccaaaaaaagcacccaatttgggattgtatgtttgaaaaatcattttctttttaaaaagtgtgaacgttttgctctgttgtgaatgattaattgtatgttttctttagagtctaaagtttagaccccctgccaaaagtgaatattcacaagtatagcgttcagagaaagttctgagtgttgcttgaatttggttatttgagcaacaagtctagaaatgaatgcttgacctagcacccgtgtgaaactagcccgttaagctctccaggtgtctgaacacgtgtgctcgcaactcctctgttaagcaggtcactaccctgtggaggaaaaaagttgcttttgcactgttgattcaacacacacacacaaaaattagatgttttacaaagcatagacataagccttaaagtggacccaaaatcgtgcaagggcaggatagagcgtacacaccagaataaaaggccttgtgcagacagagggtgcccagtggagttctgccttgtactctcacccttatcgttattttctttcacagttacaaagtgtattgggtttagtgtcacaattttatcttttagtcccttccttcctcaactgcaaagtcaatgggggtaatatatgtaacagctgagggagggctttcaagaagacacgtctgaagggccgtcagcacaaagggaaaagatccatttaagctgctgtgctaataggaaaagaaacctatcagccatcctcagagtaggaagtggtggtctatgcctgcacaaatcgaacactgcgtccattcaggagtggccaaggactgggcagcccagtgggccacacatcgggcaagaggctgcccgagccctggaggtggggttggggcctggaagcaatctgatcgggaagcagagccccgaacgggctccgacctgtcacatattttgtctctttcctcttgggttaagattctctgggggctgagattcccctctgtgttccctttggccatgacctgctaatcacaccttgtggtttgtgcgatgtctgagttcccataccctgccagcctaacagccctctaaaggagcttgtggaagagtcccaatcattgccccagacctgccaaaccctaatcttagaacagtcccagggacacctcggttgcccaggctccttaaggactgcagcatagctaggactaggagcttccgtgctggccccagtcccaacattccttgatggaacagaaaggcttagcataggaaggaaactgctgatctgagatggcctcagaacaccctgccctccacctcacccactctcactagagaaatcagttcacatctgaatgtgacgccaaggatttggcgaaacaggaacttggattcatcaaagctgaattcattcgattgagattcattaacaggccacatcatttaaaccctaactgtgttctattatttgtaagagtcgtaccaagtggtggtcagttgccagcctcacgttttaatagttgcaagtggtgcctacgccaggtgggagggcatccaccttcctcaccaacattctattttagaagtaatgactcacaatatcgtcacaaagctttcacaaactcctcccacacacccaccctgtgcaggaaatggggccattctttccaatgtacagatcaggatgttgaggctcagattaagctacattaattacccaaactcacccagctaaaatgtgtgagctgaaacaaacccaggtctttccaaatcccagctctttttttctaggacactgtattctgaaaggccctaatttgtcacctctctgatttaaaggcttggctaatgaatacatgttgctgtaaaaactgttaagtgctatataaatacagatccctttgtggctgcgagcaagccttggtctacaatcaatcttcgatactcaaagtacacgtactgttacattatgaagcagcaccttccatttctctgtacccaggtttccatcgttccttctaccttctccatcccctttcctggaccttcctcctccacccaggcttacctataaacattgatgttctgcaacactcaggccgggagtgttctctctgttttctctcatcatctcatctagtatgatgacttcaaattccacctctctgcaggtgacacccggaattacatccccagttgtgaatattcctctgagctttagatgccacgtcaaatgacctgggacaccttttgtacatctgcatgacaaccgaactggtgatttccgaccgctcctccgttcctgctctggtccatcccatctcagtgttaaagcactg

SEQ ID NO: 14173 - DNA, 54601 bp, Human
  misc_feature (1)...(54601): n = A,T,C or G
atcttctgtaaagggcctatcacagcacgattaggagtaagagactgtggaacctatcttgagatacacagaagggaggctgaatcgtgcccaatattactgtctgcctgtgttcccctaaccttccaaaatgttcacacaaagtaagcagataaacattgtttctgactttgaagctttcaggctaaattgaagagctataaatgtaaatcagcaattgtacccaaagtgttgcttgattttctatttggctctgtggtagggcccatcgcgtataattcctcgtgaaagcgctgggtaacagaaagctttgggcgggttaaaagacctcagctgtggccgactttgcctgtgtcactctatgcgagtgggcagagcactgaatgtctgttggccttgctatcattctctgattcccaggagtgaattgacgctcaaatggaaagtaaaaatggatgttaaggtaaatgggagattgaaacacagaatcatcaaaaccaggaaaaagagctgcaggaagtagtgtgcaaggaggggtttaaaaaacgcagccagagatcctcgggattctcagcgtcgctttcctgttagtttgaggttcgaatacagtatttgcgtcgtctcacatacaacaaataggtgtctgcctgcacgttgccaacgtgactcttggaagaaaagcgagaagcagcaaaaccgagcaagggagttggctaaacggctgcaagaaacacacacacacacacacacacacacacacacacggaagaaaagcgagaaacagcaaaaccgagcaagagagttggctaaacggctgcaagaaacacacacacacacacacacacacacttggaagaaaagtgagaaacagcaaaaccgagcaagggagttggctaactggctgcaagaaactctctatctcactctctctctctctctctgtgctgcaagaaactctctctctctctctctctctctctctctcggaagaaaagcgagtaacagcaacaccgagcaagggagttggctaaacggctgcacacacacacacacacacacacacacacaccacacacgcacacacacaccccagcagtcatgaaagaaggagaggaaagttctttgttgaaactccgggttcgaaacacacacacacacacacacacacacacacacacacacacacacacacgaaactccgggttcaaagctatgggccccaccccgctcaggactgcctgccacgaggccgcgcagagatgccccaggcgcggagagaagcggagcacagccgtgctagggacaggggcgccaccctgggcgggactgaggtgggatcctggctcccggctttggcctcccagcccaggctcggggcttcctggcgctcggaggccggggcgggccaggctttgcagcacagggcgaatctccctccctccccgggcgccccccgggaactggcggccagaggttaagctgacatgtttgcagacggtaatggggcgctggatgccaacagccccagctcaggggagtccagatttatgtttcttggaacaattctttcctccattgcattaacgccaaaaaaaaaaaaaaaaaaaaaaagccacttaatcaagcccagagtctactactaaagtcttgttaatttattaacccaagccgaggctgagagctcgacgtggcacttaagaagtaaaatgaggaaaggaggaagaaacggggtccctgtgggcctcggggcagcctcggccgggctttctcggagggcagggccaggggcgctggggccgctcccgcgtggcgcggctcgggagcgttccagggcgcggtccctgcgggccggcgggccggggtgagtcacccctgacttggggtgggagcgggccgtgtaagggggaggcggggcggggcggggcgggcctcgcctcgcctagggaggatgtggcgggtataaaagccccacccaggccagccggctctgctcagcatttggggacgctctcagctctcggcgcacggcccaggtaagcggggcgcgccctgcccgcccgcgatgggccgccagctagcggggtgcggagacgctgggaagaagggtacggcctggcagggaggccccggcaactggccccggaggccgtcgggggcagggggctgaagggacggccggcactggagagtctttggggagggggctcagggacaaggtgtttggggcaggggtgaggggccaccggcgctcgggccgggagggtgcagggcagaggtggtggggggtcgggcttctctaagaagcctagcgggacgcggcatggcggcgtggggagaggggcggagggaggcccgcattccagacgcgccaggcgccgccgaggcagggcgtggccgcccagggagccgcaggtccccggcgcagcagtagcaagtgggctttccactgccctctagaaagtgccccccatctgctctaagttactgtactcgaaacaaacgcgcgcttgtggagttgaaccgaccagcaggagggaagtagcgggggaagacgagaggggggagtgtgagtaggcacccctcagccccccataaaagaagacattaaaacgtcagttattccccttgctctaggttatcttgtagcatagcaacttcggatttcactctacccggagagtttcccgcttggttgaacacattggcctcaggaaggtagtgtcccccatgattctgtggggagggttgtcctgttactcgccatgatgtgacaatgagtcaggaactgagagtagagagaagggcgtggccccggggcctctcccttctggccgctctgtgcagctggccccactgctggtgtggagggcttgggttccatcagccggctgttgagaagaaggaggggaacacagataagtttccttatctggcaaggtggcttaaggatgcctattcttaccaccacccagagttattggagatttcaaaatacacagtcattaggtaataaatgtgtaaagtacacaaaaaacaaagtgctgtgcaaatgcaaagtgtcatttttgtagtaagattgccgttttaaagctgtgggtgttctgagtgcgtgtgtaaaagagcagtggcctcatgggtgcacgctgggccattaccaagaaccttaagttgttggtgtgcaaaggcctgggccccagactgtactgatggattctgttcacacgtgtgtgctactgtgcctgtctggaacttggtgacttggaatgcagaatgcactttcccactgaaacagtgttgcagaaggtgctgacgttcccaggctagccctgaaagacctttttaacatgcactgcctgattatgggattggtggtggggaggtggagggtagtgaggggcaatgtgtgtgtaggaagactaaatcactgaaatatttttctggaactttttttagctttaaggttgacactgagtaaattattttaattggaaaattatgtctttgcccctgttccactttcttttttccaccttccacctccttagagacgctcttctggctcttccgtgacgcattacaacagccatccaggccggtccagttacgctgcattccttcctccttcccatttcggcggacctgcatccagctagagactagcagattgaatcgatattcattaagttaggaatggttggtggtcctaagagcctcagcaaccgagaggagtcttgttatttaaaaaacaacgatactgggcgtggtcgtgggcctgtagtcccagctgctcaagctagtggatctcttgagtccaaggccaatgtgagcaacatagcaagacccagtctcaaaaaataaatacataataataataaaaaaccctcgttcacctaaacagatctataatttatagaatgtaaagcagcaatattcaggcaatattaaggaagatttttggtaagactggggcagcagaggtgcccttgatgggcaagggccaggagtgttaacacagtcctgcttagtaatttcttcccttcttccaagtctgtcgattatctaaaggtcaagggtttgtccaaaaatgtcccttgcatctgcagtggaaggatgtgacatctatgtgcatttttacaattggaggtttgtgatttggagaccgtttagattttgtaatttcccgcagtgccaactagactgcctgtggtaaatgcccaggaaatattgctgactcactgactttgattaggagctcagtcttgcactggagtctcaatatttagcatcttgtgtctttgagctattaaactatggtattgattgacatcaggctcgcagtcatggccgttagtttcctggctaatttctgatttaagtagttttcctggcaaagtagatgtgcttctataattgctattgattttgagggctgtaggctcttcctacaccactgggcctagaatctggcactaatgcattgtctggagcctttgttctcacccttcgcttgtgcagagcctggagcctgcggagacatttttcattaaaggagagcgggattgtcacaaaaggagtctcaggctctagtgggctgctttaaacaaccatttattccacaaaatattaattacctactgtgttccactcatagttatgagcactagggatacagcagtgaacaaaacagacccccgccaaaaataaaatccctgctctttagaccttaaatctggcggagagagaaggaaaagagacaaaataagtgaattgttggattttaaactttatattttcccaaattaatactagtttctaaacttggtgggagttcatttcccctttaatccagctgttccacagacctaaacttcacattttacctacctcggggaagttttgcttaaaattatggtgtcttaagctgccttccagattcaattgggagaattaaatagaaatggaatgttcctcttttttttcacatgagaatcctcttcacttgccctggtgccacaccctattctagttgtaggccacaccagaggaaattccagtccttcaaaaaaattctttccacccattcactgcctggtatcttttttcttctgctgttgccagaggcagtcctcatctactttctccagggacaggtcagcagtaggggtcaggagatgcccatatttgtccttctgggtggttctaccagatgacttccaaatctcccttctagggtacaccctgaagctgtttttcttttttttttcttttgagatggagcctggctctgtcacccagcctggagtgtagtcgcacgatctctcctcactgtagcctccgcctcccaggttcaagtgattctccagcctcaccctcccgagtagctgggattacaggtgcctaccaccatgccgggctaatctttgtatttttagtagagacagggtttcatcatgttggccaggctggtctggaactgttgagctcaagtgatccgcctgtctcggcttcccaaactgctgggattacaggcgtgagccactatgcctggcccaccctgaagcttttaatccagctgagctcaactggacaggtcggtagcacccaagtggcctgagttttaccccaggtgtggtgtagaaatttcttattctagggagtgactgtgttatggagccctttgtccatgtcctttgtctccctgccacacccaggctatacactcacagctcagaggaaatcagagtcctaaggccactcgtacatcctgcctctttgctgccttcttgctaggagttgtaggttacgttcccatgtggtcctatggacagagctagggtccaagtatccctgacagcacagaggtggggggcatggctatatgttgataagaggctgccctgaagcgacctgctgggctttgctaagatttgcagaagttggtgatttaagcctccaactctgaatgcacggaactggaactgcattcgaaatgtccagtctgagggagagagaaaattgaggaaggagagtgtgttggaaaagaagaaaaaaagactttctaatatagaaagacccagtgtgtgtaaaccatcccaagatgaaattgaatgcctatcgtgtgccaggcactgtgctcagacttatgaggaaacaggagggagttaagttggaaaccctgtgggcggataatacggaagacagactttacacatgtaactctaatgttgcacagacacacaaaaagctgcagaagcacagggcaaggaggggtgtgtgagaaaggcggcatttatgatttcctgtatcctaaagactcattcagatgtcagctaattaagattgaggttcctggtggagggaacttagaaagtgctgagcgtgtttggagaagagttaacagtccagttaactcttctgtgcaggatgcgtgtatgcatgtgtgtgtgtatagaagatatttaaggaaaggtaggtaagtccacagtgtggaaggtcttaaatactgacattagacttttttctgtaggcggccaggccctgttgaaaatacaatatgtgggccataaaacactgaaattgagttgcagacttgaaggcctggatttcccaaccctgaaagtgcttcatgccaagtgacatcattcttcctgccggtctctttccacccactccaaccccagatcaggataccagcagagagaggctgtgagagcatgaagctgcaacaagtcagtagggagcaaacaaatattgattcagatcaggccacagaagagacaagctggagcaagtgctgtgtgtccctcctgctcagtttgatcgaggtcactgggccgaattccaggaattctggggaatgagttggccctgtgactcagtcattaatcaagaccataaaaccaaggagaagaatatctgctttcaaaaaggttctgataaataaagatgcagtaggtgggtggaggatggagtacagtgggaacccctctcctcacccagtacattttttttttttttttttttagtttaaaattccagtgtggcctgtagactgtgtgtccaggactgtgtacagtaagagctttgatggagaacccaactctccacactcccacctctacccatttttgctttaaaatcttcatttgaatcaccagtccctgattgattcaccatggttgctaagaatctgttttgcggtaacgcatcaacactccacgtttaaactgtgaagtgggtgtgtccacaaaacttctggattagactcagatttgcctgtgcagaccagccctgttgcagtatgtttttgtttgttcagattaacatttgggctttttggaactggttcttaatttagttcagtagaatgtgtttttactatttgaagtgttgacttttaagttttcttttgtttgtttgttttaacctttttgtaaacttttctttttgggagtaaagttaaaactgcttcacttgtcctttttttgtttgtaactgcactttcgtagtgaagcaatagaatacaataaaatctatagagttttttttttttaataaggacaaacccttaaattattaggttggtacaaaagttaattgtggtttttgccattaaaagtaatggcagttatttttgcaccaacctaaataatatagtccttatgttaaatgtaaatgacttgtttctcaataactgcactgatttcattaatgatcagccttgtactgtgagcttttttagccaggcattcacagtctcatttatcagccttttcaaggcagaagaaactgttcttttcattagggtggggccaagtgacctgttttcctacccaagtagtgaatgattttaaaccagtttgaggtgggtatggctcttatcagtgagtctccctgtacctctagtttatttccttaaacagaaaaacgttctctgataaagggtcattttaatgatgttgtctagtgaccctgccctccctgggaatggaaggcacggcactgatgtgtatgtagatgtactcatcaacagattgaatttgctgattttttttttttttcttgttggagagttgaaaccagtcggcaagctgggtgaggttgaagtgttggaaagagtggtgcaaactgccattttcatgttctttagagaagtctgccagaaaaggagtagtggttctgtttttaatggatttatgagttttatacggtgatgaggagtgagtagaggtgaaattgtctcatacagcatgtaggctttattttttattttcattcaaaacagtaagtacactgaagtcagagtagttgttttcagtaagaaaattctgcctccagagcaaatgttttggtgaatagataaatatgagtactgagtcccaatcattttggctcataggttccccagtatttccataggcaagcttaactttgcaccattcagagacttatattttaggttccccacagggcaccccactggacgtggctcattttccagcctgtagtcttgttcttctgccaccctggggcattattcctcttcccctctccccaggccttcccccttgcttcttggctggaacctcccatggtgattcacccttctcagcctaggcagacagcacctccctgttaagcccttaactaatcccgctctgatggctgtgatctttctctctgtgtcttaatcacttggaataaagaaccattgtggtgaggttgaaagggcattggcccaggagtctggggatctgggttttggccctgcctcagctacttaattcactgggtgaccctggactagactctcagtgtgtcacagaggcacgaagggaagagagctcaaaggtcctgcagggtggaagtctgcatttcacagttttataagtgtcttttgtatcctttaatatagtgcaggctcagcgtatgcttggtatgggttcgttgattaattccttgcgtattaccagtgtttgtaacctacagtagcactgccaagacttccttttcctgctttcaaggatagcagcacactgacacattctcattagtcaaatatgctatattaaactaatgttttaacaaacagtgaatcgcaaagccaactgttccttccagcgaataatagatcatatgcaaaatgactttgcattgctaggggatttgatggagtgaagaagcaagcactgtattttatttctttttattttgttttgttttttggacataacctcaagattttattgtcctcataataaaacaaaagatgatgcttagaactggatcacttggccctttcttttgttatctcctcccagttgaaaatgtttgcatgtcttaacagccagcattttcttagatctgcagatggggtcagcacactcaagcctcagcacaacctcctttgtaattttacccgttttccagaaaattgccttagtctacccaccatagtcactctgcttcttgtcataacgccgctttccctgggcatacagggagtcctggtattgtgccgttttgtggggttggtgcttgccacacttcttacagaaagcccagtgggttttaggaatgttcaccatgttttccggaatgctatcggcatgggaggaaagtggccatattttatttctagggtgaaaatgtttgccattaaactcacatgaagtaggaaatatttatatggatacaaaaggcacctgcatgggataatgtcaaatttcatagatactgctttgtggtaagtgtgactttgtggttattgtgatgtttgtgttttgttttttttttctgcaaaatggttatacatagtataaatgttatgcaaaatagcaactcattgttttcaagttgatttagcacctgcattatgtaaagataatctgaaatctgtagggggactgggactatgtagggaagatgaggtcaaccatatactttctactgctttgaattgtacctatgcattcaccatttgaatacttggcacgtgtagggcacttaaaacattctgccgaatggatgaatgaagtggtatcaaaaagtgccctggcagtgaaaggcaagatagagttctgtagagtaggggtcgtggtgaccctgttggagcagatactgaagtagtggtgagtgcggagaggcaagtcacattttggccctagtcaactgtagctgaggagtaaacagagggaactgtttactgtttacaggattctgatgctcatctttgaaggctgggctctgctggaggactgattttgaatgatgtcaaatgattttgacaagattaaatggggagatttagttggtggtggcatgcaggactgatttgatgaaagagcagcacagttatgaatggtgaaaccgaaaggaagatttgtggggcttttaacagtctcctcaaggtgttgtggctgtgggagaagaattaacatgaatggagagtgtaaagaagcctatcagattgtctttgatctgcacagtactggggagtcccatgtgggacacgggtaggcagcagtctacaaagctcagagctggaaagacaacttgaaagaacaacacaatgaaaagttaccgtgcctctagttgagattttctaaacatcggaaccaatgtgaggtgtctgatttcataaacaagtggaatttaatctatactctctaagtggaaacaactctgtttgcaactctgacttgctagttccctggttttgcttttgttttacgtttggcattttttatttcttgcctgtttatggtagagactagaattctgcacagcagatgacaacagtttatcccctgctgcagacctggtccagttctgactgagtccaggggtgatagttaaggccagggcttgggtggtttgatgtccatcctaggagtttcacctctgcttcggtaattctcgggctgagggatactgatgagaccctctagaatgtttcttggtccatgttgaagttagagatttcttgctctgtcaagaagactgtcagcctgggcaacgtaacgcgacattatctctactgaaaaaaaaaagccaggtgtagtggcacacgcctgtagtcccagctacttgggaggctgaggcaggaggatctcttgagtcctggagatcaaggctgcagtgagctatgattgcaccactgcactccagcctgggtaacagagagagaaaccctgtctcagacaaaaaaaaaaaaaaaaaaggtctaggtgtggtggctaacccctgtaatctcagtgctttggtaggctaaggcggagggattgcttgagcccaggaattcaagaccagcctgggcaacacagtgggaccttgtctctactgaaacattaaaaaaaaaaggaaaaaaaatggaaaaaggaaaaaggaaattaaatggaaataagatatattcaacatatcatagttgtaattgtaatatatgatcaatatataaattattgggctggacacagtggtttatgcccgtaatctcagtgcttggatcacttgaggctaggagttcgagaccagcctgggcaacatagcaagaccctgcctttaccaagaaagaaattataaatgagagattttatatatttttttcatactatgtcttcaaaattcagaatgtcctttacacttatagcacatctcagtttgaactgaccacatttcagatgctttgtagccacatgaggctggtggctactgtattggatggttctgctacagagcaagactattctaaattgtctttttttttttttgagacggagttttgctcttgttgcccaggctggagtgcagtggtgtgatcttggctcactgctacctctgccttctggtttcaagctattctcctgtctcagcctcccgagtagttgggattacaggcgcccgcccccacgcccagctaatttttgtatttttagtagagatggggtttcaccatgttggccaggctggtctctatctcctgacctcgtgatctgcctgcctcggcctcccacagtgctgggattacaggtgtgagccaccgcacccggccgattgtcttcatttttaggaaagttttaggttcatggcaaagttgaatagaaaatacaaagaatgcccatgttcccctgttcccacatacgcatagcttccactgtcaacatcccgtatcagggtggtacatttgttagaactgatgaacctacattgacacatcgttaccactcaaagtccatcgtttacattagcattcactgttggtgttgtacatagatgcatccaccattacaatatcagatagaatcatttcattgccttaataatcccctcccctgaatccctgatctttttgctgtccccataattttgccttttccagaatggtatgaagttggaactatacactgtattaccttttcagttggcttctttcactcagcaatgtgcaatttaggttcctctgtgtcttttcatggcttgatggctcatttcttttcagtgctgaataatattccatgtctgaatgtaccacagtttatttctagagcaatactttttacaaaccagaattataccccaacggtgggacaaattggggtggggaggctgtctgagagttgtgagtgtgggggaagtggaaggtctttgactgacttttcgctgtgcataaaaagcttctgtgagcatcaagaagagagtagtggtctgggggagagcccaggatgagaatcttgcaaaaatacatccttcaccacaactaaaggcgaatcctctcctcttacatttccccactttcttcccacaccaggcctgggatctgcttagtccaaaatgttcctataagttagcaaatatctatgtcacatactctcgccaaaccagttttatgaaaatatttagactaaacaaagtgaagagaatagaaagctgtatttgcatgtgtgcagtttccttgatcaaagaatattaagcaaaaagagaccaaagcaggagtcactgcaatttaaatgtcgttcctgtctatttcaggacgcagctctactctgttttctttcttcttggggtgattatgttgatgacctgtcttgtctctgttgagataaatttaccaccaattgagcactccttattggcagggattgggtgtatcaattccgagaactgtatgattgcaaaggtggaaagccaattcatcaggctattgttttgctgccccattaagtatattaactggaagatgacttcatttcaaccatttcaaatcttaaatacaacagattcagtcctttatggaatgagttaaggtcagaaaatctgtccatcgtctttctcataaatactttaatatcttccaagtatcattggactaagaaagtaattatgggtaataataaagattccaattaagaattagggcaacatgaaaatgctactaatttcgattcacatcgtagctttcaggtccttctcaatatgtttaattacttgtgagaaatacagaagtagtggctggttcggcaagcccatcaccttttatgagaagtagaagactcagttttatcctgtctgaacaggttgcattagccatggggaacattttgtttttgcattcacacatcagtctccccaggttctgtttacacagaggaagagaaagactggctagtttagtagtccatcccaacccaaggcagaccatctctgaggtttagtttttacagtcgtaagatgggaattgcatctgtttgcaaaaactactccaatatcgtcagatgaaatggtccaaggagtagaaattagcataatgagtcgctgtgcttcagagtaaagaagagcctcttcataaagactttttgttgttctttttttccagcttccttcaaaatgtctactgttcacgaaatcctgtgcaagctcagcttggagggtgatgtaagtatatcactttcactttatataatttttgcaagttggacatctctctggataaccatattactctctatccttgtacatctaaggaagatggggacaattcagacagtcatcatttggttctcctctttcttaatacttcagctgttcctagtagttcaatttgaaggaaatatcatggcactggaaacttttcttggcctcacattaaaattggacagaattagtgacactggaatggctggaattttattctgccatacttagcatgtcattggtaataactgttatgatggtacatgacttttaatgtcatgtcctgggattttattactggttggcataagccacagccatatcaaaactaattctgcatcttttggatttcttacagtgtccaggaagttattccagatgaagacttatacttttattttatttattaatttattcattttttgagatggagtctcactctgttgccaggctggagtgcagtggcgtgatctcggctcactgcaacctccacctcctgggttcaagcaattctcctgcctcagcctccccagtagctgggactacaggtgtgcaccactacacccagctaatttttgtatttttagttgagactgggtttcaccatgttggccaggatggttttgatctcttgacttcgtgatctgcctgccttggcctcccaaagtgctgggattacaggtgggagccaccatgcctggctcgaggacctatactttaaaaaatttcacacctggaaaatattttctctaaaaaagctaggatatttcttttaaaaaaccaagaatataatgaaattattgtaattcatctgtttcctttttttctgtggctattagggaatttagaactaaactgaattttctttcataggaaatatgtgaacctagaaattctgttgcatttgtttcttttttttacaaataaaaaatttaagctatatgtgaagttaaaattatttcaaatacttttagaatcaagtggaatataaattatgaatatgtaaaatagctaatggtactatacatcttccaggtcatcctggcagaaatggcttttacgcaaactcagcactgatactggtttgtagccatatccgacagatctttcaaaatattctttgattgaaattaaaatgcaatgaatcactcaacagagggttgacagtgacttgggtcacatggtgcaagaccctctgtattgttcatggtacttgccatcaaaatgttcaaattaatggagcctgtgaaagcacaggttgtatggagtataaagcctatagagtttttttaaaatcttttttcttcttgaaacgtgtgcatgctgtttttgggaacaatacaaactgcatgttgaagtcagacaaattcaggtgctaaataatttgtttctctaatggacttagattgtatttgctatcaggttttataagagggctttttgtgtagcctctgaagttactctagtatatttcttatgtgtggagaggtggggcagaaatagaaaatgtcacatgttccccattattttaaggaaagaaaagataactttgtctcactaatttcatttcagacaagtggattttataggtaataggttcaattctcgatttaatttcatttccagagacactataaaatgacacaaaacttttccccctcactgttgtttttggaacaagacgacatatctcctggtaaatgcagtcatacatgatatggctcaatgcctggactgcctgccttgtaaataaccgatggcactcttaataaatgggaaaatgtttttccttagatttcatccacattttatagctaccatagcaaacacactgagtatttcaaaatagcactttgcctttttcctgaatgtgtgctccatgtcatcaagttcatcttactggaaagtttaagtggtgaaattagatggaacatactttgataatgcattgcatgtcaggttataaatatgaactggatttaatatttggccaagatagtcctcacaagtgcgtttggaaacatttgtcaaatgctgaacttagatttctggcctctcctgggagtcatctagatataggaaggcatcttagatgctcacctatacagtctcagtgctaataaaatggaatggcgtgggtgctgggtggtttataatgtgatgcctgtgggtggagaagtaactcacggatcttggccttttcactcttcacagaaactgcgccaaggccaagtcatcacattatacgggcattatgtgctgggggggttggggtgggttgcaggatgggagccttgatgatgaggatgggcagtgatgctgcctccaccagccatcagccaaccacaaccacaatgtacatcctctttgtctgcccttagctttgggactgggtagcagggagagggaaaactataagagcatttcaaagaaggagggaagttaataccttgaaaggagaactgacgtagaagcactccattgtccttacctcaatctggaatgggagattcccatctgtcagatcaggaaggataatgagctttgaaaagcactgaaaggctgggcgtgagccaccacgcctgtaatcccagcactttgggaggccaagatgggaggatcactagagcccaggagttcaagagcagcctgggcaacacggcgaaatcctgtctctacaaaaaatatgaaaaaattagcccggtgtggtggcaggtgcctgtaatcccagatactcaggaggctgatgtgggaggatcatctgagcccaggaggttgaggctgcactgagccatgatcacaccattgcattccagcatgggcaacagagtgagaccctacctaagaaaagaaagaaaagaaaagaaaagcattgggaaaggaagagggtatggtttagaaggcaataagaaatcttaggaagagtggagggtggtaggcacaagggatggtattaacaaaggcagagggaaggatacagaggagagggggggaaacacaaggaggatgtgggccgtctggccagaccaccttggtgccacagtggtgaccaaagtaaagaggtgggagaagctgcttccctcatttatctgaattgtaagctcagcaacactggcccagtagaaattcatgtacctgtagcagaaacttagctaaacacccttgtccttgaggcatttccacattttcagcttatttcgaattgttgccagcccagtttaatggtcttcagagccatcctgagtaaatgctggcttcaggtctccagctttgcattgtctacttttgatctctcactaaaagtaagatgagaagttgaaattgagacagcatattctaaactagctgagcctttgaagaattcttattagaaaaaatgaaattgcttgcgtgaagtgtgatggtgtgttaatacctacctagttacctagtatgagaatgatctgaattgttaaaagaaacaataggaaaacatattaggcattgttatttcaacaagaggattttaaatgtgtgtcatttgagtatgtttatcttttaacctcagcactctacacccccaagtgcatatgggtctgtcaaagcctatactaactttgatgctgagcgggatgctttgaacattgaaacagccatcaagaccaaaggtaggtgatacatttgtcctcttcttgtcagggtcttactgagacatttttggttgtctctttattctccctcaaatcgccatacgttggcgatttgaaattgtcatcgagctttaatggagtagatccagacctagctcaacccatgcctcctttccttccttccctccttcctttctttctttttccttttctccttccctcccttctccctttcttccttctctccctctttctctttctcccttcttcctgctcttccttcctttcctccctccctccctccctcccctcccttctttcctttcctccctcccttccattctttcctcccccaccccccgtttcttctctttggagagatgtacagcatgagatagtattttaaccaagtaatggttaaaaggaatcagtctgggagccggatctggtcctaggggtatgcttttgggtgcagctcttcactttgaggcttcagtccctcttctgcaaggaagaagttggtcatagtggtccctaagggcattttttgttccaagtcccctttaatttaattacatttgctgggaaaatcttactgcattgctcttagattgatctagagagtgaaaaattcagactttttttgttttttttaaaccccggtaagttctgctgctccttaggcctggagctggaattagaagagctgtcagaatgagtgtatttcctcaagttctaggatgagtaagagaagaccaggaggcgtaaaagccttcctcttgaaataaagcaaataaagtgctaactggttagggttgagcaagagcttcttatggtcattatattgttttctgggtctacaaaataggatgttcagactttctgggcttatattaattaagcaatccttggggttgtcccatcccctgaatccctgaaaaatattgcagctctcgtggtgacttttgtgattctccacttttccccccttggataaagcacttcctttcaccatgaggccagattgggatgcagacgtgacccagcacaattagagctgctgctggttcgtgcccctggtgaagagccatgtcacatttttctcttctatgtacagcgttttaacttactgacacacttatatagttcacatacggttcgttgaaagactgagaaacctcaaccaggctgacctgggaacctataactaggatgacgtcctggtttatgcctgcgtatttactaatagtgcacctttcactctcagaactgtcttattttggaggatacattacatggtcacctttcctaaaaccatgtagaatctggtgaccttgtttccagagacaggaagtagagtagaaaaacccgcttaacgttctatggttctaacaagatgtgaggatttatttgcatcatctgccttggggaagccttatgttctgcagttgctgtggaccaccccccagatgactgtctgcacagctgagggcagaataatgaagcatccaaattagacctttaaaaaaaaaatctttttttttttttttttttttgagatggagtttcactcttgttgcccaggctggagtgcaagggcatcatctcagctcactgcaacctccacctcccgggctcaagtgattcttctgcctcagcctccctaatagctgggattacaggcacacaccaccatgcccagctaattttctgtttttagtagagacagggtttctccatgttggtcagcctggtctcgaactccctcacctctggtgatccgcccgccttggcctcccaaagtgctgggagtacaggtatgagccgtcgcacccagcccaatcttttttcttttttttttttttttggtgcatttaaatgaccattcttgccaaaagttactactcagaaaattaaactaaaatctgcagggcttatttcactacagccagttccagtcagtggagcatagtggatgagagcgtatgtgagcccaggttcaaatgctggctccacaactcactcattagccacccgacttggggaaaacacggaactttgctaagactgagtttccttgcctataaaggggtgctaatcaaagttcccacctcacgggattgttgtaaagtatgaagcatttagcacgatgcctggcatatagatggtactcaaaatatgttaccttaaaacacacacacgtacaagcacatgcacacacacatgcacatacacatccatgtggtttgctttcctaaaacccatcctatttcactatttggatgtgcctagattcatgtggtttcccagcatgtcattgcagcagccctaagtttagcagttaactcatctagcaaagatggtgcttttcacaagcatgggacaaagacttcttttgtccctgcgtgagaaagcacttagtgcactggaatgtaaagattgcgcaaatgaactctggtcacagctgaaactctcatggtaataaaaataccttcaggccttttggagttagtagaaaaatactgtagtttttagacagaaacgtctggagggctaagatttagattccgacattccagtttgatcaaaagcagctgacattatcatcattgcaactatttataaaatgctcgttgtgggcagatactgcaccaggcacttcaggaacattcatcttagatgaacttcaaagtaacctctgatgtagtgttctgtcatccccaggtcttggatgatacaagtcaggattagtatgcctgaggtcttttggccttggatcaaactgggatttgaacacacctctgtccacccctaggcctgtgttcttaggcaccataatgttgtagcactcacctgtgaggaatggatttttttcattgccttggatttttttcattgccttgaattattttcagatatgaaaaacattgttcatctgtggtcttactgacttctgttaagtctcatatttgtggtctagctttagattctccatctccttttttttcccccagacttaatgttcagtgagtttcacttaggtccactttttatttattttatttttattcatttatttttttgagatggagtttcgctgtgtcacccaggctggagtgcagtggtgtgatcttggctcactgcaacctctgcctcctgggttcaagcagttctctgcctcagcctcccgagtagctgggattacaggtgtgcgccaccacacctggttaatttttgtatttttagtagagacggggtttcaccatcttgggcaggctggtcttgaactcctgacctcgtgatccacccgctttggcctcccaaagtgctgggattatagccgtgagccaccgcgcctggcctatttatttatttacttatttatatatatattgtaagacagagtcttgctgtgtcaccaggctggagtgcagtggcacaatctcggctcactgcaacctctgcttcctgggttcaagctattctcatgcctcagcctcccaagtagttgggactataggcgtgtgccaccatgcctggctaatttttgtatttttagtagagacggggttttgccatcttggccaggctgctctcgaactcctggcctcaagtgatccgctgacctcagcctcccaaagtgctgggattacaggtatgagacaccgcacccagcctacttatttttgatgcttagtgattttagagagtaagtaggttttgcaagtccattggtcctttaaaataatttctagattgttggcattattaaaaccctaaatccttttaggaactattgcgaagaaagaatatgatattcgtaagagctcagtgctaatattagcattggttatggtagtgaaagaccagataaatcttttagttgggaagtatgtcttgaggtatacttccttataatcattaagtaaataagtaaaactatattacatagataatgtgtaactctctgtattacatagaatgtctgcagaatgtagataggaaaaataaagtttgtcaataattttcaacatctttattgagatacagttaatctgccatacgatttgcctatataaagtgtacatttcagtgtgtttagtagtgtatttgcagagttgtgcagtcatcaccacagtaacttccctaacactcattttaacatccattcaccttaaatgtgtcagttgcatcaagaaatagaaatgggatggtatatgctatgtgatcacaaccacaaccattttttttttctttttgaggcggagtctcactctgttgcccaggctggggtgcagtggcatgatcttgactcactgcaacctctgcctcctggcagaaccctcctgggttcaagcaattctcctgtttcagcctcttgagtagctgggaccacaggcatgcaccaccacacctggctaatttttgtatttttagtagagacagggtttaaccatgttggccaggctcgtctcgaactcctgacctcatgtgatccacctgtcttggcctccgaaagtgctgggattacaggtgtgaaatcataggcctggcctatgatttcttttaatcaaaaaagaaaaaataaaaggcattagcaatggaaacagacgtacgtcacttcatggtccttcctttactgcactgtgtagatattatggtttttacaaattgaagatttgtggcaatgctattcactttgtctctgtgccagcattttttagaaataaaagtattttttaaatttagttatgtcttttttagacataatgctattacacacttaatataatataatcacacttttatatgcattgggaaaccaaattgtgtgacttgcattattgctatatttgctttattgtgatggtctggaaccgaaccagtagtatctccgaggtatgcctgtatatggaattgtgggcaattgctccttttcctttcttgggctttcagtatattctgtatttctgtattttgcaaattttctatgatgacttgtattactttcatagtggaaggcagtaaacttaattaaaaacaaaaatgaagtcattagttggaaaggataacaacccttttgttccttcctccttctccttgatattattagatactggataactaaaaccacttaaaaatgagctaattaagatcttaccttctttttttagaatgccttttgccttaagtgtaattaagaagcttacaccacaccttggccccactcccacctctaacccttcatcgggaagagacaatactaagtagttggtgtttccttgacatcaaaggacacggtataaacctcaagtattgatagaaacaaaagccagaggaccatgtgacgatgactggccctctttctctcctagacgggggtagccgtgtgtacacacgtgtgtgtgagtgtgccgggacgctacccactccatgtaatgttccattgatttccctgtggtctgtgtgctctcaggaagaagagctgggagcaggccaccttggaggaggcttaatcagctgctgtcgagtacacggatggtgcacaggagcaggcctggagtgggatgatggcgaggagggtagagctggtcagagacctgtttgggggcactgcttgccatggccagggcatggctgcaggagtcacgaaggctgttctcacagacgaactgtcagtcacacctgctcttcttggtgtgagctaaagctcctcacttgcagccctctgttagaggagagaggctacttttcccagccagtctgcctcctggcaccctcgagagaatatattcctaattgctgtgctcaactgaatgaatatacctccaggtgtgcagacaaaaccaaaaatacctgtcctggctcactttccagtgcttgggaggcagctcttattcaccccttcccctaactcttgtcacccctctcctgtgagctgttatggcatctgtcgtcgtcgtcttctttttttttttttgagacagagttttgctcttgttgcccaggctggagtgcaatgcacaatgtcggctcactgcaacctcgcctcccgggttcaagcgattctcctacctcagcctcccgagtagctgggattacaggcatgtgccaccatgcccggctaatttttttttgcatttttagtagagatggtgtttctccatgttggtcaggctggtcttgagctcctgacctcaggtgatccgcctgcctcagcctcccaaagtgctgggattacgggtgtgagccactgcgcctggcctatggcatctgtcttctaagggacctccctgcttcagcctttacagagtatctttctagcctcgtctctggctctgttcacggccctctacagagcatgcctctgcctttgttctttgaggagcgtgtagcctccttcctccccacctcaaacatctgcgcagttcccatttacctctcagcctgggccagtgcacagcatcaacaagctttctctgagaaggcagaaccagctatttcttggtctgtgttctcatcatactctacatactcgtttattgtgcttatgagaaggggggagaagcacaatactgctaaaatcaaaataagtctgctttgtttctagtttgaagggatctcagtattttttgcctgtgctgcctaaaccaaatgcaggattgttttatgtatgctccgtcctgaggtagactatgcaacgacttaccttaatttatgtctggttagaaactgagtacagtcatgcaaaagtagtaatactgcttaattaacaagaggttgctgagacttaatctgtaggagtctcttggtttagattggccttgggttaaatatatacgatggcgtgtacaacacagctgtgaatggtttaccatatgggtccaaataactagaaaggagagtcagctaaattagaaaaggatgaatcgagactccagaaaatagactgtaattagcagcagcacaaccccagagttagtgtaagtgccaataaactggtacagctttggtctctctctggaaggggagggtaatgaattaccctattattattgccagttttgattttagcagtatttgtgttctccggaagggatgcaaaagtgggtgatttttctcccccctttctcagaagcgcaagtatagaagcataactgcacgaagttttgcacttatttttttcttatacttttaaaatagaactgcttaagatttctgtggccaaaagactaacatcccatgccactgcagaacaagccaggatggatatttttggtttcacctgcacgccaggtatattcatttggctgagcagaacaattagaaatatattctcttgagggcgccaagaggcagactggctgggaaaagtagcctctctcctctaacggagggctgcaagtgaggagctaaaccaacaagagcaggtctgagtgtgagctcttctgtgactcacgtagcccagggccttctcaccctcctggaagggaacgggagggaacggacccttcccagttgctgaggcctttctctctgtgttcaagtttactttagactgacttctcatcttacagcagtgctgggaacaaagaggccagtgctgagtcacagccaccctgtgactctgccagcacagattttctttgtagtgatatttgtctatgtatctatgtaggtgccagacctgagccacgtagctatcaaacactggaaaaggagtccttggtgcctttctaattgtaagcatcagctttcatcacctgcctctcttcagctctttctttttttaaaaaacagttagctcttttccctgaggaaatccaaataccagtttcacccagggacaatggcagtaaccagattctaatctggtgtcagcaatgccaagaaaattctccaatatcaagtgagttaagggtggctgcgttggtttctctcgcatctgttcacattttttaattttctgtcccatgaggctgacggagtagcagagcacaatacagggcttgcattttatgcatgttccttcactgacgatttgatttgaatcttgagcagtggtgtactttgtgttttcctgctggtcttgtagcttgtttcagaaatataattctgcatggaaggcagacaaggttctagattattaaagcagccggtgagattaccaagtcgatgataccttaaatcctttctaaggaactcagctgaagtgagatcaaagcagaatggaaatagaagaaatctgatttttggaccaaaaccacttcttaggcacttagctaaactacactttccccgagttgagactgtgtgccccagctgtgccagacttgggagaggcacccaactcccctgcctcatttcaccctgtgcaatgcctactttctctcccatctcttggcagctgccagagtttgtcatgtaactggactactcatccatgtgtgccaatggcaaaaatgttctctatctttctttgccccatatttcacaggcagaaattcaaatgcaggcaggggccaggcttgtgacagagaagctgaatgaaggcagtagatgtgtttctagtcgttaactcagccagtcttttctgcatcctggtaaaataagtattatcattatctctgttctataggggtgagatacctaggcctaggaagagaactaatgtgccccaggatctcacaggtctgagtcccatggagtttccaaagcactatattgtggctgctacttatccagaggcctcccctggcatctgtcagcctgctgggtgtcctgtcttgatgagagacgctctggagacacagtgctcgcttgtgctggatgacccagaggggcaacttttacagcaggggttccgggccagccagcaccctggctgaaggtgcttttgggtagtcctatggctagaggggagcttttctctccctaaaaatctctctcactagatggatgactggctggcctaacaggcttgtttggaaggacttcctccctttgctgagttattcatgtctctcctcagaagagagtcttctagctctttctgctgaagaaaacctcaactgggttatccctttagtggccatgcattattaccaggtggcaaatcattatctacagattaccaaatgtaagtgcatttgtatgtaaaaatttcagcccagttctctacacgtgttgacacattattgtaccatatcctttgtaggagctagatggtggagtgtggtatgaaaaagtatcaaagtataattttaaaaaggtacaaacttgactcataggataaacatatactaaatttttaatgcactgaggtaaggctggttcagagggaatttgagatactggatgttggtaagtgttgagaaaagaatgttggaatgagattgttgggccaggctgggtgtggtggctcttgtctgtaatcccagcactttgggagggcctgggcaacaaagggagacctcatccctaaaaatatttttaataattagctgggtgttggtggtgagtgcctgtgcttccagctactcaggaggttgaggcaggaggatcatttgggcccaggaggtcgaggctacagtgagccatggttgtaccactgtactccagcctggtcaacagagtgagaccctgtttaaaaaaaaaaaaaaaaaaaaggaaagattgttgagctgaatacaagaccattaatgtcctatagggtagtgaagccacaacctttggggttatcttttctactggaccaaaatctacaagttaacatgtaaccccacagagtgtatgcccaaatcagtagtaagtagcacgtcaggtaagagcaggccccttgagcaggagtctttgggcctgtgagatagtgctccagcacatacctggaggatatgctgtcttcctcttgctttattttcaagttttgcataattttctatcacaggaggcagagttgcctagtgcagtgagccagggtctttagtcccggtttgaatctcagccctgcaagtgtcttgcttgtgtgaccttgagtgagtctctgccttctatgagcattggtttcctcattagtacaaccgggatgacaatggcacccacctcagatgggtgtggtgagaagtacgtgatagaatatgggcatctgataaaaatgcctgtaacatagtaggtactcagtaaaaggttactattattattattattattttgagatagagtttcgctcttgttgcccaggctggagtgcaatggctcaatcttggctcacctcaacctctgtctcccaggttcaagtgattctccagcctcagcctcccgagtagctgggattacacgcatgtgccaccaagcctggctaattttgtatttttagtagagatggggtttctccgtgttagtgaggctgatctcaaactcctgacctcgtggtccgcccaccttggcctcccaaagtgctgggattataggcgtgagccaccgcgcccggcaaaaggttactattattataataaatgaactacgtccacgtgtacacacccataactctgtggcattgtcctctctttgtggcatgcctctgaccttcttttagtaaagatgatttcttctcagctttgatactggtatgctcagtaatcttagtcaagtcaagtcgtggtcttccccataatctaggtaaggagaggatctggacagttttcctttgttttccaagtcaacccccactctcccgagaccttcatcaaacacaaatgaaatccattttctttgtgcagtcagtgtgtctcggcagatgtgagtcagcatcctgttcagaacggctgttggtgccttgccatggacaataaagacacacattttccatggaatgccaggcgcttgagctgacttggggtttccacccgcagagaggaggaggaaactccaggaggctgattttgtggttttggatccagccatcattttaaactgcaaatattctctgtgcttgaaaaatatggtgaatgatttatgggacccatgacccccaggtttctactggcaccttgctgtcagcaacacctccccgtggcattcccttggcaaagctattgcttcggactgactggcatttggaacagtgactgacctctgggggtgcccacgatccaggtgttgaaaatattgttgtagttagctaattagattagttggctattttcgttcaacgagtaaatgcttaaagatttccttgtgctgtttcttatcaggagccaaatacatttgtgtcttggttcctcaccaatgttggaaaactgtaacttctgttagttttgaaaaaaaattgtaaaaaatctgcctggatcacagaattcatgttctcacccatattctgtggggtcaccctatccacatcactcttctttggggagagcctttgcttagatgactttgtgatcactcatatcagacacacgaggaagaggatggaaaagaaagtgatattcaggttttctgtttcttctttatgccctcgccccacccacacagtttctttagaccctgtgcccttccgcccagcaaacacttccttaagcactggaacacgagaggtcagagagtataaatcaagggaggcagagccccatctcctgggcctctggcactatattcaatttagagcttttctggtgtcctggcactggttgtgcattgttgatgatgattgtgctgacataggtattcgaggttccgtccgagtccttcagttgcatcctgggtagaaatggtgagtaaccggatgacccttgcaacctcaacctgtactgaacaatttttcacaggaataaatggcctcaccaattacaatagcagggcaagaggaagcagcagtgttctaaagataagatggttcaatcccatttgcagatgcatgtatttggtattacaatataggacatgacttaagtggctttgactaggcagttgatcctggctccatgattttttcctctttccagttcaatttgaaacatgcagacagtggtatgggagaaatagctgatgcaggtgaggttcttgggcagggcggtaggaggggaatcttctgctggcagaaacagcctccatttcatttctttgtagttagtggcattagcacttgtgcaatgcattacggctgttcacttgtaaagtcccagcatgttagatactgcatctcagctggctgtttgcttggtaaataatttaggtaaaatacattttgattcctttagactatggttgttgctgcctcctaggtaagattcacgttaaccacccaggctctttatggggatctccgataattggattaaattctatcagtgctggctggacacttagctgctatggaaagaagggcaaaaagctgtgtcgttggctaagagtgtgggactgcattgcggcttgtggagtgaactctttagatgttacttcttacctgggttgtttggacaaaagtaagcacttcttttcctaaaattgtagttgatcctgtacctcacaaaagcagttggtagaagtgacatagaagtcttttagataggtagatttctagagacatttccatttcccaccatggttatccatttctgttggtgattctcaaataaggaattactagggagtttgttgaagtgctgcttcctcggtcccaagttctacagagccttccttagtagttctcaggtgcagcctaagggactgtgtttttaataagtgcttcacgtgattttaatgcaggtggggccaagaaccacattctgacccaaacacagactttgcatttgtttttaagagagaatacttttttatgggtcactgttcttggtatgccttcaggccagcggcccctaggttgacttctggaagtattagaattgaggttagaggatagaattgtattttgtgatggttcttcagtattttcagttgtgggtaataaaattaagtacaaggcaaaacacgttaataaacaagtggttttcctaatagaaacctagagccatagaattttgagagacagagcaagggagcaaacgagcaagcgaacacgcatgtgtgggtaggcatgaatgcacagcagcccaggcacacgtccactttgtgggtattttagagtctttgaatcaatctcttctgcccgttcctaaatgaaacaaaatataagttaaagcttaattatatccattagtgttttgtggaagcagaagtggggggtcattgttcaagcccccttcttgtgcagatatagaagctgagaccccagtaggacaaatgtttacacacataacacatacagggatgggctgcagtccctctgagctttagagcctccacttatgaaatagaaagagaaatagctatcccctcttggttgttatgaggattaaataacatagcttgtcttacgatgtttggaaactgaagagaattatatagatgtaattcctaattaccatgcatactgtgttttctaactgaagtatttagagttatacagggactctcttgaagtgaagtcactagtcgattctggagcaatgactgcctgccactcaccgggtattaaaaaaaacccatttatggtcattatggtgaactttgaaagtacagataatcaaaagaaagattatacataatcccatcactcacatgatcactattaaaattttgatatagagacttctaggtattttcttatacgtgcatacacattttacaaaaatgagagtatacagagcatactgctttgcaacctttttttttttttacttaacagtacctatattgtggatattttccaacattaattaatacttccatgccatcattttaaatgactgcatagtatcccattacatggaaaaaagaacatttaatcagcctcttattggacacaggtgttttttctactttacttttcaatattgtatacaatgctgaaataagcatctttgaagctgaatctcatatccagcaattggatttctttttattttattttattttattttattttatttttttttttattgatcattcttgggtgtttctcgcagagggggatttggcagggtcataggacaatagtggagggaaggtcagcagataaacaagtgaacaaaggtctctggttttcctaggcagaggaccctgcggcctcccgcagtgtttgtgtccctgggtacttaagattagggagtggtgatgactcttaaccagcatgctgccttcaagcatctgtttaacaaagcacatcttgcaccgcccttaatccatttaaccctgagtggacgcagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaactgccattgtcatcatggcccatccccaatgagccgctgggcacacctcccagacggggtcgtggccaggcagaggggctcctcacttcccagtaggggcggccgggcagaagcgcccctcacctcccggatggggcggctggccgggcgggggctgaccccccaccaccctcccggacggggcggctggccaggcagagcggctcctcacttcccagtaggggcggccgggcagaggcgcccctcacctcctggatagggcggctggccgggcggggggctgtcccccccacctccctcccggacggggcggctggccgggcggagacgctcctcacttcccagacggggtggttgccggacggaggggctcctcacttctcagacggggcggttgccaggcagagggtttcctcacttctcagacggagcggccgggcagagacgctcctcatctcccagacagggtcgcggccgggcagaggcgctcctcacatcccagacagggcggtggggcagaggtgctccccacatctcagacgatgggcggccgcgcagagatgctcctcacttcctagatgggatggcggcggggaagaggcgctcctcactttccagactgggcagccaggcagaggggctcctcatatcccagacgatgggcggccaggcagagacgctcctcacttcccagacggggtggcggccgggcagaggctgcaatctgggctctttgggaggccaaggcaggcggctgggaggtggttgtagcgagccgagatcacgccactgcactccagcctgggcaccattgagcactgagtgaacgagactccatctgcaatcccggcacctcgggaggccgaggctggcggatcactcgcggttaggagctggagaccagcccggccaacacagcgaaaccccgtctccaccaaaaaaaaacgaaaaccagtcaggcgtggcggcgcgcgcctgcaatcgcaggcactcggcaggctgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccggcgagggggagagggagagggagagggagactcagcagcaattggatttctatgtttaccttggctactctaaaaatgagagctaaagttatagatgctacagttaagatagcaagcatattggtatggacttgctttgaaatgagcatatacattttaaaaagttatttatttttatacccagaaattctaactttatactttttgatctaacacacttgagaattcaaaatacttcctctgtcaatctgctgtttgtctttgtctcaagcgttacagttttgacctttctgtttcttcaggactcctctgattttcttcaggccaagccatttgtagtttgcaagtgactttgtaggtttagcaactctactctctcacccaagagttacctatccagttatggcaaagactgtttctttcattaaacaaagttattaatcagtcaggagagagacttttcacattctgaatttacaaactgtgctttcttaagttaaatggcatgttaggagtatttctgatatgaaattggaaacttgcagacaccagaaggcattgcttatctttgtaaatacacatgttccaattaaaataggtactaaaatattttggtggcacctcaaaactcccaatttagatttaatttagattaaaacacttactctttttaataaagttataaaattaattattaaaattgcctattgaagattaaaggcagtggaacgtttattttccttacaaaacaattttgtcttcaataagtgtgattgtgttaatcaattatgctattaaaaatacaactgccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgagcgacagagcgagactccgtctcaaaaaaaaaaaaaaaaaaaaaaaaattccaactgccatattaaatctgactcatttgtcatgacagtttttataattatagaaattatacctagctgcttatatagccataatcctgcaataagtataaataattatctctattaattcagtttgcagttactctctattaaatcccgagttaaatggcaatttggggaccttcatttaaaatcctactaaatctctgttgttccatctgactgccaaagccccacatatgcacctcctactgttgattccagaaaccaatttatgaataaaatagtttttaaaccacaagtatttaaaaggtccatttaagcttgaggtttgaggctctcaagaaaaaaggaaagagagtgtacacattgggtagaggatgctgacgaaagagatagaacaaatcttggtgtctgggtatttcagtttggaaaacagtatataaatttcagtttgaaaaagtctgcttgacaccttctatgtaagcccaaaatactagagtatactgagtaacgattaacaacttgtatttccataggtgtggatgaggtcaccattgtcaacattttgaccaaccgcagcaatgcacagagacaggatattgccttcgcctaccagagaaggaccaaaaaggtacaggcaattccagggatggagggcatttcttgttgaatttttgtttcctcagacattgctttttcttttcatgaattgtggctctcatgcgcaaaagacttgtgggacccttggatatctaagattttcttcttaaatccttgtaagagtcactgcacatgtgtgtgtgcgtgtgtgcacacgcgcgtgcacctcaggtcatcaggcattaggttctcataaggagtgtacaacatagatccctcgcgtgtgcagttcacagtagggttcgcgcttctgtgagaatctcatgccaccgttgatctgagaggaggcagagcgcagatggtcacgctcgctttagagtgcttgggagctcctgtgtaaggacagtaccctcccccaacccaggctacctggagggagagcttctgggaatagaaagttaggaatagggaacaacaacaataacaacaacaggcaccatttattgagtgcttactttgggccaggcactgtgctcagttttgtacatgtagcaactcatttcatctttatgacttctgctggttcttgataagatgtttctaatttaattttaggatactagcctccactgagtgttgatcctaacaagctcctctcattttaaaaatatacacttgaattcttaagctttttgcaacgagtgggcttagttgttagttcatttggtctgcaaagctatcttcaacatgccatgctcctactatttaaagggtctttgtgtgctttttccctttgcttgtccactagtggttaagaaacaaccagtgcgtgttcgtcctttattttgtcagttgtaggaaattttatttttaaggacgtgctgctttatttttaacttcttgctattaaaagcttttgatttattcttggacagtgcagtaagtgtggcttcctgcagctcccgtttgacttatggctttcacttgtagccacagtggaggtgagctggaaggattctagaagagatatttctgcccttgggattgacatgaccagcagggtcctgggagttgcaggtcaagccttgctacacttccatcccccgcactctaaatggttggaaaggacataaataggaaagcatctggcttctttcatctcaagtgcattaaaattcttctttcactagacgtgtattaatcttgtgtagtgaggcatagaggggagtgttttatttctccagcttcccaaaggggtctgtgagctggtagagccaagttcccagtggagcagaaggctcatctctggacagcaagcaaaaaatttgatctttcagctgtcacagagtatggtcttggaatacatttgggtgtgtacacacacacatagaagcctgaaactttttttttttttttttttttttgtgacagggtcttgctctgtcaccaggcttgattgcagtggtgtgattcggcttactgcaacttctgccatgtggactcaaatgattcatctcagcctcccaaactgctgggattacagtcataagccaccacacccaaaacctagatcttggttttagattagatatatgtagaacaaagctcccacgtaccctctaggagggaagatattaccagaattatgatgaggtcccaagatctcacaggctttgctgtgtgctggggacagctcatcatcctactaattcttgactctcagccttaggccaaggagaattatgtatcttttataaaagatatgtaaactacttgagatagtttcaagtgaaacaatcggctgtttgtgaaataaagaagaaaatttgtgaaataaggaagatttgtgctgcagagttctttagggatacgggctgcagctgcccaggtgatgagcttgaagaacctaggcccggctggcagagtggagaggagctgggagagacagctgcttttacgactctttcatgttctagcagatgccagatgcgaggcttctccttacagggaagggttatgtttgatttatcatacatttctggagtttttgtttagtttttgttaaatgcaaagctctgtgctggacattgtgagaaacaggaagttgaacgcccataaggagtttagaatagaagtggaagaagtcagtaggtgcccaaatgctatttgaggtttgaatagagaatgggtagaggggagtgtcaagggtaggctaagtttggagttacctaacctcaaagttccaaactgggagactggtgttataattgggagctactgcttttacagtcccctcctaagtgccgtgtgttcccgggacattgggaagcaggagaaaatgggtggtgaaagccaggtggcttctaagatccatgtcagttctaacacttttgacatctacgaatgattcagcatggttgtctctgaagcatgctgcaaatcacctctcgtagcctgcaagtacctgtaggggctaagctttgtagatgccacaggtgctcttagaaagcaaggaaagaaagaagagagagaagaaaaaaaaaaaagcgaaaagaagaacattatttcagtaggaggcttcagtcatcagccatgatttgtaggaagtttagctcgaggaagcatcgctaaaagacacattgagttggggtgtctgtctacatacatgggtgctgaccagacctctgacaaatttttgtgttcatggtgacagtggatccaacccttaagaaattacatgcagcagggaattcaagggggccagttcgggggtgttagtttcctatcacttccattaaacaccgtccgagtttggtgtggacaaggagatattttctcagtattagatgaagtgttttgcataggaaagtttcatgacctcacttccaactgtgttgcggcctctggttccttctggtgactttgaggagctgccgctggaatggctgcccccacgtcttttacagtatatcgggaggccacaagatctgcttgccaggaggctgtctgctcaaacatctccttcttagcaggggccttgatctccgaaagcgtcctgccttccacggagtgttactgctttcaagcatattgcaaagtgcctgcactctcacagctttcttaggaatcacatacgactccagtttccttttattgaccggggaagacggcaaaattaacttggattttaaggaatttcgttgaagcaaagcctgatgtttatgtttctgagatgtgggtctgttgaagggaatgcagttgagggcgtttgacccaagactccggagtggtcaaagactcacaacctgcttcacaaaaagatccctcttacttttgttttactcactagttttaaagtaaaataaatattttccttatgattgcctgttatcttgaaggaacttgcatcagcactgaagtcagccttatctggccacctggagacggtgattttgggcctattgaagacacctgctcagtatgacgcttctgagctaaaagcttccatgaaggtaaatgcatgtgagatgtcatctctgtcaaatctgctattaattttgtgaattacagctttctgagtgtaatttggtgattttcagttttgttgaattctcatttggaaccattttttaaaaatgaactgaagttatatgtctcaggatttgtaccaaaaatatttcaattacttgttttaagactgtaaagaaatttcatgatgctgagaagtcagttaccagctgctactactcagcacctgggcaattggaataccatttgggaaaactacttccttgattacacttcctcctttaaaaagatatgttgtgatattaaggcaagaaaaaaaaactcatagcttttgttaagtgaagcttgcaaattctgcccatcctttcgtgggtgtttcttcctcccatactctctctgtcagtaccatttgtttcaaattcaggcagaatcagaacatcatagtgcatataaggggtaattctggatgaagaatcgtacctgaatcgtacctgtgagaaagtaactgtgaagtctcaatgcacgttatcttttatgtttttcttttgtaaagttcttttgaacctggaattttaggttaaattaagtaaaaactgtagattggaaacctcctgaactttgtgcatacttaaaatatcaagttttttgttttgttttgttttgttttttgagatggatttcgctcttgttgcccaggctggagtgcaatggcgcgatctcagttcactgcaacctctgcctcccgggttcaagagattctcctgcctcagcatcccgagtagctgggattacaggcatgcgccactacgcccagctaattttgtatttttagtagagacgggatttctccatgttggtcaggctggtctcaaactcccgacctcaggtgatctgcccaccttggcctcccaaagtgctaggattacaggcgtgagccaccgcgcctggccaacatcaagttttatataaatgcaatagatgcacacacattaatgtatgttgtactgcaacacatttggacccttttcttagtgtgggtctgcagcatttgaacagtccgacactgccctctgctgatatacatgggtaaagtctgcgctgtagatgagggaaaccattggtcttgattttttattccgagtctgttttctctgatgccactgttcctgaattatgaacagtctgagctgtaagcctgtcaccagagctaatgtcacagttcagttgtcatccttttcccagagaacacaagagtgagggtgcttcggacactgggcatctccaaagcctggaatttgatagctcagggctgctgtaagatttgttgttaagtctctttcttcctttagttcttcagcttagcccaagctgtgctcagtttattttagcggacttgtctgagtttcctaagtagactgtactgcagaaaagacgtcattaagaatgataaaatgtcgacaacatttcatgatcctggttgataaaaatagcgctcctgaaaaccgagtctgtggacctttggaggcagggatgagtcagcctctcctaggtttcttctgaccatcaacacttcagatcagtttgtcttattttcatcaagaatctatttagttgtgattcgagtggctttactggtatctattactaggtattagggacttgaaacagacctttttgagctgtcagtcactgttgtaatctatgtaattgggcccaatggaaggtgctttaactgctgaagctttgaccctgtgccagctcttccattagctatcacagttgaatacccgtccaaaatccataaagcttgaagtgacattaactgaactatgcttaaaaaaaaatctgttttgacttctggcagtaccggtggcagtatctgccatatgttacagtagaatttgcccttgtgataggaattgtggacagtctgtggagagtttgggccgggctttggaaattgccaaggtcacctttgaatgtagacataaaaacactattggaattctcagatattaccactggtatatcagtgatggaaggaaacacatcttacattattctgcctgtcttgcaattctacaatgtcaggatataacatttctcccactgtgtgttatttttacactatatttctatcatccttgagattgaacaactgcctctcaaaatattcaaagatactcggtagtcatttaataacatttgtgtagaatgctgtatggaccttttgctaacaaggggagaatttttggctttgctggaacctctacaaatcatgattaaaaactcagaaagaagagccattggctcaaaggttagatgaagaataaaattcaaaattaaccattaacctgaggcttagcttatattatacaaactactttttcggggcatataaacgctaataagtttaattaatagctgacacgcttttcatgtggcgaagtttcttaaagtattaacaccaattaattgatttacatattaaacagttgtaattctacttagctcaaagtgatagttccatattcggaaagacaagtattaaagaatcctgattattaaatcttgactttgatcatgaagccagctttgaaatacatgtttcattgagtcctttcaagctatctgacatgctcaaaagtgtatatattaaatttgaatacatcacccatcaaattcttattccttaataaagtgttggtgtctaggtttatttggcacttcattatttctttttgcttccctaaagtgcctgaagagtgcataattatcaagcaaaaatggaaggacaagaatgaaatttttaacattaacccaattttacatttcaaagagtgcagctaaaaattttttcttaactatacctttgcctggtaaaaagacttactctaacaatgctggctgcaagtgacaacataaaatttctgtattcctttattttagcgagaattgtttaacaaagaaatttctaatctgttaaaatagtgagtggttattgtagaaagtgaaaaataataataagaaaaagttactttatctacccacagcaaaaggcaattgccagttttaatattttggcatattctattgctgcctcttcctattcactacttttttttttttttgagatggggtcttactctgtcgtccaggctggagtgcagtggcgcgatctcggctcactgcaagctccacctcccgggttcacgccattctcctgcctcagcctcccagggtagctgggactacaggcgcccgctaccatgcccagctaattttttgtatttttagtagagatggggtttcactgtgttagccagaatggtcttgatctcttgacctcgtgatctgcctgccttggcctcccaaagtgctgggattacaggcgtgagccactgtgcccagcccctattcactactttaaaaaaaaaaccatattaacagttgaactccaacatgccagttccaccatcttgtgctctggtgaagcattttttaaaggaatagaaaatgccattactttgtgctaaggggtaggagtatagattcttcagaaggaatgtagaaagcaggatgctaacagacccaatccatgtttgcaatttacttgatggagatcagagaagtaggctaatggtggggaagcatttccctgctgatgttcgtgcttcctggttcacaggggctgggaaccgacgaggactctctcattgagatcatctgctccagaaccaaccaggagctgcaggaaattaacagagtctacaaggaaagtgagtagcttgatttctgtgattcatcctctcagcccaatttatgtgactctatcatggccactggggttagggttcgggctaagatgcctgcattagtgatgtgcagaagtgcctgccaccttgactatgcaggcaaggttggctgtggtccaagtttctctccttcacctcctcattgcctgcattttgattattacattccactagaacttctgtgttagaagaagggtagacaggagggaaaggagagaaaacaaaacttgtttttaaacaagatcggatgaggagaagtagcaagtattatatatggattccacttattgggcgctgttcagtgtctgctcaagaggttgccaactctggactgtggataattgaagaattacagcaagagacccctgtggactggtgcacacttagcagtatagaaggctatgaggggaataaacaatgcaacttacatcgctactgcatttcttttttgttttactttttaaagttattatcatagttttacatattttgggggtacatgtgatattttggtacatgtattatatataatatgtaattatcaagtcagggtaattgagatatccatcacctcacacatttatctttttttttgtatcaggaacattacagttcttctctagctactgtatttcaatatagatgctattttgaatattgaaatatactttcattcaaaagcattgtttaattcttagtagtttttgccgctgtgcattttctcagtggacagtaaagcacaattgtgtgtgtgtgtgtgcgtgtgtagacctccaatttttttgatgttcagaacaagtactcacagtcaggagggctgggagccagtatttaaactacacgagaggtcaccaatcaacggtgagcctgaggatccctgatttgatctagccctgctgccccctgttatggataataactctggctctgatttcatgagggcgaaaatcattctagtgaatccttcctctgtttggggttaaggagaatggatatgtccagctgacgtagctgttctgcttctcagagtcttagtgggaaatggggagattggggtggatggttggctacacaggcagaaagcataaaaccaggtgtattttcctccaagtgtacaagactgatctggagaaggacattatttcggacacatctggtgacttccgcaagctgatggttgccctggcaaaggttggtttcccagtttctttctttgcccttgcttcctcccaaggcaagtcacatacctcattttatacttggagtgaattaactaaatcccctgtgcctgcatcagaaattcagctgcatttttgaaagtgggtttgcactgtcactgcagagttgtcaattttgtataataggatttcttatcctgcaaaacctcatggacaagtggactttgggagccagagaagggatgggcggctctcaagtcctggcctggatttatgtgccagagccttggccgtgtgacttagggaaggtcactttgcctctatctgttgtcatgcaggacccagtgggaagtgaccttctggtttctttttcactgcgtttacttctcatggaagaatttgcccatatagtcctttgtctggggtggagttgtctttgtggagctgattgctaatattaacacattaacatggaggaaggggcatttcccctgtgaatccctagttctggccagcgtgtagcttaatacttatgtgccaggggagggacgagagaccctgggaaccctgatgacaaatgacagatagtgcgtccggcccactcacatctccattactgcaacaactcctatgccattctccctcgctctcctctcttcgctaccacctgccccatgtaccaccatccacggatctctgtgaaatacactttcaccattttactcctctgttcaaaccccatttctgctgcatcaaatttaaactcctaactgctgtgaaaggtcctctaaaccctccctgcatcttctttgctcatctttcccgctcagctctgctctgacagggcagctccttacttacctgagagcgtgctgtgccatccctcgtgtgccagctggctctcccgctctgcttggctagctgcatctgactgacccttgaagtttcagcttaagcccaggcccatcgttcacactctttgctgactctgccctctgagagttcttcctccgcccgcattttgtgtctttctagtgctgtgggttcccgggctgctttacatttgtttccacatattcctccatctgcattgcaagctctctgtgagaaagagctaaatctcatcagctttttgtgggggatggggacagggattctgtaaggtgtgtaggccaggactgggtaccaagggggggattgttgatggcaaggcacagcccccacttccttgctcaatgattttaccactccttggctggtctaggtttctttttctttttcttttctttctttctttttttttttttttttttgagacagagtctcactctgtcaccagggttggagtgcagtggcgtgatctcagatcacagcaacctggttcaagcgattctcctgcctcagcctcccgagtagctgggactacaggcatgtgccaccacgcctggctaatttagtagagacagggtttcaccttgttagccaggttggtctccatctcctgacctcgtgatctgcccgcattggcttcccaaagtcctaggattacaggcgtgagccaccgtgcccggccccatctatgtttcaaagtaagaaaaatcttacgtggttacttatttaggaaattaaataatggcgtacatggactggggagaaaacattttcagttttaaaatacacaaagaaatgtatttgaagttctttttctttcccccatagggtagaagagcagaggatggctctgtcattgattatgaactgattgaccaagatgctcgggtaagtgctgagctttttgctttgagtttttgttttctggtaagtctctggatagtctatatagtaatttaactctgtgtgacaaatgactcccaaactctgtggcttaaaacaacaaacatgtattatttctcagtttctgtgtgtcaggaattgaggagtagattagcccaattgttctggctcagggtcttttctgaggttgcagacaaaatgttgcatggctgcagtcacctgagggcttgactgggtcaagggaatctgcttccaagatggtgcacttcacatgactgttggtaggagaccttagaatcgctccacatatgcctctccatggggttgtttgagcgtcctcacaacatggcagctggctttccccagagcaagcaatctgcaaagaggaagccacagtgtcttttatgacctaacctcaggagtcccaccttgcactgctgtcatactcttttcattaaaagtgagtcactgagtctagcccacactcagtgggaggggattaggctcttcctttggaagggaggaacctcaaagaatttctggccatattttaaacccaccatagtctgacagcaatgtttattagaagacattctcttataatgctggtgttacttacagaatcaatacgtgactcacatatgctcactcaggctttgcttgtatggaagcatcagtttctgcagagtgtaatgtggctgtgcataccaatcaggcaggcaggtgggaagcagaagaaggtggaggagacacagccagggacaggatggtgtactgctctgttgtggtgggggagaaagggaggccagcagagacctgtccttttctggctgaataagacttttgccagttctagttctattatctctgagaactatttgttaagcttattcagactgcaatgaactatattctttactcagagggacaacgattatctcaaagtaagtcataaaagctgcagaaaaaaattaatttaaattaatgttagttttaaaattcaatatattccacacggcacttctagcaggtagtagagaagggttttaaataaagtaatagaagttgggttttgcagttcctagatggtggaagatcacggaatgaatatctacccttgcataagcctttcttcctcttgccctccctgccattgttagggctacttgtagcccctaaattttccagaaactgaaagtgagatgagatgggctccttttccagctccatcactccctgagtctctgagaagcttgagaatgagagcctggtctgtagctgtccagtaaacatctgctagcttatctgcccctaaatgtgcccaaagggaggagggccagatgtgttaatgaacatttacttgttcttctttatatgaatacaagctcttggtccctcctttcttattcaaggaaggagattgtacagcagacctcacgaactatctgcagtctcatatggtatccatctgtgcctaaggaagactgcttgtgattaagacttttgacctaaatagtaggtctctgcccatgtctgcagtataatcatctttcctcgtttggcattttgaatgtgtagctttttttgttttttttgcatgacattttttttgacgttacattggatgtgtagttaacttttcctggttggttgtactcgtaggatctctatgacgctggagtgaagaggaaaggaactgatgttcccaagtggatcagcatcatgaccgagcggagcgtgccccacctccagaaaggtgggcactgtgctgagggagtctcagtgccttggggccctggctggggcggctgggtggatgtccatgttgggatggagtctgccagaatgaggttctgtctccgcttggcactctcttaggctcacccattttccctcacctttctctcccattctggattcttttctcttgcaaatagtttctgcatttggtgctttattctgcagctccttcttgtttgatgatcattttgtcttgccattatttgttgaagtagtggactttggtgcatgctctgtactgtttcctatggttttcggatggaatgggttccactcaggggagatagagatggtccaaatatgtggcctgggcagtgccattcaggacaggtggtatggctgttccacgacaaacttggccaatgttggctctggtcaccatggtaacctctaagctcctaggatgctgtgatcatcctcaatttttaaaaaaattatggtgcataaaactaggtgggtgatcattgacagctttgactagtggctcggatctgataactctttgttgtttttcctcagtatttgataggtacaagagttacagcccttatgacatgttggaaagcatcaggaaagaggttaaaggagacctggaaaatgctttcctgaacctgggtaagtgaatgtggcccccattcctggtagacatcagctaccagagcagaagtgacagatggccatcctcttaatccaaatgtgtttgggaggtgtggcttctatgcatgctttggatagttttacagtcttaattgtatagatttcagaatataaaactgaagaaaggcctaacttggtaacagattgttgccagggaggagtaagagaacaggaggagagaggggtgtgttgtggaaactcacgtatgcacttgggttctgcaggcctcagagacccctggtttaaaaccgtggtggaacttagtattgcagaggatttctacatttcccttagcctgtcctattttgcagcccttttccattgcattaggtcacttctggtttgtggcccagggccagggcatcctctctcattggtagaggagagaccagagcagctgcagcgctgactccctttcttctctccacagttcagtgcattcagaacaagcccctgtattttgctgatcggctgtatgactccatgaaggtaagggcagctggctgagagagctgtgtttccacactcagcttttcttcttttgggtcccaaattgagtctccttgattcatggatgggggaaggggaccccactgtgtggatgcaggaacacactagtcagctgtggttgtatgtgacagctgagagaaccacaaatctgtcttctttctctcagctgcttgaacatgtatttgcgtacagacaaaaagtaaagtgccatgggagagagaaaatgcgacatggtagtcgtgtctgatccctgctcaggtttctccgtgatttcttcctgttactgccagagtcaagacaagtgaggaagggagcgattattaagcacccactatacagtggacaagtgctactattttaccttaaatcattgcataacaacctctgaggcttatatgattatcttctttataaatgcagagatggagctcagaatacctcagcctgcttgaagttacacagacagatttgaacctgggtctatcagaccccaaagacagccccacaacccttccctaaacgaaccacctcttcccgtagacccatcccattttctacacctcaagtgtgccatgtgttttctggcttctaggcttttgcattttccttctggaacatctcccttgtctgcgctgcctctgccatctgtctttgagttccatatcaaatagcaccccttggtgccttcgctctgatgctctggaagtaaactcagtggtctttattgcacatatcattagaaatggcacagagcgatgatagaaatgtgttggcatgttccctctaagcctgcaagagtcaggaacctcttgttacatatggagactcagactgcttgaactgagccttgcagtagtaggtgctcagtatatatttattgaatggtggcatagagtgggagtctgtgctgactacagcctggtgtgtttggaattcccagatgctcttctttcttttcttttcttgtcttgtctttttttttctttcttttttcctccctccctaccctgccttcccctccctgccctgccttcccctccctccctgccttcccctgcctccctgccttcccctccctccctgccttcccctgcctccctgccttctcctgcctccttgccttcccctgcctccctgccttcacctccctccctttccttcccctccctccctttccttcctttccctttccctttcttctctctttctctctccttccttccttccctttttctttctttctctctttctttctctctctctctctgtctttccctctctctctctgtctttcctttcttataggtttttgggaaacaagtagtgttcggttacatgaataagttctttcgtggtgatttttgagattttggtgtacttatcacccaggcagtgtacactgtgccctaatatcccttatccaaaatgcttgggaccaggaatgttttatatctcagatttatttttgattttgtaatatttgcatatatatgatgaaatattttagggatgggacccaagtctaaacttgagattcatttatgttttatatagaccttacacacatagcctaaaggtaattttatacaacgcttttgataattttgtgcatgaaacagtttgtgttaagtgctgtatgtggaatttttcattgtggcatcatgtcggcactgaaaaagttttggattttggagcattttagatttcagattttcagatcagggatgctcaacctgtagacgctttctttaacgataacattctcagcgaatgtaacaaatatcaacttgattttcagggcaaggggacgcgagataaggtcctgatcagaatcatggtctcccgcagtgaagtggacatgttgaaaattaggtctgaattcaagagaaagtacggcaagtccctgtactattatatccaggtaagcccgaggtgcagtgtcagcctgccctgccgtccagagcaccccgggccctggcaggtggcctggcagaatgatgacagagtggcgattttctgttttctgactctctggggaagagatgctagtcatcaactatcagggatttattttgaaagcaccatttgtgatttgtcctggactttgtacaatcaggcagatgttttatatttttcacatctgttactctacaatgatcatcggtgttcatgacgatgatcctgcaaggcttgctgacatcccgaagaggcttggaagatcagttacattttacttttttttttttttttgagacggagtcttgctctctcgcccaggctggagtgcagtggccacaatctcggctcactgcaacctccgacttctgggttcacaccattctcctgcctcagcctcccaagtagctaggactacaggcgcccaccaccacacccggctaatttttttgtatttttagtagagacagggtttcaccgtgttagccaggatggtctcgatctcctgacctcgtgatccgcccgcctcggcctcccaaagtgctgggatgacaggcgtgagccactgcgcccggccacattttacttttattatgcattggttccttgaaaaatcctctgggataggcctaacaactttcagttattcagaactcccatctctccaatcagtttagcatctgtctgttttgatgtgatgtcgcatttgcagtaaggaagtgatggcattcacagtggtaccactgtgtagatttcagacagcccttgcaattcccctttctagaagttcctcagatgtccaaaggcatgcccatggttagcaaggataaagttagagctggattttttgtagccaggtttattagggcacatgtttaaagtcaaaggaccagttagactcttagtaattgttcctcacctcaccagcttatttccacttgaccttaataatgcaggaaataggagagtgagctaggaaagtaccctgttttctgtggaaagacgaggacaagagaggaaagttagggtgtttgtaggaccttgctgcagtaagaacagccctggtcactaacctatgtcaatcctcagcaccttgcactccctccaccccacagtcctaaggagccttgagtgtcttccccagcacctcctccgaccacactcctggaggcttccctggcaatggtttgggtgtggccttccaggcctttgtatcagggcaggtctcctgcagagtcttctctttgtcatgggagaagcttcattgtgcgttgaggctacttctgtgttattgaggagtctgggcttttttctgataccacgtttcttttctttcctgggccattgtagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacacgtactttgtggccctgctttcaactgaattgtttgaaaattaaacgtgcttggggttcagctggtgaggctgtccctgtaggaagaaagctctgggactgagctgtacagtatggttgcccctatccaagtgtcgctatttaagttaaatttaaatgaaataaaataaaataaaatcagttcctgagtcacacaatccacatttcgaatgctcagctttcacatgtggtcagcagctagtatatctggacagcgcaggcagggaacatttcgatagaaagttctgttgggcagcagtacatgcccagggcatgagaggacctatgggggagaaaaagggtcccagagggaccccttatctgcttatctttctacaggttaattaggtgaaaataagcatcaggggcagccacaaactggagagagcagtggggcagggtggggcaggctacagcattctggcaaaggagatccaacacaagccgatgggaagcacggagaagggatttcttttgactgggaggattgagaaagatgatagagaaaaggaacaatttgagctgcacactaaaatctaaggtgaggttttacagctgggagaaagcactccatgcaggttcttaagggtctgggaatgaatgacaggtcgctgatacaatggtacacatgtcaaaaagttcagagacttctttctgtacagggaaagttatgtctctcccttactagccagtggccttccctggagtcgcctggtttccagtacattttcatggatagactgcatacgcatgtatatatatgtatctatctgtgttcataaatgtgaaggtgctgtccccaggctgctggtactgggttctgcagattcctttttatacaagtgctccccctaagcagggtagagggctgggagtgaggggaagttgactactcctcctaacccttctccttagtggagggtgtgtcaactactcatttttggcacctggctgatgcagggcccactcagtcatctgcagggactaggtaggtaatggaaatgaatgtatgaaatgggcaggttggacagaagtggggaatctggggaaaatggggaatgcctgccttgcttgaggcattcaaattcaattcaaacaacagtcgtaacaacatggcattgaccaaaccaaatacatccgtgagctgattggctgctattttggccctttggcaaactttagatggaaatttggatcgagcatggctcttgggtcactagtggcccataacgtacgtgaaaggcccctgagatagtccttaaaaagcaggttatgcaaaaatcaggtattttatcaaatgtgtcctgcctatacatattaaaatggatgccccaaatcacagaatatactgttctgtgtgcttgggcagagttcaaggaactgcctaagaagcaggacctttctcattaaccccaaattatactgaactcagaattgatagggctgggcagagactgtcaggagcagtgtttcagatcagtgaacatttaggcattgttacctctcaatcatacgtgtgtttcaggctgcaaagggagcagtggtgtggagcagacaaggccatggggtgaatatggggaaacttacgctcccactgtgcccaggacagtctggccactggtgtggccaacaggtatgtgggaaagttgaaagggcaggccaacataggaaaggcgcttggagaactgtttcaaacactgtctactgtttttcctctatacaaagcaatggcagtccagtgttttccaaaactcacagccagggcacttgaattttggtcccattttcttctggatttcagcctgtcctcttcagtcaagctgtccaaactgtttcatgaataaagagaaccatctggaggtttgacttattctccccagaaattttactttgcaaagagaaggaaaagggtacctggcaggctgtgagttggtaacaagaactttgattttattctttgaggaataaaaggtaattgatgcaatgtagctatgaaaacttattgtactgtaacactgtgatcaagaacatgatttttttctccctgccttggtggggctgggcagagccatcatgttgcacaaccccagagaacactcatcctgttgtagtctatgtgaatgatacctcccttggtgtt

SEQ ID NO: 14174 - DNA, 12993 bp, Human
  misc_feature (1)...(12993): n = A,T,C or G
gatgaatgaggcagaatcagcaatactcatcatcagttggttaatggcaggtggagtgtcaatggggagattctaaaatgatttatcaagttattggctcagatgattaaagaggaaaacatgtgcatcttaccaagagaaggacttcaagatgggtgaaagatagtggattttgttcagggaatgttgaaattgaagtacttgtgggacatgatggtgaaaatgtacagaagacagtggttatgtggatacggaactcaaaggagaggactgggttcaatatggcagtcatgaggctataactaatagctgaagtcatgggactagagaactttacaacaaagggaccctgggaaaggctgcagtaagtcttcatgttttataaagtaattatataccatgtctttttgttaaaagacagttttagtggataaagttatgtttctttgtaaattctgcttttagaagtaaaattatcactgcaatgtaaatgagttttaaggaagattggtatctgatgaaaaatgttatggatttgatttttaaggtctttacagcaagatttatacaaatgaaagtcgaaaacaacaaaaagtttaatatccaaaagaagtttatgtcaaacatttgaaagaacaaaaacattctagaacaaaaagggaaacaaattattttagaaatcaacttaaatgtaacttctgtctgagccccatgttgtaattatttgctactttgcctcacctttggggctgggggcggggggtgggctggggcacaacactgtgtcttttatctatgtttagggcgttgtacatagtatatactcaggaaaaaaacctgtttattccatgccagaatgggaggtttgaacagatgacttggaaggtccctttcaaccctgggagtctataaaagggaagtggttattaccgcttaaaagaagaagtaggcttagtcctacttccagagagccaatgttttcatagttacagaaaggtaaatagactgtcagctcaatatgacactggtaagaattttctaacaattacggctatccaacagaagaaaggctgtctcagaaggtggttagctctgaaacaactggtatttaagggctggaaggacccttaggtatctttaggtcttcctaatctttttcatgccattgcctatacagaaaatggtatttctataacacaaataaaaaaattatacagcaatttttgacacatcaatgtctcaaggcatacttgtcacacgttctcagggctttggctgggaaaactgatttagtctaacatcctcgtttgcagagggggaaactgaatcttaacgagggaatgcaatattcccaagtcaagacgttaatgttaatactggaactagaagaattgagactagcgactgtggacaactagccagtttcctctgctcaaattaagcaagctggaggccagactgaaagactgcagtagatggtagaataaacagtctaaagctatattgctttaaatgtggtctcaagaccaccgacattagaacttgttaaattctggggaactcgctaaaatgaagattaatgggccccacatagacacacggaattaagctctgcggtaaggccttggaatctgcatttttaggtttgcgaatccccgcctctcccgttactatttctgaactccgagctccagccctggcttgaactgagacgctccgctgggcgcgcagcagccgccgatcggacctcggggtcctggatgcaggactgtctgttacgtacagcccttgtgaccgtcacgggcggacaccggccaacgccgggttggggtgaggccgccgccgcggtccctccatcaccctcctggcccggcagaggaacccactgctccgggcggccggggacagaggtggctcaacagcgccgcctcgaagccagagccctccgcaggctagaggattgcggtttcccttcatctccgcggctcttattcctcccccgcaaggccgcccaccggggtacgctctcccgcgcctgcgccaattccgccccgccccgcccccatctaccgaccggatgttagcagatttcccatagtgcctcgctagtggcgggcatgataacacacgccggagggtcgcacgcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcaggtaggcccgcttgcctgtgccctaggggcagcagggcccaggacgtcccggggttggaatgtagaccctatccttcactttctgcccctcctaggagttcagagtcaccctggttctttgattcagaccgcgaccttgccaaggggacggtggccttgagaccaggcctttatttactctcttaatacgccgtaccttcttgctaccctccactcgcttctcccatccctcctcactgtccagctttggatcctttccgcctcctctgcgaattcgcgccgagtctccggccatcatctaggcattgaggaggcggggcccaggagctggagtatagacgctttccttcactccctgcccttcctaggaggtaagggctttgagacttcagtcctgcagacgctcccctccgtttaggacagggttttaataagtctctagcattcttgttgaaggcgttggatacatagtatcttgatgacatttcttatttgggatctgtgttcatatacatgtgaatattgacagttaaacatctgacactggttattttctttttgtttatatgtagttttgtgtatttaccgaggtggttttcatctgtcttggcaagttgtccaaagaaacctgtaagttcttaccttcgattttctaaagaacaactacccatatttaaagctcagaacccaggtaaggagttttggggcatatacccttttctcatgtaataaaaatgccattaagcagttaaataccaatgttgaattgcagtgctaaagcattcagtgactgcaggaacaatcatttgatgtctgtaaaataggaagttctattttataccaaatggaaatgctttaaatataaatgagaactagtaaatggtattttaaaaataacgtatagtgtagaaagcaccctaggaagaggataaaaaagctgaatttggggccttgttgcctttggtctagaggaccactgatgaattattttctcttgcctagctcctcctttttctggctcagggaattgttaataaagttgcaacttctgtggaagcatccataaactgtaagttctgtagaactgtaaagttctatgcaatttactgctaatttcaagagctttcaagataagaaaggataaaccttttcatcataggagttcagagccactctggttctttgattcagacctcgaccttgccaaggggatggtgggttgtaaaggataaatcctttcttgtcttgggttcctaaaaaaaaaacatttccaggtaggatgtttgttgactctctagaaagcctctcggcgagaataaaaaatgctcacatcaggctgggtgaggtggttcacacctgtaatcccagcacttcgggaggtcgagatgggtggattgcttgagcccaggagttcgagaacagcctgggaaacatggaaatcctgtctctaccaaaaatacaaaaatgaggtgggcatgggggcgcagtgcctgtagtcccagctacttgggaggctgtggtgagaggatcactggatcccaggaagttgaggctgcagtgagccatgactgctccactgcactccagcctgggtgacagagcgagaccctgtctcaaaaaacaataataattttaaaaaaaagctcacattataggtaaggagttagtttcagagacatgcttaagtacccacatcttttaaatgtaagagttagtactaacaggtatttttaaaaatcaattaattgcacgccatcattccggttaagatgaagaaggaagtggagaataacagattgaatttcgaatagcttgtttccaaatgatatttctgttattgaaatacgaggctgtgttatatggatcgagaatgtattttgttgttagcttttataaatttaggaattcctcaaagacttgaaaaagtgttttgcttgaaatatggaagggaagtaaaaaacttgaagcaattgatcatccagcttcttaaactagtaatcagcctggtgtggtggctcgcgcctgtaatcccagcactttgggagactgaggcagatggattgcttgaactcaggagtttgaggccagcctgggcagcatagcgaaaccccgtctctacaaaaaatactaacattagctggacatgatggcgcctacctgtagtcccagctactcgggaggctgaggcaggagaatcacttgagcacaggaggtggaggttgcattaggccaagattgtaccaccgcactgcagcctgggtgatggcctgggtgacggaccctgtctcaaaaaaaaaaaaaaatcctagtaatcaaactgttgactgtttctggtggtatatggtatactccttagttgttagataatagacttttgataatgttggataaattacttacgtttaaattagttggataaaggaaagttaaatcattatattaagttatgtgtggtatggattgtgctttcctggatatctttagaaattaatcctgagaggtaaaattgtggcatcttttttctttttatttcattccatagatgcaaaaactacagaactaattagaagaattgcccagcgttggagggaacttcctgattcaaagaaaaaagtaagcacataagttttcaacattgctgaccagttattctgcagttaggagcaattgtcatgtcctttaaaggaccagatggatcagactttttaaaaaataatctgttatctacaaagaaactttatgtcttctcatctgcataaataatgagaatatggatgtatggggtggaggtgaagaagtggcagtagtttgaaaatggaagctgattactaaactctcaccttgattagtatatataaggaaaatgtatgttttaatccatatacatctcatcccagagcacattttccacctggtgataaaatctgtctgtctgaagtcatgcagttgcctttccctggcatgtgctatgttgaatttgccagcaatggtttgttgacttacttgggttttttatttatagatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagtgagtatcattgaaatacttttttcttatggtaaagaattgagatttatataactatgaatataggtagttttctcttaataggcaaataaaatatggtagaatgtcatcaagtattcttcagttaggcagaagtgggatagttctcttatgaaaagtgagatagccactaggaccacttgccattgagtctgtttggaaatccttgttgctacttgcagatgtatccacatttaaggtgtacagttcgtagaacagtaatggaaactacaggaacagagttatgaaacagtcaaaccaggagtatcaagaatctttgcttctgagtcttctttagaataacgtattaatttgaattattctatagattatggtgagtttgatatggaatattgctgagtagactgcattaattcattaacacatcggaaaaatgccaatttatctaatcaattaagtgcctttaggatggaattctttttttttcttcaaagaaataactattaaaaacctcacatggttcaaaatttgtagttcccagcttaatgtattaattcacataaatgtcatcatttgaaagttatacatttttttcatagagccagtattagttttgaggtggtcagtttgctagtcgtgtacctacactattacaaatgatcatcagagttaaaactatttctttgaaagactagattacagccttgaatgtgggatgccaatacgtctttccctgaccctaatgttttaagctgtcctagcactagggttgaggacccgcccagtttcgagaccatgatgccgctactttagggtggctgatctaatcagtaaaagggagccagaaagatactaagagtgaaaaatagagtgtctacataaggatggtgtttggaagagtgattactaaagtatatcctccctctttcattctcccttcctccttaatgcacccagcccactgtgctaagagtagagaggaccagaagcatgaattggacatttataaagtttcccttgtcattctctctttcttttgtaattgttcttgactcccagtaccaactagttcagagatcaagtgagaagtgtgaggactaggaagttacaagtaaaaccctcaggagagaaatccctagtgatagctctagaaacaaagagggaaatagttaagttgtaaagtgcttggagtctatagtagtttcaatactcagtgactgagagattcaggaagaagaaactaaatcagaggagccctacttacagttatgaataaaagttgaatttgttactgattatagccaaattgctattaagagccacagaattttgtaaattacaggtactacttactatccaaattcagaaacttaagtataataatgcaatatcactccctgaactcagaaattaaactgatagtaagggatacttgtattcttttccacagtttcttcccttttggtaactagtaaaatgaatttaacacaactatggagctttaaaggtggagacattcagggaatggagtgagatgaaagattattaaacaaatagtccattgttcttgggttgtggtggaagcatgcagtgatttggtcaaggggacagtagtatcttacaaggatgaacctaaggttgttttatcttttaaaaaggttttgtacatatatattcagttatttagttcatggagactatgagaataataggtaaaggaaatggttttgtatggaaaataactggtgaaatctaacataattttcataacagtgctgtcaaaaaaattctgaccgcaagatgtaataatcacactatataagaatcataacattcactttaaggaataatctgtaatgcgtagtagtgaataaagtttctgtaggtaaaattaagtctcatggaggttaacactatttttgaccctccaatttttttaattcaggagttaacactgcttggaaaaccaaaaagacctcgttcagcttataacgtttatgtagctgaaagattccaagaagctaagggtgattcaccgcaggtaaagctgaaatatatttttgtttaatttttaaaatatttagacaggaaaagtctagagtgccatgtgtcaggtagtgaagaaaagtagtgaatatccagacagtaaactcttttgctaaggccctctttaaagaaaaatcttttttcttaccatatacaatcaatttaggtatgtagttgccaacacatacatacatacattgccaactttttaaatttaaatacttaacattttttttaatatgtagggatattaaagttcttctggaggcttttctgttccagcagttcttaactgttttacgatcactagaaagaatgagagtagagctgcaatattttctatggggaattgattgtaacctattgcttcatttatatcttttaataacattttggttatacccatagggatgtgttatacatgtgaatgcatcatatcagtgtgtcaaagaaaaagaaagcttgtcaatccctgctgtggcttagtctttcctatttttttgctgcttagaagctccaaatgggcaattgctttttttcctgtatcatatgacatagtaagagaaatggatgtttagatccgtaacccatgttaatctaagatgaagtttttggcactctgcctacgggattattatatctgtagttcactttacaaattctgtttccatatccctaaataacatttttatattgttgcttcttgattttttttcaactttaatcattgtttatcttatgctttaagcattacctaccaccgtttaagctagacatttcttccccgggtgaagacgctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaacttaatctctctgcttttagtatggtaccatttccctcaactgtacctgtacctggttttcacagagtgacactattttactctctagagaggataaatgtcctaaaatttgccatggtagaaatttaacctcttttttttttttgagacaggcagcctgttatacaggctggagtgcggtggcactatctcagctcactgcagcctctgccttccgggctcaagcaattttcccacctcaacctcttgagtagccaggtctacagtcatgtgccaccaagcctggctaattttttgggtattttgtagagacggggtctcatcatattaccccaggctggtcttgaactcctgagctcaggtgatccacccacctcagcctctcaaagtgctgggattacagatgtgagccactgtgcctgacccaacctctctttattttttttgagtcggagtctcactctgtggcccaggctggagtgcagtggcgtgatctcggctcactgcaacctgcgcctcccgggttcaagcgatcctcctgcctcagcctgcctagtagctgggaccacaggcacgtgccaccacacctggctaattttttatatttttagtagagatggggtttcaccatattggccaggctggtctcgaactcctgacctcatgatctgcctgcctcggcctcccaaagtactgggattacaggcgtgagccaccacacctggccctaatctctttttaaacagtctttcagccaatcttgtgtttaaccttagcttcacctgttttacacctgtctggtgctgccaattcctgagatatttgggaattctgtatggtaaattaagttgcttttaggttttctccactgtcagtttaacaattagctttcttttgtcagttaagtcagttaccactaatgcatctgcttttcagcttccagaattttgtgttgatagtgccctcttctgttgtctttattcatgtgggattatcctttaaaaagatttctttgtttaatgggattttagggaaagcaaaagtaaacatctttggctgggcacagtggctcatgcctgtaatcctaacaatttgggaagcggggtgggagggttgcttgattccaggagttcaagaccagccctgggcaacgtggtaagaccccatctttacaaaaaaagttttttaaaaaaattaaccaggcatggtggtgcatatctgtggtcccagctactccagaagttgagacaggaggatcacttgagcccaggaggtcagtgctgcagtgagctgtgatcataccactgctttcccacctgagtgacagagtgagaccttgtctcaaaaaaaaaaaaaaaattctatccctttaattttataaatgaagagccaagcccaagggaggtaaagtgaccttttccaggtcatataattaagttcaactaagtagacttactggacttgtgctgtattgttcttattactgcatctaaacactgaagcacagattttcaaataaaacctaaagctacagggaaggaataaaaacagactttgaagttagtttatgacaacacatagattatacctgaatattaatatttccgaatcaaaaatatgtaccttcattcagttcatttttgtaaattgtaacagtttgatagtttttgtttagagagaaaagatgttaagaattgatgaggctttgcctgtaattcttggtatcttgagtttttgttggaatgaataataaaggtcactgaagtccccatatctaccttaacttaaacatatattgttttacaggaaaagctgaagactgtaaaggaaaactggaaaaatctgtctgactctgaaaaggaagtgagtattacggttgttagtctcaagtgtctacttaggatatctgtgagagaatgtattagggcaaggcttgattcatgtgaagacaaccttgtattactaataatacaagtattctaaaattattttcatattctcagaaccagtttggcatttttctcttggtagtttttgtctgcaaataaaattggtatttgaaaccacagcactcataagcctgagtgtccacttattcagtggcagtgataccctgctgctgcccccttcctgcacctcaagatctgaacttgtaacaatttcattcaaagagataacagtctatctcttacattttcatcatctaacttttatctcatgaaaatatttcttctccagtctgcctttatacatgtagaatggtaatgtaatttctaaagtatatacagaagcattccagaaattaattgctattttaaataatcattttatctcaaaaaataagtaaatcattttaacagttatgctttttctcagttatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccagttaggtctcaatacctgaagctatcgtaaaattaagaaaggataaagttggtaaaccttttatatttagtatctttttattcagctcatggacttctgccagcataatacttgctttggaaaacccagataaaggttcatgcaaactttattttgtgtttaggaactactgaggatcagagtaatccaagcaaatgtgaatcattttacctttgacaaaggtaaatcagactatgaagttttttttatacaggatgatgactatggaaagagtactcttgtttccttatattatggaggcaggagtttcgttttcaaaattgttacaaattgtagaagccacggtgttctgtgatataagtgtgtgtttttcataaagcaggcagaactcatctaggtaaattacagttcctaggtataattcacattgtattcagagttgatggttgtacatataagtgattgctggttttagttgcaactttgtataaaagggactgagaaatttataaacttttttcttactgtcttttttctaaagtaaaaacaaagaaattatgtgccagatttatgcatattattttatgttgcatagaataaaatttttaatctttaattttacatttcctaaatatattttaagacgaaacatttgttctatagcttttccctttttttaagtaaggaattttatttttttctgaattattttctctcgtgagtatattgatccagaaagaaaacttgtattatgtgtgttttaaaatgagaaatctaaaaaacgaaaagtctccaaagtctctggaatttgaaacactttgcataacgtataaaagcctgtttaagagacagccaactatggcctgtggatcaaatccagcctgctgcctgctttttatggcctgtgagctaggaattgtgtttataattttaaatgtttttttttaaagacttttatgatacttgaaaattaacatgaatatttagtgttcataaataaagtttgttgaaacacaaccaagatcattcttttacttgtctatggctgcttttctgtggcagagtagctgccacagaaactatagcccacaaagcctgatatttactgtctgtctgtttatggaaaaaatttatcaacccatggtctatagtatagtgtgatatgactactgttccaatgtattgaagtgttgggatagttttttcaaatgttttcagatgttcttgttttagaatcattgtcacctttaagaggaaaaaggtcatcactagataatctaaacaaattgttgcttctcagtgttagcaaggaaaataatctagtttcaaattacattgcagtataatgaaaaagatccatatactgtggaatgatattcttttaaaattatttgctatggcttggtaaaaatgtactttttcc

SEQ ID NO: 14175 - DNA, 12993 bp, Human; identical to SEQ ID NO: 14174
  misc_feature (1)...(12993): n = A,T,C or G

SEQ ID NO: 14176 - DNA, 20063 bp, Human
gactccatctcaaaaataaataaataaataaaaagtattttaaaggaaggggaggcaggctctggttcccacacaatccccgctcagtgaccctggagccacccctggccacgctctgccagcagagaaccaaagccaggtcccttcagccctaaagaggccataaccacatgtaacccccgtgaaatgtccgcacatggccccgctctggctgagcagggagaggcagcacaaccagaaggttccacaggcatccacaaccctccctggggctttccaagagtatctgagatgcctgtagggtgggagacgtccttcccctaaacagacaaccctgccacagcttcacagaggtgagatttcggaagggagccccaggcagaaaaagggactaaatttgggggcaggagggtcaccgcttttggggaccttcgtagcccccgcaggtgcagccctgggggagagatctgcccatcgcagcctccagaggcagtgaggacgccctgcccaaggggcaagcaacgtaggtgatgggggcagcaaaggggcgcaggaggcctgggccaggcccagtgatcccacccctcaggccctgcccccgggcctcggcctgcacaaatcaggttgattcccgacctccacaatacccagggcactgtgctgcagggacactttcccacaagcccaacccctcacagcagcacaagggaagaggcaagaagacctgagggtggtgggcagagccaggcctccagcacacggaacacagagggactgcaacggtcctctgttcaggtgcctgagagcgggatctcctccgcctcaactggatctcagcttaaaggccagctcattagagaccactgtgacctcccttctgggcggccgtccccaaccctgggccccacccccacggcccccgcctcaccccggggtccccaggccacctcctcctttgcttcatctgcggccagctccccggcgtctgctccgggcccaggtatgagcccgcgcgtcactgcggccgccggggcgccgaggccagtgcggggacacagcaagcctcccgccttcggaccttccgccgtggccccgcgagtgccacaggtttccacagggccggggcacgtggacccgcgcagcctgggagccaggaaccccaaccccggcgaggggcgcctcgcacccccgtcctcacgcagtccccgaggcctcccggtgactgccgggtgtgggaggaggaaggtggcaaccagccccgcagctccagttgctgcaggagccccccgggcctcagtctccaaatacgccaaacgggcgggagtgagccacaggctgtcttcgcggaagactcacaggcgcaggcgcagacgggtgcgcgcccctagggtgcgcgcgagctaagaccgcggcccggggcggggtgtccccggccccgccccctgcagccctaccggagccagcgcgcctgcgtcgcgggcgcacggtgggcggagttcccggcgtctccgccccttacccggcgtgccccgcgcccggaggcgctgacgtggccgccgtcagagccgccatcttgtgggagcaaaaccaacgcctggctcggagcagcagcctctgaggtgagggcgaggggcgcgggccggtgtgggccgcagagacgttggagccggcgggggctggggactggcctcggggcgacttgaggttcgcgaagggcacgtcgacccccgcggcggcggcggcgacagggccgggccgggggcggacgcagacgggccgggctgaggctggggcccggccggagtcggggctgggcggacgggcgggtcggtgagctcctcgcacccctcacaggttcccgaagtcgctcgcggccgcttgtcctcctctgcctgtccctgcccccgcccgtcgcccggaagtccgcttggacgccgggctcttctccaggaaacctgggcttcctgcttccctcgcctctgcctttctcgtttcccgaggccgcccgcgcgtggacggttgggattagcggccgcgggggccggtgggggtcgtggggcctcccccacccgagtacaggcgagcgagcggcatccgggcggacccccgcctcggggaccgggaaactgaggctcgggcggcctgagacgccgtcaaggtcatgtaggtggtgggggcttgcatcttcgcctcccgactccatccagttcgtgtttgctgtgaagacggtaccgggtcaggggtggtgagagcgggcgggcaggtggacaggaaccccgtgcccttccctgtctgctgaacggaatgcgtggacctccgggggagcccagagtgcctcccttcacaccagtgagacgcaatttggggtcagcactcagggcaccggtggcctccagagggccggtcgatcttcgctttaactccagggtggtttccttgacgttgtcggcagtagataagaaggcctcttctgagctggtgaatctttaacctacctgaatctttaacctgcctgcggaacgacctgctcgcagactctaggccgcagaggccggccccagcgctctctcggagcacagcctgggtggttacggcgtgtgagattggggctggacagccgtgcgcacctagagtgttaaataaccattccgacggcacctcctggcactccctttcagtccaggcagccagttgctgctttgcaggaattgagcagaaatgcactcggaatcgcgggcaggaaaagaagggaggtcggaggctttggatggtccccgaagtcgccgcctagttgagagctgtagagttggtgccactgcccctgttggagtgggcagttgtagttcttgtttcagaactagtggtcagcagttttctttgccggctgttgcaaggctggtggttctggcgttttccgcagtgtgttgggaggagtgtgagatgccgcggtgcagttgtgtgcggcccctgtggccctctgctgttgcgttagccattgtctaacacgtgtgaccgcatggatggtgtcctcatttaatttgaattttcaccagcactgcctaggtagccagaaccataaggtcctgaaatgccgtactattagctgggtccaaaattgagaagaattgagtagtgtaaatgttagtcacacatctcattggacacattgttagagtgtgttgtccatgttttcacatgttggtagactggagaatagctgtcacttgtcttcaggcgtatcttgttgaaaataaatccaaatcactgcagcagtaggaatatgctgttgcctgtgaggcagattttcggatttgctagttgaaaaagatttgaaacagttggtttggacaacagctgagtcacacaatgactgtgagtgaaaagcaaaaactggttctgtgcccctcacagttctggttttgtacatcatgtggtctagctatgggctgtacctcttgcacaatatggagaggacattcagacatcttcaactgctcatctgcccctacggaccagacaggcttgaaactataggaagatgcatttgacctttcatttttcagttcagtagaatttaatatggactgtcagccgctgcggtgatcatggaagtagacctaagagaaaaaaacttgtgcaagttcacacgtggagtagtatatgaccatggtttcagagaactgaagcagttctttttagattcttcaaattaaatgtctccttggtgtatttaaacctgctgttactcacaggccaggctccaccaagctttcctacacacttcttcctgagctgtgaccattctcctgagcaagaggctgcagccagcctgggctggcgggcccatactgtctctcataggcattctctccccttgacctttcacctccgtaaattcaagagggtgaaaggaaatagagtgcactgtcaaagataattgggagagaaacacgaaaaggcctcgcagtggggatcttaaattatgagaacttgtgttttctgtgttgtgcctgctcctcattggcgtggatggttggtaggggcattctgcccgtagcgtctgaagtggtcttttggaaaagatttggccccttcatgttgggattccaggacttgccttcatcctcaggttaatattctcctgtgattgttacaagctctctaaggcatagttgcatttattgccttacagctgcgcagctgccgcaccgtccagataggtagtttcacattctcaggtgggtcagatgaccttgttagcgacttgacagacatgtcctggatgctctttgttcccaggaggctctcaggtcctcccccagggtcctgtcactcagccacctacagggatggggagacagtgaggctggctgataagccataaagtccttgactaatcctggtttcctggttctcacacagtggtaacaagggcttgcagccggttgtcagccaacagactgggaagggtggtgcttcttacaggccctgataacaggagaagcctaaatgacaagagaagagacagggaaagcataaaaggcaggcagattttcacaggcacagcaattgaaaatgattctgtttagaaggcagacattctcccacacccttgaggcccagggctcactgctggtgtacagcatgaagtggacaggagagttgattcagtccatgaacatttcaggaagttagaagtctatagttgtggattgcaaaatacatatctggcctgcctcccatttcctggctaaaatacttggaatctccgaagtgatgatgtctttttgtaccctaatgagttgaccagtgatgggcagcccctacgaaacttcagggtagggctagtcacagggccaaggcaggattagagggtttcagccccaccctccaattttcccagagtggagagggactgaagattgagctggtcaccaatagccaataatttaatcaatcacacctataccatgaagtcacacttttgccttcagtagttaacagcatctacagccccgtgtttccacatttgtacaaaggaatgttcagactgaaccacacttaagtacaattttgaaacagcatgaggctgggcgtagtgcctcacgcctgtaatcccagcactttgggaggctgaggcgggtggatcatgaggtcaggagattgagaccatcctggcgaacatggtgataccccgactctactaaaaatacaaaaaaataggccaggtgtggtggtgtgcacctgtagtcccagctacccgggaggctggggcaggagaatggcgtgaacccgggaggtggagcttgcagggagcagagatcgcgccactgcactccagcctgggcaacagagcgagactttgtctcaaaaaaaaaaaaaagaaaaaaaagaaacagcatgaaattccttgttgatgggaaatacccgaaaggcctgcctgggttttcagagagcttccagaaagctgaattcatggaggttcctggagaatggcacagccaggagggaaaggtagcgccgtgtctcttccctcatacaccgcccactgcatctctccatctgtatcctttgtaacatcctttatgaaaaaccagtaacctttagtgtttttctgagttctgtgagccactctagcaaattaattgaacccaaggggaaggagttatgggaaccctgatttatagatggctgtccagaagcacaggtaaaataacctggagtttgtgattgcctccaggtagacagtgtcagaattgaactgaattaaacgacacctagctggtgtctgctgcagaacgcagaactggttgcttgcttggcatgtagggagaaacccctgctcatgtggtgtgagaagcgacctgtgttataagagtgtgtgagaaactgagtttgggttttcctatgtcctcaaaatagtatattttgaaagccttctaggcagaatgtattaaaatagtttttactccctgaagggatgccagcaagctagaaagattcatttccaaagggcttccagtggtagcatggctagacatgagacatctttccatttgtgtcatacagcaagttatttttgcagtaccatatacgctatgcgggaaacttttaagtattttataggtttgatttaggtacaaatggccaagaagctatcatctatactcatcctggggattgggaacggaggcagttagatgtgcctgtgctttgtaccttctgtagatgggaatgcagttgctcactcaccaatcaaatttattgatttatatttaaaatactatgaatacatcttctggcaattttggtggtgacattttccttaaaatatttgtactagccaggcactgtggctcacacctgtgtagtgcaatctacttgggaggctgaggcaggagagtggatcacttgaacctaggaggtcaaggttgcagtgagctgtgatcataaccactgcactccagcttgagtaacagagcaggacccttagctcttaaaaaaatttatacctactcatcagctgaggacctgggggcaggtttagaaaacagattttgaacacacatccttccctccctcttgtgtctgacatcactgagctgccacacttttgccttcagtagttaacagcatctacaaccccattttcccacatttttatggtcaaaagaatgttcagactgacccacacatgagtacagtttttaaaaagcatgcaattccttgttgatgcgataggtttttcgtgacgaacttaatttttagggaaagcacatctgcagatgtgtacagttgatcttcatgagccctatgggcctgataaacattcttttgccattgttttctcctctccttggtggtgagtcacttgtgcagtgcccagcggaagagggtgggaggctggggaggaaggcctgttctgggcaaaggaagccctgcttgatgagcatgaggctccacgggggcagtggctgtgacggtgagtgccacacagagctgcccacactggtggagggaaggcagggagataccaggaccatccggaaggggctgagtgtcatttgacaggtgccatgtgagcagagatgtgaaggagtggcccgggacaatcagggcagaatccctgaggtgagtgcgctggctggcagagtttggagacctgtcaggagtagggtgcatactgggtgggaagcctgctggggtgtgcagtggccctcggagggggtccgcggttcccagaaaaaggaatttggtaatctgtggtggcatttttgggtggcagcactggcacctttggcagtggcaagaacacttcctgtctgaccttcatgtaggggaggtcgtctgatgtcccagacctgttataaatatgaaaaaaaaatttttgtgcatagttttaacaggtgttctgaagttccaggaacaaaatcaccttataaatcaaagatgactgtgtattgttctcttcagaatcacagcaagaattcagtttccagaaggaaaagctacagtagttgcttcatggacatggcttgcccttgaggttggtggtgtcagtgcatgagcagcctggtaagggtggttctctggccgccacccttggtcctctagcgtggttgtgaagtcactttcctttactccccattgcatcatagttgggacagagcagtggttctctgccgtcttgtgcgagtgctgggatgctgtctctacttccttttgggttgccagaggcagcatttagagcacagtgtgggcattatgttgtggaccaaggcagcctattgcaaggacctgatcgggcggcagccgtggggcagctctgagtagaacatcgggtcacctggctgactggtgtgctgagaacacgcaggaggaggctggagacggggttcttgcctggggaacaggagggaggctactcgcatcacagcggagaatgcctgttgggtttgggaggggggtttcggctgcaaagctggctgtcaaggggcaggaattgggaggagggtctaaagtcttgaagagaaatgtggggtcgttgtgtaggggccaccatcacctggagagcagggcagatgccagcgtgtgtgtgagaactaggtcacttgaagggaggtccccagagtgtccccggggtgtgcctttctctcacctaggtctggagtgcctccagaagcgaggatttcctgcaagggcggtggcctcccagggtctgtgggggggcatccccgtctctttacatgtctgactgaccagagtggggtggggtggcaaggtggtgctcgtcccaaagctgggggaaacctggtgatggttcccactcccattgttgcacttcgcttttgatttctctggaagagcaagtctttgtgtggtgtttcccctcagcctacatttttaaaatgaacgtttcttgaaggcagaaatcaagttttaggcattggctcaatcactggtgcagccattgcattaattttctttaacctggtgcggagaagctacaagggccccacccccttctagtggttggaggaaggagcaacttgctctcccagtttatgacagcaacaccagcagtgtgctgttccagttccccttttttttttcaagtggtgtagaaaggggccttcagggccctggatcccccagccccacacaatggtgggcctatgttcgtccagaacagtgcctggcagtagctcagtgcccagcatgtctgtggtgagtgtgtagttcaggaagtgaactggcaaaactgagtatcaccctctcttcctgggttcttgccactcccctgaaaaccagggtagcattgtcacatcagatagctccgctacgtgtgcgctgaccatgctgagatgggcactgtggactcagcctctggtcattgctggaaccagcggcctccatgtgaggtacaggggaacgcactgctagcagatggttgggatgtggacactcgtcctgccctcttggcttggtgctgtgccatcgcacagtcattcgctgtttagcatgcatgggagagagtgaagcacaagggcccaggcccctgggagtgcctgccctcaagttggaagagcccttgggcacagcataggcgcctggcagaattggactgggccatgatccagggcattgggacctcacctaggagttggggttctggtcagaagccctgtggagacagggtctcccctgtgggcaccaaactgacctcaaactgctggttctttggccctggggacggggctggttgaagtactctcccggcagctgtcacctgcagggagaggtgggggtaggggtgctgtgtttcttagctgttcctcgttgcagtgttaaatccctgcaggttccttattctcagcttgtgttgtgagtttcagtgttgggggctaatgtgggtttgcgtttttggtcttggttttcccagtggccagtccatcagccactgcactgggggccaggtagaggccaactgcaccctgcctgccagagtagaaatactggtaggccccaggctctgctgccccttccatgtccttgtgtaagcatccatggacaaagctgactcacggggtgtgcacagctgcagggaggccaggaaacaggggttttattctagagggccttgtgctcagtgacagaccagagtcccatcactgagagagcagggctggggcagcacaaaggactggagagcatttgccatgatgccatgtgcacagccagtgcaagtccttcattgtagctgtggtcagaggtcatgagacactgccttcagcagccctgggagtccacctggtgtgtggttagagctgtgcatctgcagatttcagaaggacttacgtttggtgaggtgctttgaagtaacacttcacaaataccaagaagcaagaaatacacaaataagcaggtaatggttctttggtgtttacattagctagtgggcaacggttctttggtgttcacattagctatagtcccagaactcagtccatgaggtggaatcacaaaaatggaattcatttctggctgtcagtacacaaactgatttaagatatcaccttgaattttaagctgacaaacagtgatctaaactgaatttcactgattgccccacctgaaagtcagacctgatagataatgccctcccttaactcaaggccagcagcagatgtgttagaggggacccttgtgcctcgcagccctcatctcctaatggctgtggggtcactgtgtcgagttgtaatgcctaatgagctcctctaaaaacatcctgaaacttgtgtaaaaaaaacagcagactcccagtggaactcgccttcagatgcagcccagaataagagttctagaatgtgtgtgccatccttttgtctcaatctgcatgattgcaagtctcttcaacatgattgggtgcgtggagtgtctcggtcatgtgtcttcccctctgagcatgccttttgattcgcacctgtgtcacaattgtgccagcctgtgagatgtgtctgcctgtcaccagtatcggcacatttagttttccctttacgtgagttttggtaaaatagtgacaaaatgtaatgcagtgctcagtcacagaaaaatgtcaggcctacagaaatggagcatttggctggcgggtagcgtgatgaccataggctttatttggctggtgtggtaaacaagcagcagcttgtgcaggtgagaataaatggccatattgcatttcattttaaggactcccttaaaatgaaaatcttcgtgtgggacatgaacacaggctttcacgaaattgatcatctacactatatgtatgactgttgaaaggctgttgttcctcagaaattcttaaaatgttatgtaatgtacatgagtcccttcaggaagtcatcagctttgttcagtttcctcagattagatagtaaaactgagattatgaactataaagatgtgtgtaatttatctgtcagtgaacttgactttaataaaagctttttgaaaaagaactctgggtggggtgcattggctcacacacatagtcccaactactgtggaggtcagggcaggaggatcactggagcccaagagttcaagatcagcctgggcaggatagcgagaccctgtctatagaaaatattaaaaatcagctaggcatggtggcttgcccttgcattccctgccacttgggaggctgaggtgggaggttcgcttgagcccaggagctcaaggctgcaatgggctgtgatcgaaccactgaattccaacctgggtgacagagtgaggccctgtctcaaaaagagaactctcgatgtcactggctttccatgtaagcagagcacatcatgtgagccccattcgtggatgtcagtcagcagaacagaatcttggacctggagcttgtttgtcctgtgctagaggttggaggtgtctctgtctttctgttggttcctgtcagttcaggtcacttagagattctgttacatacaccagctctgacaggttgggggagatgatcaaccttccgcctgcgcctgttcccttccctgactcatgccaaagtatccctgagatctgcaagggaccgaggacagtactggctggtggtctgggtacaggccacagaggcatctggaccccatgtgcatctggaccagtttggttggatccattcatggacacaaaacggatgtgaactcacagagctacattttctccctgcccctgttcaggcacagtgaggtgtcggggaatgtagctgccagagttgactgtcccgttctttggtgtaatgcctgaaggccacctttaccattggtctgtggtcctcactgaagaaagaaacattcttcctaaaagactttttttcctcagagttggagcccacagcgtggtcaggaaagagaagtagccactggtggctcctggcatcctcctgctgggcagccccttctcaaagtgtgaggggtccccttgtgtacaagcaggaaggctctgagaaagtcaggtttgctcctaccacaggataattccgatgaacctgaaaagcgggttttggcttgtgtgcagggactctggtggaagaaagggtgacagcacctggcctgggcatgacacaagttaggacccgtaccaagaggccctggaattgagggtgggggttgctgtggactctttctccctcttaggaaactctattgggtctccatctgtcacagaagcagtaaatgatgtaggggctgccaggtatagggtcctgtggggatgctggaacatgccgaggcaggacgtgccagccaccctctgcccatatgtgcagcagggccacagatgtgcttgtcggtaggagagaccaagctgtctgtgtgccgatgtcttgacacctgagacttcaggttcacccatcctggttctgccattccattgcagggtggcttccctcctttggggactcttaacgctttggtctgttaaaaaaaaaaaaaaaaatccgggcgtggtggctcactcctgtaatcccagcactttgggaggccgaggtgggctgatcatctgaggtcaggggttcgaggccagccctgaccaacatggtgaaaccccgtctctactaaaaataaaaataaaaattagctcagcgtggtggcacgcgcctgtagtcccagctactcgggaagctgaggcaagagaatctcgaacctgggaggcagaggttgcagtgagccgagatcgcacctgagaggttgcagtgagctgagatcaagccactgcactccagcctggatgacagagtgagactctgtctcaaaaaaaaaaaaaaaaaaaaaagccaccaatggggagggcctgggattactggcatcacaaaccccactgcctgcaggctgcatgatctcctgggcatggttggcggcactgccccgggcatgaggaggcagcaggcatgtgtggatcacggacagtgctggggtcgagggggttggtgacggtgtgacaccccttcccctgagtggctgggtgttactgtcaattctcccaagtgctgtgcttcagtggtcgtggcagtctggtgctgcctctgcccaactggcaggcgacccttattcctgagtccctgctgacttggtgtcctaggtttattcctcctagacttgttaacttgtacagttaacaagcctttgacaccacacaccctcgcctcagctttccaaccccctagtaataacaacatcaggactccctgagtatcctccaccatatgttttcctggagtaactcataaaaggccctcttttcgttccatttcatgcttgggtttttcatgcgaacctgtcattattagtttttccgcattgcctagagttgcccaaccccataataagaatacgtaggtggcgtgccccattcttgcaggtgtccacttcctgctccagtctgagggggttggctaggctgctgctctctctccatgtggggttggctaggctgctgctctctctccacgttgctgtgggctcgcatcctctccctggttccctgggggagcttcttagggagggagcatgtgagagatctgaggccctgcagtttgggagttattttcattctcccctaacacttgttggatactttggctgggtatagaattaaagggtttcgaaagcagtgtttcagagtcttccattctctggggcatcagaggtgtcatttgcccctgtgcattctggagtccaccttgcacctttattgggtctcatctaggtccttggctttgcgcttcagccctttgaggccgaagcccagattcctgggtccccactctggaacagggaaaaatttcaccccgtaatttcgtacgttctttctttttagggtttctgttggttgatatcttaagttactcctcatcttcctttttcattctgtttgtttttgttctgccttctgagcaccttcattttgaattttccttttcagctatttgtgtatctatcaggtttctctccttgtcctttgttaaaatagtcttctgtcttcagtctcctgtcttggttgcctccttgcagattccttttatatttgggtctcttatgttggtggcctttcaaaggcagacaggcctgtctcttggtggggggtgggggtgggcggagctccagttgcttgtgtgtggatctgctggggcatatagaactctcaggaattattctggaatttcatggctcaagtgtgttgtcatggctcagcgcaggcctaagccctgctgcagctgctcccctagaccaagcttgtccaacccttaggccgcatgtggcccaggatggctttgaacccgacccaacacaaatttctaataaaacattgagattttgggggtttttgttttggtttggttcaccagctgttgtgttagtatattttgtgtgtggtccaagacaattcttcttccattgtggcccagggtagccaagattggacattgctgccctaggcagtcccagcttcatcccttgggtcccaggcggtccagttttctctgcctggtcaatcatcacatccaaggtcttcctcccttttctctctgcccttcaaggcgtgtgtgtcattttggtgtcttcattggtagtggttgcaggagtggactgagagggcaggtattcagtctcttctgtgctccatgggtggtggtcttcctctgggcttagaaaacctggccgtccccaaaaagggaacactacagtgaaggtccttataaatttcagaactcatttaaatttcagaataggtgacatgttcaaaaccaagagcaaagtgtccaaaggacactgatccagcttgaaggggttctgtggctcatctgggatgatggcagtgttaaatcagacacgggcggccagttcacacccactgaaacacacaggcatgtgtgggctcttgctgatgttgagaaatggagaagaggcatttccttgccgtagcgtgctggggtgactggatgagagagtcaccagcggacagtcatggctgtgattcagccaaaagccacctgtgtgtggaacccctggtggaggaggtctgatgaggggtgggtgtgctcacaggctcctggcatgtcctcttgaaggcagaagccttcctcactcggggtaagccccgcttgcgggtgcagtgaagaagcagtcattgtttcagaaagtgaccagtgttttctaaagtccctgttcgggataaaatcacctgattcgtgaaattgcccactggccagtgaggccaaagcctaacaacttcagtgtcctcacagaggcgtctgggcagtggaggcccttcctgctggagtctccgcagggctctgatggtgggtgccagctgacttaattgctgtccccgatatttgtgttctgctgagggaacccctacccttgcggtgtggggcagacatggcgggcgtgccccatcgaggctgtgtcctcatgggagtgtgtccctgaaggtgtcctgctgagtctggcgtggccctgtgtgctctggtccttgtgagtgtgggcaggcacagtgagtggtgctctctggccctggaaggttctgtgttggggtgtagaggagccttgcacgcacctggaagccagtcctcaggcagccagcctcccctcctgcataggctgggatgaggcagcctttctggccatgcagctgtggggacagcttcccaagatgagggcaacagtttctcaattcctgactcagccattttccctcagcccccatcctgaggtggatttggggggcatgggaggcagggctctttccctgtttccctgcaggcttccaggaggtggggtgaggcagtggtgcatccctgggtgggtgggttctgagcaaccactgctgggcagcacagaaccagacatggagcaccttgtctctccaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggtgaggtgggggccagcagggagtgggctgggctgggctgggccaaggtacaaggcctcaccctgcatcccgcacccaggcttcaacgtggaaaccgtggagtacaagaacatcagcttcactgtgtgggacgtgggtggccaggacaagatccggcccctgtggcgccactacttccagaacacacaaggtaagtggctggggcctggtcccatgggcactcctgcttctagagagggggggccagcccatagatggggcatcgatgcccatagatgcggcaggggggctgtgttcccatgaccatttgacactggctgcccggcaggcctgatcttcgtggtggacagcaatgacagagagcgtgtgaacgaggcccgtgaggagctcatgaggatgctggccgaggacgagctccgggatgctgtcctcctggtgttcgccaacaagcaggtaggcgcccgggccagcctggggaatgtgaggagccagtgtgggttccgcctggtggtaggggttactggaggctggtggggcccctttctctgtcctgtggacagcccttcccaccaacccttccttcccccaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatttcaccggctctccagtgcttccacacaggcatgctgcccccaggagatggtgggtgcatcagccagctttactctaggaagtacaggtgactgcctagggccgccacctcagtccacaccctccccatgttccctcctgagtgtgcaggcacttctctgtgtctgtgtgagaggctcttccagcatggttgcccacagtgaccttgatctcgtttgcagtcctgtcgggcccagccaatgagacctgggccatacagggcaggggtcagcaggcaccatggaagacctcagcctccgtccttccctccatcggcctgctgctgaaccccactttgtatagctggctatggggcagggccactgctagcatacatagggctttgtgccaaccagggaatggtccctgcctgagtgggcacagcccccacctctcctcaagatgccatgcagcagggggctgccagtctgggggtacctgtttctgggatggggccatcagcaggtctaaggtctgccttctgttgggcagagtcccaaaagagagggctgccctggctaggtggcccaaccttcatcccccttgacagcacccaagacagcacagtctctactccagtagccacccgagggtgagggcagaggtcaaagccacaagctacaccttggccagggccctgaggaaggtctgcataacttcccttgaaatcagaaacaggccaggtgagggagctcatgcctctgatcccaacactgcaacgctgcattgaactgtgatgcagcccaggtgccatctgtctttatgccatgcagcctggtggccgcacacatcctgaacagccctgatccttcttagggtcaggcagaagggacacccagcccactgcctctggagaagcggagctgagggttggggtagcaggcagttggaggagctccccaacccccacacccaattgaggctgtgcctccacagactgcagtctttgacctcacctgtcgcagggatagggctccctgccccaggttcccacattgccagctgagcacctgcttccagggcctcagccctccctgggttttggtgggggctctgggcacacatgggaggactacattcccccaggacattaagaatcagatgggcaccggggctcacacctgtaatcccagcactttgggaggccaaggcgggcgaatcacctgaggtcaggagttcaagaccagcctggccaacacggtgagacctcgtctctactaagaaataacaaaaattagcctggcgtagtggcagcgcctgtaatcccagctactcaggttgagacaggaaaatcgcttgaacccgcgaggcggaggttgcagtgaactgagatcacaccattgcactccggcctgggcaacaaaagtgaaactcaaaaaaaaaaaaaatcaccaggtctcagactcctgggagacagaccccagctccgacgttccagtgggatctcattaacccctgatactgaccttccaatttgatataccttccttttaaaatatatttattgaaatacaaagagtcaatataaagaaaaatagaggtcaccatacttggccacagttagaccgctcataggcccatggctgctgcaaccatgggcaggacacagagggagtccagcctctactgataaatctgggcaggttcaccttcgcaggccaagccaggggccatccctggtatgcgaaacctggaggttttccaggaagccggctgctccagagctagctgtcaagtctttagccccacaggctggtgcccagagccacttccacaggagcagcctcgggcttcacccacacccaaggagcttccgaggcaggaggcaagcaaggtgaagggagggttcagggtcccacaacagcagtgagcagggtccagccatcaggcctcagagcctctgtcatgccacctgcgagacgggctcctcctgtccccactgtgtccccgcttcctcctctta

SEQ ID NO: 14177 - DNA, 12725 bp, Human
ggaggtcgtctgatgtcccagacctgttataaatatgaaaaaaaaatttttgtgcatagttttaacaggtgttctgaagttccaggaacaaaatcaccttataaatcaaagatgactgtgtattgttctcttcagaatcacagcaagaattcagtttccagaaggaaaagctacagtagttgcttcatggacatggcttgcccttgaggttggtggtgtcagtgcatgagcagcctggtaagggtggttctctggccgccacccttggtcctctagcgtggttgtgaagtcactttcctttactccccattgcatcatagttgggacagagcagtggttctctgccgtcttgtgcgagtgctgggatgctgtctctacttccttttgggttgccagaggcagcatttagagcacagtgtgggcattatgttgtggaccaaggcagcctattgcaaggacctgatcgggcggcagccgtggggcagctctgagtagaacatcgggtcacctggctgactggtgtgctgagaacacgcaggaggaggctggagacggggttcttgcctggggaacaggagggaggctactcgcatcacagcggagaatgcctgttgggtttgggaggggggtttcggctgcaaagctggctgtcaaggggcaggaattgggaggagggtctaaagtcttgaagagaaatgtggggtcgttgtgtaggggccaccatcacctggagagcagggcagatgccagcgtgtgtgtgagaactaggtcacttgaagggaggtccccagagtgtccccggggtgtgcctttctctcacctaggtctggagtgcctccagaagcgaggatttcctgcaagggcggtggcctcccagggtctgtgggggggcatccccgtctctttacatgtctgactgaccagagtggggtggggtggcaaggtggtgctcgtcccaaagctgggggaaacctggtgatggttcccactcccattgttgcacttcgcttttgatttctctggaagagcaagtctttgtgtggtgtttcccctcagcctacatttttaaaatgaacgtttcttgaaggcagaaatcaagttttaggcattggctcaatcactggtgcagccattgcattaattttctttaacctggtgcggagaagctacaagggccccacccccttctagtggttggaggaaggagcaacttgctctcccagtttatgacagcaacaccagcagtgtgctgttccagttccccttttttttttcaagtggtgtagaaaggggccttcagggccctggatcccccagccccacacaatggtgggcctatgttcgtccagaacagtgcctggcagtagctcagtgcccagcatgtctgtggtgagtgtgtagttcaggaagtgaactggcaaaactgagtatcaccctctcttcctgggttcttgccactcccctgaaaaccagggtagcattgtcacatcagatagctccgctacgtgtgcgctgaccatgctgagatgggcactgtggactcagcctctggtcattgctggaaccagcggcctccatgtgaggtacaggggaacgcactgctagcagatggttgggatgtggacactcgtcctgccctcttggcttggtgctgtgccatcgcacagtcattcgctgtttagcatgcatgggagagagtgaagcacaagggcccaggcccctgggagtgcctgccctcaagttggaagagcccttgggcacagcataggcgcctggcagaattggactgggccatgatccagggcattgggacctcacctaggagttggggttctggtcagaagccctgtggagacagggtctcccctgtgggcaccaaactgacctcaaactgctggttctttggccctggggacggggctggttgaagtactctcccggcagctgtcacctgcagggagaggtgggggtaggggtgctgtgtttcttagctgttcctcgttgcagtgttaaatccctgcaggttccttattctcagcttgtgttgtgagtttcagtgttgggggctaatgtgggtttgcgtttttggtcttggttttcccagtggccagtccatcagccactgcactgggggccaggtagaggccaactgcaccctgcctgccagagtagaaatactggtaggccccaggctctgctgccccttccatgtccttgtgtaagcatccatggacaaagctgactcacggggtgtgcacagctgcagggaggccaggaaacaggggttttattctagagggccttgtgctcagtgacagaccagagtcccatcactgagagagcagggctggggcagcacaaaggactggagagcatttgccatgatgccatgtgcacagccagtgcaagtccttcattgtagctgtggtcagaggtcatgagacactgccttcagcagccctgggagtccacctggtgtgtggttagagctgtgcatctgcagatttcagaaggacttacgtttggtgaggtgctttgaagtaacacttcacaaataccaagaagcaagaaatacacaaataagcaggtaatggttctttggtgtttacattagctagtgggcaacggttctttggtgttcacattagctatagtcccagaactcagtccatgaggtggaatcacaaaaatggaattcatttctggctgtcagtacacaaactgatttaagatatcaccttgaattttaagctgacaaacagtgatctaaactgaatttcactgattgccccacctgaaagtcagacctgatagataatgccctcccttaactcaaggccagcagcagatgtgttagaggggacccttgtgcctcgcagccctcatctcctaatggctgtggggtcactgtgtcgagttgtaatgcctaatgagctcctctaaaaacatcctgaaacttgtgtaaaaaaaacagcagactcccagtggaactcgccttcagatgcagcccagaataagagttctagaatgtgtgtgccatccttttgtctcaatctgcatgattgcaagtctcttcaacatgattgggtgcgtggagtgtctcggtcatgtgtcttcccctctgagcatgccttttgattcgcacctgtgtcacaattgtgccagcctgtgagatgtgtctgcctgtcaccagtatcggcacatttagttttccctttacgtgagttttggtaaaatagtgacaaaatgtaatgcagtgctcagtcacagaaaaatgtcaggcctacagaaatggagcatttggctggcgggtagcgtgatgaccataggctttatttggctggtgtggtaaacaagcagcagcttgtgcaggtgagaataaatggccatattgcatttcattttaaggactcccttaaaatgaaaatcttcgtgtgggacatgaacacaggctttcacgaaattgatcatctacactatatgtatgactgttgaaaggctgttgttcctcagaaattcttaaaatgttatgtaatgtacatgagtcccttcaggaagtcatcagctttgttcagtttcctcagattagatagtaaaactgagattatgaactataaagatgtgtgtaatttatctgtcagtgaacttgactttaataaaagctttttgaaaaagaactctgggtggggtgcattggctcacacacatagtcccaactactgtggaggtcagggcaggaggatcactggagcccaagagttcaagatcagcctgggcaggatagcgagaccctgtctatagaaaatattaaaaatcagctaggcatggtggcttgcccttgcattccctgccacttgggaggctgaggtgggaggttcgcttgagcccaggagctcaaggctgcaatgggctgtgatcgaaccactgaattccaacctgggtgacagagtgaggccctgtctcaaaaagagaactctcgatgtcactggctttccatgtaagcagagcacatcatgtgagccccattcgtggatgtcagtcagcagaacagaatcttggacctggagcttgtttgtcctgtgctagaggttggaggtgtctctgtctttctgttggttcctgtcagttcaggtcacttagagattctgttacatacaccagctctgacaggttgggggagatgatcaaccttccgcctgcgcctgttcccttccctgactcatgccaaagtatccctgagatctgcaagggaccgaggacagtactggctggtggtctgggtacaggccacagaggcatctggaccccatgtgcatctggaccagtttggttggatccattcatggacacaaaacggatgtgaactcacagagctacattttctccctgcccctgttcaggcacagtgaggtgtcggggaatgtagctgccagagttgactgtcccgttctttggtgtaatgcctgaaggccacctttaccattggtctgtggtcctcactgaagaaagaaacattcttcctaaaagactttttttcctcagagttggagcccacagcgtggtcaggaaagagaagtagccactggtggctcctggcatcctcctgctgggcagccccttctcaaagtgtgaggggtccccttgtgtacaagcaggaaggctctgagaaagtcaggtttgctcctaccacaggataattccgatgaacctgaaaagcgggttttggcttgtgtgcagggactctggtggaagaaagggtgacagcacctggcctgggcatgacacaagttaggacccgtaccaagaggccctggaattgagggtgggggttgctgtggactctttctccctcttaggaaactctattgggtctccatctgtcacagaagcagtaaatgatgtaggggctgccaggtatagggtcctgtggggatgctggaacatgccgaggcaggacgtgccagccaccctctgcccatatgtgcagcagggccacagatgtgcttgtcggtaggagagaccaagctgtctgtgtgccgatgtcttgacacctgagacttcaggttcacccatcctggttctgccattccattgcagggtggcttccctcctttggggactcttaacgctttggtctgttaaaaaaaaaaaaaaaaatccgggcgtggtggctcactcctgtaatcccagcactttgggaggccgaggtgggctgatcatctgaggtcaggggttcgaggccagccctgaccaacatggtgaaaccccgtctctactaaaaataaaaataaaaattagctcagcgtggtggcacgcgcctgtagtcccagctactcgggaagctgaggcaagagaatctcgaacctgggaggcagaggttgcagtgagccgagatcgcacctgagaggttgcagtgagctgagatcaagccactgcactccagcctggatgacagagtgagactctgtctcaaaaaaaaaaaaaaaaaaaaaagccaccaatggggagggcctgggattactggcatcacaaaccccactgcctgcaggctgcatgatctcctgggcatggttggcggcactgccccgggcatgaggaggcagcaggcatgtgtggatcacggacagtgctggggtcgagggggttggtgacggtgtgacaccccttcccctgagtggctgggtgttactgtcaattctcccaagtgctgtgcttcagtggtcgtggcagtctggtgctgcctctgcccaactggcaggcgacccttattcctgagtccctgctgacttggtgtcctaggtttattcctcctagacttgttaacttgtacagttaacaagcctttgacaccacacaccctcgcctcagctttccaaccccctagtaataacaacatcaggactccctgagtatcctccaccatatgttttcctggagtaactcataaaaggccctcttttcgttccatttcatgcttgggtttttcatgcgaacctgtcattattagtttttccgcattgcctagagttgcccaaccccataataagaatacgtaggtggcgtgccccattcttgcaggtgtccacttcctgctccagtctgagggggttggctaggctgctgctctctctccatgtggggttggctaggctgctgctctctctccacgttgctgtgggctcgcatcctctccctggttccctgggggagcttcttagggagggagcatgtgagagatctgaggccctgcagtttgggagttattttcattctcccctaacacttgttggatactttggctgggtatagaattaaagggtttcgaaagcagtgtttcagagtcttccattctctggggcatcagaggtgtcatttgcccctgtgcattctggagtccaccttgcacctttattgggtctcatctaggtccttggctttgcgcttcagccctttgaggccgaagcccagattcctgggtccccactctggaacagggaaaaatttcaccccgtaatttcgtacgttctttctttttagggtttctgttggttgatatcttaagttactcctcatcttcctttttcattctgtttgtttttgttctgccttctgagcaccttcattttgaattttccttttcagctatttgtgtatctatcaggtttctctccttgtcctttgttaaaatagtcttctgtcttcagtctcctgtcttggttgcctccttgcagattccttttatatttgggtctcttatgttggtggcctttcaaaggcagacaggcctgtctcttggtggggggtgggggtgggcggagctccagttgcttgtgtgtggatctgctggggcatatagaactctcaggaattattctggaatttcatggctcaagtgtgttgtcatggctcagcgcaggcctaagccctgctgcagctgctcccctagaccaagcttgtccaacccttaggccgcatgtggcccaggatggctttgaacccgacccaacacaaatttctaataaaacattgagattttgggggtttttgttttggtttggttcaccagctgttgtgttagtatattttgtgtgtggtccaagacaattcttcttccattgtggcccagggtagccaagattggacattgctgccctaggcagtcccagcttcatcccttgggtcccaggcggtccagttttctctgcctggtcaatcatcacatccaaggtcttcctcccttttctctctgcccttcaaggcgtgtgtgtcattttggtgtcttcattggtagtggttgcaggagtggactgagagggcaggtattcagtctcttctgtgctccatgggtggtggtcttcctctgggcttagaaaacctggccgtccccaaaaagggaacactacagtgaaggtccttataaatttcagaactcatttaaatttcagaataggtgacatgttcaaaaccaagagcaaagtgtccaaaggacactgatccagcttgaaggggttctgtggctcatctgggatgatggcagtgttaaatcagacacgggcggccagttcacacccactgaaacacacaggcatgtgtgggctcttgctgatgttgagaaatggagaagaggcatttccttgccgtagcgtgctggggtgactggatgagagagtcaccagcggacagtcatggctgtgattcagccaaaagccacctgtgtgtggaacccctggtggaggaggtctgatgaggggtgggtgtgctcacaggctcctggcatgtcctcttgaaggcagaagccttcctcactcggggtaagccccgcttgcgggtgcagtgaagaagcagtcattgtttcagaaagtgaccagtgttttctaaagtccctgttcgggataaaatcacctgattcgtgaaattgcccactggccagtgaggccaaagcctaacaacttcagtgtcctcacagaggcgtctgggcagtggaggcccttcctgctggagtctccgcagggctctgatggtgggtgccagctgacttaattgctgtccccgatatttgtgttctgctgagggaacccctacccttgcggtgtggggcagacatggcgggcgtgccccatcgaggctgtgtcctcatgggagtgtgtccctgaaggtgtcctgctgagtctggcgtggccctgtgtgctctggtccttgtgagtgtgggcaggcacagtgagtggtgctctctggccctggaaggttctgtgttggggtgtagaggagccttgcacgcacctggaagccagtcctcaggcagccagcctcccctcctgcataggctgggatgaggcagcctttctggccatgcagctgtggggacagcttcccaagatgagggcaacagtttctcaattcctgactcagccattttccctcagcccccatcctgaggtggatttggggggcatgggaggcagggctctttccctgtttccctgcaggcttccaggaggtggggtgaggcagtggtgcatccctgggtgggtgggttctgagcaaccactgctgggcagcacagaaccagacatggagcaccttgtctctccaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggtgaggtgggggccagcagggagtgggctgggctgggctgggccaaggtacaaggcctcaccctgcatcccgcacccaggcttcaacgtggaaaccgtggagtacaagaacatcagcttcactgtgtgggacgtgggtggccaggacaagatccggcccctgtggcgccactacttccagaacacacaaggtaagtggctggggcctggtcccatgggcactcctgcttctagagagggggggccagcccatagatggggcatcgatgcccatagatgcggcaggggggctgtgttcccatgaccatttgacactggctgcccggcaggcctgatcttcgtggtggacagcaatgacagagagcgtgtgaacgaggcccgtgaggagctcatgaggatgctggccgaggacgagctccgggatgctgtcctcctggtgttcgccaacaagcaggtaggcgcccgggccagcctggggaatgtgaggagccagtgtgggttccgcctggtggtaggggttactggaggctggtggggcccctttctctgtcctgtggacagcccttcccaccaacccttccttcccccaggacctccccaacgccatgaatgcggccgagatcacagacaagctggggctgcactcactacgccacaggaactggtacattcaggccacctgcgccaccagcggcgacgggctctatgaaggactggactggctgtccaatcagctccggaaccagaagtgaacgcgacccccctccctctcactcctcttgccctctgctttactctcatgtggcaaacgtgcggctcgtggtgtgagtgccagaagctgcctccgtggtttggtcaccgtgtgcatcgcaccgtgctgtaaatgtggcagacgcagcctgcggccaggctttttatttaatgtaaatagtttttgtttccaatgaggcagtttctggtactcctatgcaatattactcagctttttttattgtaaaaagaaaaatcaactcactgttcagtgctgagaggggatgtaggcccatgggcacctggcctccaggagtcgctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatttcaccggctctccagtgcttccacacaggcatgctgcccccaggagatggtgggtgcatcagccagctttactctaggaagtacaggtgactgcctagggccgccacctcagtccacaccctccccatgttccctcctgagtgtgcaggcacttctctgtgtctgtgtgagaggctcttccagcatggttgcccacagtgaccttgatctcgtttgcagtcctgtcgggcccagccaatgagacctgggccatacagggcaggggtcagcaggcaccatggaagacctcagcctccgtccttccctccatcggcctgctgctgaaccccactttgtatagctggctatggggcagggccactgctagcatacatagggctttgtgccaaccagggaatggtccctgcctgagtgggcacagcccccacctctcctcaagatgccatgcagcagggggctgccagtctgggggtacctgtttctgggatggggccatcagcaggtctaaggtctgccttctgttgggcagagtcccaaaagagagggctgccctggctaggtggcccaaccttcatcccccttgacagcacccaagacagcacagtctctactccagtagccacccgagggtgagggcagaggtcaaagccacaagctacaccttggccagggccctgaggaaggtctgcataacttcccttgaaatcagaaacaggccaggtgagggagctcatgcctctgatcccaacactgcaacgctgcattgaactgtgatgcagcccaggtgccatctgtctttatgccatgcagcctggtggccgcacacatcctgaacagccctgatccttcttagggtcaggcagaagggacacccagcccactgcctctggagaagcggagctgagggttggggtagcaggcagttggaggagctccccaacccccacacccaattgaggctgtgcctccacagactgcagtctttgacctcacctgtcgcagggatagggctccctgccccaggttcccacattgccagctgagcacctgcttccagggcctcagccctccctgggttttggtgggggctctgggcacacatgggaggactacattcccccaggacattaagaatcagatgggcaccggggctcacacctgtaatcccagcactttgggaggccaaggcgggcgaatcacctgaggtcaggagttcaagaccagcctggccaacacggtgagacctcgtctctactaagaaataacaaaaattagcctggcgtagtggcagcgcctgtaatcccagctactcaggttgagacaggaaaatcgcttgaacccgcgaggcggaggttgcagtgaactgagatcacaccattgcactccggcctgggcaacaaaagtgaaactcaaaaaaaaaaaaaatcaccaggtctcagactcctgggagacagaccccagctccgacgttccagtgggatctcattaacccctgatactgaccttccaatttgatataccttccttttaaaatatatttattgaaatacaaagagtcaatataaagaaaaatagaggtcaccatacttggccacagttagaccgctcataggcccatggctgctgcaaccatgggcaggacacagagggagtccagcctctactgataaatctgggcaggttcaccttcgcaggccaagccaggggccatccctggtatgcgaaacctggaggttttccaggaagccggctgctccagagctagctgtcaagtctttagccccacaggctggtgcccagagccacttccacaggagcagcctcgggcttcacccacacccaaggagcttccgaggcaggaggcaagcaaggtgaagggagggttcagggtcccacaacagcagtgagcagggtccagccatcaggcctcagagcctctgtcatgccacctgcgagacgggctcctcctgtccccactgtgtccccgcttcctcctctta

SEQ ID NO: 14178 - DNA, 88268 bp, Human
  misc_feature (1)...(88268): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtctttttttccccctttatctgccagtttccaaagtgatgaggtagtcccttagcatccttcaaaggtgatcagtgaagtgtttttttgtttggttttgttttgagacagggtctcactctgttaccctggctggaatgtagtggtgtgattgtggctcactgcaactttgaactcctgggctcaagggatcctcttgcctcagccttccaagtagctgggactacaggcatacaccactatgccccgctaatttttttttttattttttgtagaggtggggtcttgcttgttgcttaggctgatctcaaagtcttggcctcaagcagtcctctcactttgttctcccaaagcgcggagattacaggcatgagccactgtgcctggccctgtttttttgttttttatttgaacatcattttgaactttcagatttaaatatataagatggcctttacttcatcacggtcattctttgtgatgtaaaaattgtcagaagatgggacagtttgaatatctttggtcagtaaggttagctcctaaatccttttgacatgacctcattgtagtctctgatagtttccttgctttctcatatggcaaagtgttccaggctcatcttgtacagttcctgctccagccttgggatcagtcatttttctaagaagccctaatttcattatttagtaaatggtacttagagaccacaatctaagctagagatgctatttatgcttatttagtctactaccattgtctctaggctttagttggtcagggctggggaatatatatttttcttatagatcaaatatatcaggaattcattggtcaccttcgaaggatgctaagggaccacctcagtacttccaattcagaaccacaagggttttttttggttttgttttgtttttgagacagagtcttgctctgttgcccagactggagtggagtggcatgatctgggctcactgtaacctccgcctactgggctcaagcaattctcccatctcagcctcccaagtagctgggactacaggcatgtgccatcatgcctggctaatttttttgtttgtttgtttgttttggtagagacagggtttcaccacgttgcccaggctggtctcaaactcctgtgctcaagtgatctgcccgcctcagcctcagcctcccaaagtgcaagggttacaggtttgagccaccatgcctggctagaaccacaagatttttacttaagttcaagaatcttatatctcacctaaggttgggagttcaagaccagcctggccaacatggtaaaaccctatctctactaaaaatacaaaaattagccaagcgtggtggcatgtgcccgtgataccacctactcgagaggctgggccaggagacttgcctgaacccaagaggcagaggttgcagctgagtcatgccactgcactccagcctgagcgacagagtgagactatctctcaaaaaaaaaaaaaaaaacttatatctgtgttttcccttaaccatgcccaaaatttctgttctcacgaaataattgctcatttgatttataccacaatatccatagaactgtctctgaatacaaaccaaaagtaccaccaatatgatttctgaaaaatgcttaatattttttggttttgcagctcttttattccttagggtatatcttactactgatgtaagggcaaattactgtgttttaaaatcatttggtttagttctttttggtatgactcaaattatttttataaagcatatttaaaggaaaactagtatacttaaaatgcattttgatattttcacattttgaattcttcagtttcaccagattgcaaaattggactatctaatacaattttacagttcacaaagtaaatgtatgcttttttgtttgctaggcgctaatgtgcatgctacaacagcaacaggagacacagccttaacctatgcttgtgaaaatggacatacggatgttgcagatgttttacttcaagcaggggctgatttagtaagatatttttaatttcaaatatttttgcgttaatgttaatatccatttatacttaacatttagaaaacactaaagatcaatggtttgcgtactttgtatacagtaacttaaaaaagcttggctacctgttctagttgttgtatgtattaaatgtatttgaaaatacttagtgttgaacagggcatactgtttcttttcctaggtaaaactactagtttgtttcttcctttcactccacccccatttgacattcctgtgctttttaaactgccatctgttagatatatcataaattcaatgatgtgttcacagaatagagtaacaagtcaagtcactttgagtgatttattattattttaattgacacatgataattgaacatattaatggggtacagagtgatatttcaatacatgtatataatgtgtaattatcaaatcagagtaattagtacatccatcatcattttgaatgatttctgttgtttctctgattagacatttcaaaacaaagctactattgttaatcatccttctagtacattcctacaaattctattctttttgtgttttctgttttggtttttcagaatttcaaattaggtggcaggttcatatgtgtaataatctatataaaaataatattccatttaaatgttcatgcctcttgctgaaatgtgtgctttgcctagcttttattttgtgagagtgctttaaactgcttcctagagtttttcccagaattctctgatacatttcttaaaaacttatgtgtgacatacatagctgtaaatgttatagagaattagatttcttagttttgcttatttagaaaaaactatgcaagtattaccttttaaatcatccaagtagatacctgagaacattattggaaaataattattaaccaaaataaatgtgtagtatgattgttatttattatcatttctactaatacaaaatattgtaatgaaaacactatcattcattcttattaattaggaccttccctatcagttataatttttgggaggtatgcttttttgtctgagaattgtgacagcaatatatgttaagtacatcttagtcttttgacttctttctatatctttttccttttatagagttgctttgagtcgtctataaaaattaggaattgaagtttgtcattcaaaataaagaaatagagtagaacttaaaagcttagataatataagcaaaatttaatactcttatcctctaaattcttacctggattctctcttcattgtattttctacaacaaagtcactgtcttaacctgttgggagttcttctaaaaaattgaatagggctgggtgcagtggctcatgcctgtaatcccagcactttgggatgccgaggtgggtggatcacctgaggtcaggtgttaaagaccagccggactaacatggtgaaaccctgtctctaccaaatacaaaaagttagctgggtgtggtggcacatgcctgtaatcccagctacttgggaggctgaggcagaagaatcagttgaacccaggaggtggaggttgcagtgagcctagattgcgccattgcactccagcctgggcaacaagagcaaaaacgccatctcaaaaaaaaaaaaagaaaaaaattaaataggataaaagaggagctatctggtaaatgtactctaatgtataacaaaaccatactgattgtgaccaagttaatatctgttacatttttaaatattttatttttactgtcttctggaattagttaaaatagagtgtttattatttagttccttagaagaactacattaattgaacagatagagctatttgaacttaccgtatttacttactttcaaaatgtaagattaaaaatggcccagataggccaggcgcagtggctcacgcatgtaatcccagcactttgggagaccgaggcggacggaccacctgaggtcaggaattcgagaccagcctggccaacatggtgaaacctgtttgtactaaaaatacaaaaaaattagccgggcatggtggcgggcccctgtaatcccagatacttgggagaatcacttgaactcaggaggcggaggttgcagtgagctgagatagtgccattgcactccagcctgggcaacaagagtgaaactccatctgggagaaaaaaaaaaaaggctcagataaatacatatcttaattattcaatacagaagtaatgccattgttctaacataattattcatttttatcttgcaatctatttttacattcatatttacatgaaattatagacacaatatataatacagttgttttctattttttcactatgtgttcttgtgttctatcataatctttaccatattactatatagtctctataactcttgcatcatattccatcaagttgatgaaccatactcgttcattaattatggaacttttgcttttcatttttcactattacaaatactgttagatttaataactctatatgtataactttttaccttttcttattttgaattattttatatattgattttaagttttaaaaatgtatagcctcttccatgcttttgctatttgtggactgatatcttaattttaatattatttcttttcctcattataaaaagcaatactgttcttcatataaaatgtggaaatgctgggcttgtagtcctagctaccaaggaggcagaggtgtgaggattgcatgagcccaggagttaaaggctgcagtgcacaatgagcatgcctgtgaacagccattgtatgctagcctgggcaacatagtgagacccttctcttaaaataattttttaggagaaaaagaaaatgtggaaagtatgggaaagtataataacttttatatttaaaacctatgaatatttgtgagtaaaatttgtgacagtgaaaaaaatataaaacctatgaataaattttatttcaggctttattgtaggccagaggaaagaaaaagttctagtcaaaaacagggaaacctcagagtaaagcaggcagattagtccctgagtcctgggaaaaagtgactggtaattcttatcaactttatcttacaaggcagtaccatcttacttgtccttcattctttgctgctgtcttctaatatctgttttgggctataataatttcctccagcagtttgcagatagaggactgtccatcccccattgcatgcagtggagatgtatttcattcctggcatctcatagatatgttctcagtttaaggtttaagtgtactaattctttttttttttttttttttttttttttttgatgtggggtctggctctgttacccagggtggaatgcagtggcacgatctcggctcactgcaaccttctcctcctgggttcaaatgattctccttccttagcctcccgagtagctagaattacaggtatgtgctaaaatccagcctgggtgacagggcaagactccgtctcaaaaaaaaaacaaaaaaaaacaaaaaaacaaaaacgtagtttatcactgacttacctctgtaaccataaagtaagccctctgacctttgttgctttctttggactgtattctgctgactgagtgaactatattgggcattttccaaaaatagttgagcaattggaaactaggtaatttagacatgggtacattagtactctgtagttcttcttcctggaacttatttccttttaaatgagatttgatatggacctcccttaatagaaagaaaaatatcttatggatcagtttattatctgtattaaatcttataaatagaaaacatagacccaagtcctcttttataagattttttaaaaaatttaaacaatatattgtgtatctctctagacatttctgtatacccaaaatatgtacatttaatatatgtgatataacatctttccgtgttccagtagatttcccattctttttcacaggtacccagtgttctgtataatttattaaccatttatctacgcataaacacctgagttaatagtttttaaatattacaaatggtgctgcagtaaatattgctaggcatatttatgtatctttgctacttttgtgaatatatataatagggataaattcctggaagtgaaattgctggttatagggaaatatttgactaaaattttattgtttcgggaggtccacatctgaaattttgataactattgtcaaactgttcaaaaatcctgaaccagtgtacatctctgttaacagttgatccctcctgactctcccacattctcacaaatataaactgatttcttctttctcccctccttccttccctcccttctctccttctctcccaccctccttccttcttcttccttttttaaacagtttaattttctaatttctgatcacagcccctatgtttgcattatctacaaaaatcttcttgcctggcacagtagctcaagtctttaatcccagctctttgggaggccaaggagggcagattgcttgagcccaggagttcaaaccagcctgggcaacgtggtgaaaacctgtctctaccaaaaaaaaaaaaaaaaaaaaaattagccgggttggttgtgcgtgtctgtagtcccagctactcaggaggctgaggtggattgcttgagcccaggaagcggaggttgtagtaagctgagattgcatcactgcactccagccggggcaatagagggagaccctatctcaaaaacaaacaaacaaacaaaaaaaacttactgtgctacaattagccctattaattgctcccaaagttttagcgaactatagaaaacacaggaataaaattactttctggaagtatgtgaagacaccatttacaaatagatttttaaaaatcagatatttattcagtatctattgacttcattctgaaggacaaggagagtaatatatctttcaccatagaattttcatgagttattttaatattctcctggttatacatttacattctgatttaggaccctatttctcatagttatttaaatatatatatatgtgtatatatgtatatataatatttaagtggattcagtttttacattactagtctttcttattatatagcttcatgattcctgaattcctcaacttgacttatctgttggctggctagtactggtattttgatttgaatttattctccccctcaaaaaaggagttaataggtgcttgcatattttagaataccatatgttgtatttataaatgaatgtagccatgtatgaaattattgaatcacttgttctttcccctcaaaattttaaacccactatattagtgtcttctggtactgaatattgccaaagcctgctagactattctgtattatatgtaagtgtctcctttttctgtctggattatcataaaattctttcattatacttaaacatctgatttcatcaggatgtatcttgtgttaattattctattaattttcctgagaaacagtgaatactttctgtctgaagactttaataagtcatagtctttaataagttgtcatagtatttaatttttaaaattttttttttttttagtggtgaccgtggggtgatattttcttttttttaaaggaaggtttctttctgctatgtttttgactatttatttttctattctgttaacgtccttcaagatatttaccattcatatgtatggtctccctcatctcgcttgtttgtatttgtattatgtttatgtctaatacatttctttgtccttttcttctgcattgtgtcttaagtctgtcatccaggtcactatttttttctgtatacttgtttctgctttttttttttttttttttttttcttaaaagggacagggtcttgctttatctcccaggctggagtacagtggcatgatcacaacttaatacagccttgacctctcagtctcaagcaatcctccacttcagcctcctgagtagttggaactacgggcacacactgccacaccagctaattttttatttttattttttgtagagacggggtttcatcatgttgcccaggctagtcctgaaccgctgggctcaagcgatctacccaccttagcttcccaagttactgggattacaagtatgagccaccatgactggcctgtttctacttctaaatgtggttttcatggcttcactgttactgctcccttatctgcaaagcttgggaccagaagtgttttggatattttttttggattttggaatatttgcagaatacatacccattgagcatccctaatctgaaaatccaaaatctgaaatgctccatgagcatttcttttgagtgtcatgtcagtaatcaaaaagtttcagattttggagcatttcagatttcaggtttttagattagtgatgctcaatctgtatttagtttcttctattcttccaattcactttccagtcttttgttttatcactttgttcagctatttaagtaaagattccctgttctcttcaatttatttgaaggtattggggaatatttgactaaaattttattgtttgttttgtaggaacttcttgataggttccatgttggatactttgtgcttattattcgtattttaatgggactggctatttattgaaatagggggtgaaataggggtaaggtggcagggaagaggaagtgagccttaacagttagcttcttaaaatcatgtagttgtctcaggatactgtcttgctgaatctataccataggagcatgcactttcttaggataagcacatcacataggtaggaaattggaatgacttagagtgaagccttctctaggccacatttcctttatttggagatttagttgactctggtcaatgactgaaaagcttcttatggtttcctaagttgtatccctgtctcacctttagatagtttctctctgttaagagtctagatctagagaaaatacaaacattccatttctcaagttctttgaaggttcttgttttagttgaaaagtggaagccttaagtacatttataatgaggggaaaagctatgtaactatttatcttacagtattttcctccgtcctcccaacttctgatatgcccaaatctcttgatttcattattttctttggttagatatttttaaatgttgctctgtttttgtggctttgttttttgagacaaaggcatgaatttaaataattctgcagaaatatttctacatatattaagatttatattgaagttttattggtaaaaaaccataatatcacccccttaaaaaaatttatactctgctcatgacattacagtctctacagatgagaatctttttagttgaagatcctgagttaacaaagcccaccatctgaagtatcggtcacaaggtcttcatggccaaatgtgattttcgtttttggaataagatccgtgagttcttctttttcctttcgcaggacaagcaggaggacatgaagactattttggagggcatagatccggccaagcatcaggtgagggtggcctttgatgcttgtaagctactacgtaaagaatagatgttgtaggtaaccagaactctggatatctgaattccagccaagaagttccaggaccctgctgggtgacaaaggaaatcctcttcaattgaaaaagattatgaagtcccaataaaaagagatttgtattgctggtagtttgtttccttagtcttctttctcagtgatattcctaaaaaaatctcttaggtgaaaatagattttcttattcaggtagttcttttacattctcctttattgggagagttagtataccgcagagagaaagtctcagtaataaagtcctttgcattcaactttgttcatcaaaaatctgaaactcagagtgatattaatatattggattgttttaaaaataatactcaaataaacaaaaaaattagtttagcaaaacgtttactatatagtttatgccctaatttctataaactagaagtttaaaattttcttcttaaaattgtctcctactattctgaaattggtttttaagaaggtgaatattttttcataggaaatatttcttttgaaaaaatgtgtgaatttgtgcccagtggttttaaaagtcaaataaatttaatatccattataatccaaagagatttatttaaaatcaggagcagtttttaattttaaaattattaatgaattgtgattagatcacaaataacttaggccatctaagtttcttttttttttttttttgagacagagtctcgccctgttgcccaggctggagtgcagtggtgctgcaatcttggctccctgcagcctctgcctcctgggttcaagcgattatcctgccccagcctcccaagtaactgggattacaggcgcgtgccaccgtgcctacctaattttttgcatctttagtagagacggggtttcaccatgttggctgggctggtctcgaactcctgaccttgtgatctacccgcctcggcctcctaaagtgctgggattacaggcgtgagtcaccgtgcctggcctaagtttcttaattctaaacccctcttaatcatgatgcttattaagtgtcttcatcattggcttgttaaatgagaagctgttttatttattctgttgagatttttaaaaattttttaaattttttttttttgagacagggtctcactctgttgctcaggctggaatgcagtggtgtgctcttggctcactgcagccttcccatcccaggctcaagtgatcttcctgcctcagcctccccagtagctgggactagaggcatgtgccaccatgcccaactaatttttttcatttttatagagatgaggtctcactgtactgtccaggctggatatatttattctactttgaagtaagtaagtttattttacaaaatgtgatgtgaacatgtgagcttctactcagtttgtataatattataggctcctatcaagaatgtaaagctgagtgttatttcagatcaaagtaattgtttttccctggatttgttagatgaaatgtaattgtaaatctttctctctagctgcaagtctcaaaacaggatttttttaaaaatgagttttgcagccccacgtttacaggttcagattccatagatctgaaatagggggtctgcatttgaactaatatctcaggagattctgatgacaagttctccatattttacactttgagacattggtagaggccatacagattattctgcatcattgctgagttcttttctttttccatctttgctttataatcgatcatttttcctccatccaaattgaataaacttggtttttctctctgttacttgtgatttttagaaaatgtgctaaacacaagccttaggaccagtgcctcttaaccttttatccatatcagttctcctgaggggtatgaatccaatcagtaatagtagatcactaaggtaatgattaatatacagtggtgggttgaaggaacatactccccatggaagagtattggaatcctctagtacgtacagtatcaaacagtctccctccttttctctgtgattttggtctttctccttagagaatgtcctccctccaactccaaaagacattgcctctgtggtatagttacagtccttaaatatatgtcttgggtgccctgtggctgtgattttttaagggaaattaacttattttaaataaaataaacttaatttaaaataaaattttgttatctaaagccaaatagaaaaaattccacattttttcttacagtgctcattcatcagaaccttttttttttcttctttttttttttttttttggagatggtctcactttgtcgctcaggctagagtacaaaagcgtgattatagctcactgcagctttgaactcctgggctcatggcatcccctttcctcagcctcctgagtagctaggactacaggtatgcaccacaatgcctggctaatttttaaattttttttcagagacaaagtcttgctatcttgcccagacttgtagtgtattttttatagatatatttttagggagcttatgagctctagtaatctacttatcaatgtatttcaactgttagtaattaccttaccttaataaactttaaatgtgaccttaccttccactttttaacttttttattaaggaatagcgtatatacatatttttaactttactacttaaaactaggaaacttctgtcaatttcttaaaaatctaaaactacctatggaatacacaaaactcctaatacatttcttttaaagccaagttctctctttctatgttattgtgtattgaatgagttcttttcagctctctccaggttgtttaaatataagtacaaatgacttcagtcaagaaggtaaagtcattattagtatatagaaaaatgaatctaaaaatatgtagtcgtgccccaaaacaacaggattaaagatctccgtggactagaagtgcagcatggatccacagtttaagctgtagtcccaaggagaattaagggctaaaaaaatacacaatgggggctgagatttcagcatgtgcagaggaatagggaatgaatgcatttcacatgtagtacatcagtagatctagtctacttgaataaagcaaggaaccggcatcttattgccctacctgtgaaccaaaatggataaaaaaatatttgatcaactatctagggttatggttagaaattagcaaattgtcatatccaggttgtatgtaaaaaacaaaacaaaacaaacccaaaaaaactaaaaaaaaaggggggaaaaattagcaaattgtcgttaatggaagaaacagagacaactgtgtaactaaaaacttggaggacaaccttcttgatttagggaacagaagtgaaatatctctatgagacaagaaccttaggtgtccagcaaaatatctacttctgaaatggactccaagagccagactgagggaacttccaaaacatctgatgaggagtacatctgtggatggaaaagaaactaaaacaaaacacctcccatcaaaatgagtttcctcagtaaaaaaattataaagctggagagcgaatctttatcaagaaagatagtcaaaatgtaaacaaacaaaaagcaaaatataatacactcaaggaaattgaaataaactttaatcttgagaattatgaacatgtttattttaaactatgaccagtagccataaaacaatgtgagataataaagcaaaagctgataattacgtattaagaacaggtggatataaaataaaactaaaagttttggggggtaacctcaatatatagggtaagacagcatattagacacagttgaatgcattagtgaatgagtgataaaacaagaaataatacaataaaatatataatgaaatatagtaaagagatagaaaatatgaaaaagaaattgagagaaagagaatagattagaagctccaccatattatctactagaagttcctgaaggagaggatagaaatggaggggagaggaaatgtttgaagagaatggtggagaattttctagcattgtgactagacatgaatccttgactgaagaatcatatccatcactaagcagaacagatgaaactgtggaactttaaggataatgaaaaatgtcttaaaagctatcagaggaaaaaaacgcattacctacaaaaaaacaaccatcaaagttttgaccttctcatcagcaataataaattacagaagatgatgggaagtaatatcctcaaaataccaagataaaataacaatacagaattctgtacttaagtaccattctagagaaggaaaaaataaacatattttcaaatctacaaagaataaacgaattaccatcattagacccttgacaaaagaactactaaaagatatatacatcagtaagaagaaaagtgagtcctggaggaaggcgtgggatacaagaaactacggtaagcaaagaaattgataaaacatattataaatacaaatgtttgagtttaaaaacctaaattttaatgtttaaaaccaaagtagtactaaaattctagaaaacaatagcaggaaatcagaaggatgtgttagagagtttaaaagccacgctagagtcttttgttgttgttcaggaggagaaggtactgaataaagtttttttttaaagaaaaatagaatcgtaatcagaacaaatataaagctattacactcaattgttaaagggcagagacttctgaattagagtcagaatcaaaatgtaacaaatgctgtttgcaggagacaaacctaaagcaaagtgatgaggaaagcttgacagtgatgggaaaaaattatgtaaagcaatattaatatcagacaaaatggaattttaagccaaaagcacttttagaaatgaatactcctccaactgagaaaataattaccaatcagtaactaacaatctaccatccaaataaaatataaaactgcaaaattgcaagagaaatggtcagatctgcatttgtagtggtaggatttttttcacacacttctcaatgaaactgatgaatcaaacataaaatgattgttaaaaatcaaacaattttttatctttcataaagctagcattctgtttccagtaaatatactttatattcttttccaatacatggaatatttataaaaattgtccatgttttaggccacagagaagtccgaagaaactcctgaatcttcatcacatggactacattctctgatctctcttgccttaaaattacacatcaacaataaagtcttctttaattccatacatttagaaattgaaggaaaatactttttctttttgttttgagacggagtctcactctgtcaccaggctggagtgcagtggtgccatcttagctcactgcaacctccacccaccgggttcaagaaattctcctgcctcagcctcccaagtagctgggattacaggcacctgcctccgcgcctgggtaatttttgtatttttagtagagatggggtttcaccatgttgggcaggctggtcttgaactcgtgaccttgtgatccacccgcctcggcctcccaaagtgctgggattacaggcatgagccgccgcgccaagccaggaaaatacttttataaaattcatggggttaagaggcaatacagtaaaaattacacggtagaaactgagttaccagtgcacaccaaaacttgggtagggagaatatacctaaagttgtccttagaaggaaaattgtagttctgtatatcaacatattaaagatgaaaataaaatttaaaacaatagcacaaaggaagaagaaaataataaaagcaggagaacaccttgttctatcatatatggtattctgtggtacatgatattctatggtatagaatgagatgttgcccaaatgtagggaaaaaatataaaagcaaaagttaacacaatagaaaataattttaaaaagagatacaaaaaatatagggatgaagagtgaaattaaaagctggtttttaaaaaaagactaccaaaacagataaaacaagcaagcaaggcttttctttctttttctttttttttttttttaggggaaaaggcacagataacaataaacttaaaagtgaattgtaattattttataagtagagatcttaaaattcaatcaataaatgtgaatgctcaggtgaaatgaatactaatttttgctagaaatatataaattatcaaaattgactctagaataggaaaccatgtattacaaattgaatcagtagtttacccatatatagaaggtaaaggttcaaatggatttatgggtgaattttaccaaatgttcagggtttttgggtttttttgtttgtttgtttttgagacagaatttcgctcttgttgcccaggctggagtgcaatggtgcagtcttggctcactgcaacattcacctccaaggttcaagcgattctcctgcctcagcctcccgagtagctgggattacaggcatgcaccaccttgcccagctaattttgtatttttagtagagatagggtttctccatgttggtcaggctggtctggaactcctgacctcaggtgatccgcctgcctcggcctcctaaagtgctgggattaaaggcatgagccactgagcctggccaagaaatagatactttctttctttatttttattttatttattttttttaatttttatttatttatttatttatttttaagatggagtcttgctctgtcacccaggctggagtgcagtggcacgatcttggctcgctgcaagctccgccttctgggttcatgccattctcctgcctcagcctcctgagtaatgggactacaggcacccgccaccacgcccggctaattttgtttttttttgtattttacggggtttcaccatgttagcttggatggtctcaatctcctgacctcatgatcccccccgcctcggcctcccaaagtgctgggattacaggcattagccaccatgcccagccgaaatggatgctttctatattattctagctgttctcaagaacagaaaaagaaacattaaactgcatgatatttaagtttgtagccttggaaaataattttctgcgtttatgaagggaaaaaaatcagaaacaatttgtatcctaaaattttattagtattgaacaaatagtggctatatgactaaatccaatgctcataagtagtacgatgtatacaaatttgattaccattatatacatatatgcattgattcccatgatatgcacacatatatgtatatacatacattatacatatatattcccattattgattcccattatatacatatatgtgttcccattatatgtatgtattcctgttatacatgtatattcccattatatacatacatatgtatatatacattgattcccattatatacatacataggtatatatatacttatatatatacctatgtatgtatatgcgtatatatgtgtgtgtgtatataatgggaatcaatgggaatatatgtgtgtaatgtatatatgtatgtatataatgggaaccaataatgggaatatatatgtataatgtatgtatataatgggaatcaatgtactcctatatatatacatacatatatatgtatataatggggattttccatatatacatatatagatatattattatttttttcttttttctgcttcttgcacagcagggctaacccatagggagtgtgcccacagtagcctgattcccattttaaaagaaagatttagtagtcagatattttggggcaaatattgtgtgttgtgggatatacattattcattttaagacacaaaatgttgtaatacagagttgtggcattgttttatcaacttttttcaaatgtgattatgttattcaaaactaagggaatgaatgtatatttatagagaggaaaataaaataggtagcttttcaccccttttatttcaggaattaatatgttgaattttgaaatgacttggtgtgaggatattgggactgtactttctgatttcttgtcttttaacaactatggtaatattttaaatatacagaattaacagttattttttaaagtttattctaaatcagggctgaaagctttgaaatcatttttcatgatttcatttgaaatgtctttgccatgactcacgggacctaattatgttgatatgacctaattatgttgatcactgccaggcttaagaaataagaaagagaaaagggtaaagtaaggataagtgacattaatattgcccaactatgttctaataataacatatcagttgcagataatcaatgtcttactctcgggcttaactactactcttaatttcttgtttagttgactttcctttctcttatttacctagtagaaaataataaaaacttcaaacctcagtgctatgagagggaagatttgcaagttcagttatgcttggtttcctgcatgattaaacaatatttaatcactccattgtttaagcattatgtgtacagtggcaagcaaaaaaagacaagatcattcctctcatggagcttaccgtttagtggaggagacaggttagttaaatataatacttacacagactaaaatatgattgcagtttatgaaggagagcttcatagagatgtatgtccataataggaagagtgatttagtcaggaagttcagggaggtcttccttgaggaaataacacttgacttgagatgtaaaggatgaaaatgagttagtggaggaaaagcattaaaaagaagagagaccagtatgtgcaaaaaagttgtgaggcaggaagggaaaaaacaagttgctaaatgggcaatttatttccaggatgtagttgattgtaatgataattcagaaataagttggatagaaaaactggacaaacaactttctaggtctttccaagtaaggtctttgtgatacatattcagttttatttgaagtaaattgccagaatgttagatttacctaaatttgaatgtgagttcaagatctattctaaagccaaattattttggcattatctatagttattcatttttccataatctagagttaaaagattcttatttaattaacatgtataacaattaaaaagtcaaagcataaagtagtttttaaagtaggtttaatgatactacactgtcaagatttttttttaaacctattttagggaggaattcctatcacttttctgtgaggtttccattgagttgacagtctactcatttcttattgttgttttgcctgagttgtagatcagaataattaaaatgtaaatagactaaattgtattctattgggagagcacatattttaaattgatcatgtggtaattataggattttcagagttaattagaagaatatagctgaaataaagccttaacgtaaccaccagtctttatcagttttttcttagtaataaaagagaaccagaacaacagaaattcgtgtttgcatatataatgaaagaggggataggtaagagaacttttcaaagaagcagtatataagctacattttaatacttagatgaatttaatgagttcataattcttccaacagacagtattactcaccatataagcaagctccttttagtggcatttgatgtgaggcatgcatggttaaaaactgttttatcattcattcctcttgctggcaaacttcctagaaagaacaatctttctgctattaggagttgtatcttttgcctttgactattcaagtatttaatttctacttaaaaaaaaactacccattggtatatttttcttcttcatttttccgttactcctaaaataccatagtgtttttcttcagggaatcatttgcatcctttgatagtgcttttattggcttctgctataagatcaagattcttctaatcatttcacaggactgaggttcctttttcacaatccagataaatagttgggaaacattttttaaaacttagaattagaaaaatgcagtgatttctctttgggaaccaaacaaaacattaatattatctttaatggttattacttggtatgcaaaactgaacttgcccttagaaagttacattatctactttggactgaaaatcctgtataatgggggaattgaggtaggtggtataaagtgtctacaatgagtaagtatattaaatcctcgttatttctcatttcatcagtactgtttttaaaatagatggttagactgttggcattgatggattattttttccatttctttaacaggaacatgaatctgaaggtggaagaacacctttgatgaaagctgcaagagctggtcatttgtgcactgtgcagtttcttattagcaaaggtaaagaaagggcaagtgatcatttccaagaggctacagtttatggaaaaaaaaatcctaaactgttgcaatttatgttatggctactttacctacagtaaagtattgtattcttgccttttgttattatattttatttagtaagcatagagtttgtgagttgtttactgggaattttctttattagttttgaattttaagttttcatcaacaaagcaacatgtggttgctcccaacttagaaaagccaaatgtaaaatgtcccactatgattaggtggatatgcaacagctaatgatgagtctattctgctggagatgtgggtggaggacagagagtaagtctgctactgtggtacttgtttgtggtacagttgaattaactgagtttgtaagggtcttatttataatttttatatgtctttagaaattctattattagaattatatttaggcaagaaatttcaactggtgaatgaagaattagcttaagactgtttactgcagtaaaataaaatgctgtggaaccaatgttaggtttaaccgtatataattgtcatgttatgaatcaaaaatggtaatgtcagcagtttcatttggttcagcctaactctttgtatagtgtcagaaatactgtggcatataatgaaacatcctaggataggatggtcaaaatacaaggaagattctctcaggttgtgttatgttattaagataaaaactatatttatattttaatagatttctgacatttagtgacattaaaaatgcagggtaagattttatcttttttttttttttttttttttgagaaggagtttcactctttttacctaggctggagtgcaatggcgccaacttggcttactgcaacctccgcctcccgggttcaagtgattctcttgcctcagcctcccgactagctgggattacaggcatgcaccaccatgcacggctaattttgtatttttagtagagacagggttttaccatggtttgccaggctggtctcaaactcctgacctcaggtgatctgcccgcctcggcctcccaaagtgctgggattacaggcatgagccactgcacctggccagattttatccttttaaatgtacttgttttcctctgaattggataaaactaggtttattttcttcatattgcatttttgctgccaagtaaggcatatctttacataatatagtctgtaaaagctgtttacctcaaccacacagaaataaatagatggataaactctggagttctcttatgtttctttactaaagagaatacctaatcatacccaacaacaacctgctaagaatataatcaggcttatcaggaataggaacacattgattatatcctttctatgtcaaataatcctgtcatctaaaataatttcatgttgctaatctcaggatgtttattgctgcgttttacctttcccaaaaggtacttttatgcaagttaggattagattcagctggatattttctgaaaattagacaaactaatagtagtggttttacccactgacttatttttctcttaaataagataggtagaattaagaaggaagaatgaatatttctatagtcttaactttctagttgagatcttttggaattgttaaaggtagctgaactaaagttattttttccaggggtcaaaaataatttatcaaaaaagaaactaagaaaagactttgcatttagacatttttcaggtcatgttatacacagctattgaacaacttgcctttcagataacatatctggataatattctgtcttctctccatatctaggtcccctgactcttaaaatacacaatatgaagaattatatatctcttaaacattgcttaaaaaaatctgttttctttactttgagacctggctatattgccactttctagtagatcaaaaatgtctttgaaacattttgagttatatacagtggtgttatttgatgcttacattaacctgtatatatttattaatcttagtcttctagattttccattttaaaagtgatattgaatgaacgaactacagcttcatgcaacattgtggatgaatctcacaaatataatattgagtgaaagaagccagacgcaaaagagtacattgtatgattccgttcatataaagttcaaaaactaaaaccagtttggaagtcagggtagtggttaccattgggaggctgggtagtgactgaaagggagcacaagatggggcttttggtatgtggataatgttctgtttcttcctctgggtgctggttacacaggtgtgtgttcattttgtgaaaaaaattcaaactatacacttaatgatttgtatatttttttgtatctacattatacttcacaaaaaatttttaaatgatattgactatgaactagcttgatgtcaacctttgctaagattgcgatttatttttcttcaaaggtgccaatgttaacagggctacagccaataatgatcatacagtagtgtcgctggcatgtgcaggaggccacctggcagttgttgagcttctcttggctcatggggctgaccctactcatcgactcaaggtagtctacttaaaaataagtaaacaggctgtgtgcggtggctcatgtctatgatcccagcactttagaaagctgaggcgggtggatcacttgagcccaggagtttgagactagtctaggcaacataaggagaccccatctctattaaacacacacacacacacacacacacacacacacacacacacacacgtatgtatgtgtatatatatataaataatatgtgtatagttataaaaatatgtttgatctatcttagtgcttagtatttaatactgtttaaatgagttttgattttatatgagctgctaagaaactataaagaattaattatcatggcaattctttttcaggatggttcaacaatgctcattgaagctgcaaagggtggccatactaatgtagtttcttatctgttggattatccaaataatgttctgtcagttcccaccacagatgtgtctcagctccctccaccttctcaagatcagtctcaggtaaagtaaaatggagcttgtttgttaatataaatattcttcaacatgattagaagtttttgtttaaaatcagttttaagcaaaatggacttgtttttattctctgttacatattgagaaaatcatgactctaaattctttaggatttattttctttaaaggtacactgaaatttgttattgccttatttattgagaatagtggtttttaaaaaccacttaatatcaaatataaacgtaagtattctaagttgttatcttattacaactaggtttttcagggttttttatttgttttttaacaagagaatcaagagaaagctttttcttttttcttttgtttttttttttgagatggagtcttgctctgttgcccaggctggagtgcagtggcacaatctcagctcaccgcaacctccgcctcccaggctcaagcgattctcttgccttagtctcccaagtagctgggactataggtgtgcgccaccacgcccagctaattttttgtattttagtggagatggagtttcaccatgttgcccagggtggtctcaaactcctgagctcaggcgatctacctgcctcggcctcccaaagtgctggaattacaggcgtgagccacatgcccggccgagaaagcattttcttaatacctcccaaggtagtattaattatcctagagatagtgacttttgtcaaccatgaaagtataggtaacataagcgctagaagttcattaaagtaacttttaaacccaccttaaattatggagcttttactagtatattaagttggtgaaatctaaattcttttctacaaagtcattctgaaaactgctagcataccccaattgaagaaatatattacatttttgttttcttttgatccatgtagaatttgaacaagggtaaattggctagtggatagtgaatatgtgacttgtacccctagctacaattggaaccagcaaggcgttctattcagcaagggagtaatgttatttccatttagcttaaaatcattgactatttgtagattccccgactgtctaatcattagtctcaaaaattattgcttggtgaaagctttttttaaaaaaagcttcaggaaacaaaagtgcatttggtggtatatgaagataacctaaaacaggatatctgtttcatttatgggcctttgtcttattctttggtctgagatgatttttttctgagttgactttttaggtgccacgtgtgccaacgcatacacttgccatggttgtacctccccaggaacctgacagaacttcacaggagaactctcctgcccttttaggagtgcaaaaaggttagttattgaattatttttcttaaaatgggtattttttcacctaattgataaatccagaaatgtactttaatgatacagagttactgtgtacccatggctaattgaggtagataattctgacaaatgcaaatagtcttactatctaaaaccaaaaagacgtgttaggaaaaatgactttttattattttcctgttaacatactgatagttgtagctttcatctggcacagatgaaaacacttaagaaacaagccaagttcttgattatatttaagtaaccacagtttatcagacattcatttttcatttgataattctttagctaaccaatagtaaatgaagagtaaaaatgcatatttgctatctagttaagtctttgtaacattgattcagttaatgagtgagaagtttaagaattacattcagttgcatttatgcaatgctgaatatagtagattatcatctgtcactatgtgaacctggacaaataactatcaaaataaaatgtgtacaagtaatatccaaatgactattaagaaggagagtatactacttaaaaaactcaagtttatgagctctgatatgtttctgctgtctttatatttgtaaatgaaatgtaccttcatgtataaatgtaccttcacttcataattatgtatagttgtaatatctgagttttctgaaataaagaaaatagttaatatgtaggatgtttaaaactatgtaaaaacaaacttatgaacatcgttcatttagtgtatgataatcaagtcctagatattgaaatcacaatgaggtatgtaagtgtatataaatatctgtaacactgatttaagaaaagttggtgtgggttgactgttatagcagcaaacagaaatttctttcaaattatgccaattttagtaatttaaagtattgggggcctttaccagggctaaactattaatttcagagatgaaatatctgtagtctctctgatttaagctaattctagcagtttttcatggaacacctagctattcaaaattttcctgctgtttttaatcttaacaattaaaaagcaaattaaacatgcatctgtaagtatcataatcagctgatatttaacctttagtaaaatatttaaagctaaatgcctctgtttttattgttttctttgggggggagtttatttggctaaaccttatagaggactgtagtaactttggctttggaaactcaatactaaataagaatcattggccgggcatggtggctcacgcctgtaatcccagcactttgaaaggctgaggctggtgaatcatctgaggtcaggagttcaggaccagcctggccaacatgatgaaaccccatctctacgaaaaatacaaaaaattagccaggtgtgttggtgggtgcctgtaattctagctagttgggaggctgaggcaggagaatcgcttgaagccaggaggtggaggttgcagtgagctgagttgaggccattgcattccagcctgggcgacaagagcaaaactctgtctcaaaaaaaaaaaaaatcataaaaaaaaatataggccacgtgtggtggctcacgcttgtaatcccaacactttgggaggcttaagcaagtcaatcacttgagtacaggagtttgagacgagcctggccgacatggtgaaatcccatctctactaaaaatacaaaaattagccgggtgtggtagtgcacacctgtaattccagctactagggaagctgaggcatgagaatcacttgaacccgggaggcagaggttgcaataagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaatacaaaagttagccaggagtggtggcacaagcctgtagtccctgctgctagggagactgtagtgggaggatcacttcagcctgggagaccaaggctgcagtgagtcatgagtgtgccattgcaccccagtgtgggccacagagcgagaccttgtctccaaaaaaaaaaaaaaccagaaaaagaaaaaaaattaggctatgtgctgtggctcatacctgtaatcccagtgctttgggaggccgaggcagaatgatcgatcagcctgcccagcataggagaacttgtctctatttaaaaaaatttaaaaattagccagtcatggttgcctgtgcctgtagtcccagctactcaggaagctgaggcagaaagatcacttgcacccaggagctccaggcagcagtgagctatgattgtaccactgcactccagcctgggcgacagcctcaaaatataaataaataaataaataaataacacagatccacaaaacaatcaagaaataagctagatagagtgtatgccaagaggaaataaaaacattttaaatttaggtttaatatgtaaatactctgagatgtttaggtagtgattttttaagtttatactctagtgagtaaccatatttttgcttactgaaatatcttggattatttagttattttctgcattttgatgttttattacttactaaatagtataaacatggactacctttctaaggaatcattttactagattattagggttatccctaattaacatttgtatttagatcacttgggcacttgctactgctatcaaccaaatggcattggcaatctaacagttacttatgtaggatcaaactgcgatagtgcattgtgttaaaatgtcatgttagtataaatcatgcatatcatagaatattatgttgctatgaattaggaaaaatcatttaattatggaaaagaacacactgaattaccaggataggaaaacctatcttaaataaagacttaactttttttttatacttaaagctcctttttcttcttaaagcttctcttttatgtctctggaaaagctcccttgagtgatgaaattgctgtttgacctttttgtttttgtttcttctaagtccatatattctgtgtcgtgtatgtgattagggatggacaaagggttcttattccctaggactctcttttcctcttccagcgatcatcttttcaggttcttataacattttactcctgtctgtttttagtaaatctttttattattcatatcctcatccttttaaaaatgtattaatgcccataaatcttacccaggtgtttgatatatgttctactcagatattcttttctttcatgccccatgtgtaccatttgtacaggctctgtccatcttgattcataacctcccgatttaggcaacttgatctcacttgtctgttggttttcaaggattcaggattctaggtggcatctaacagaggcctcagaatcacgtccataaaatatgaaactcagagtgacatgctcagttttctagcattatttaactttattacctgcagttacaaatattcagatgggaaaggatacataagtaatgtaaatccgttgccttgttataactggttctacagaaagattcattttgatcttttgcaagttgtgtaacttagaattaatctgctgcaaagcatttaaaattatgtcaggataaacaaaacacatcttttgtgtatacctcaagccctcctgaggagtaatttccttttctctgaaattctagagtacttcattggatcttccttccagttcttgtcacttttgcttgctcccctccccttgggacctcaagtgtagagggttgagttaatcatactcaatttctggtgctttatcaccataacttctctcttgtttcatttattcccttttatttctctttccattcccctgcttcccccatagataatcatttcaatatttgatgtgtatattcttttgttcttataaattcttataaaatatttattttttatatgtatgtatatatgtgtgtgtgtgtatatatatatatatacacacacacacatatatatatatatatacacatatatatatatatatatatatttttttttttttttttttttgagacagggtctcactttgtcacccaggctggagtacagtggcgcagtctcagctcactgcagccccaacctccgaggttcaagcaatcctcctgcctcagccctgcaggtagctgggactacaggtgccctgccactacacttggctaattttttgtattttggtagagacagggttttgccatgttgcccaggctggtcttgaagtcctgagctcaagagatctgcccgacttggcctcccaaagtgctaggattacaggtgtgagtcagcacacccggcgattaccttgtatttttaatttacataaatagtattgtgctacagatttcattttgttttttccctttgtttactcagtactgtttttaagatttatccacctatctctagattgtttctacctatagcatagtgcttcacaccctgtatatcctccatgttttacctgtcctttctcccagtgacgaatatcctgattgcctctattttctcacccccactaacaatgctttgatgaaaatatttgtatagtccctttatggatctatataagaatttctttggaacatcatctccccacttagactgtaagctccttaagggcagggtttatgttgcttatctttatatggtctactatgccttgcttgtattagatgtttaagtacttattgaataaattaatgagtgcaaggctaagaatatagattattttgaaggcagaagaaaattcttaagcatttttaagaaagacattgtgattaaagagatgttttaaaaaagtaatcaagaagtagcattctagaatggtgggaacgagattgaaaacagaagcgtaaatgtaaagtaagaattaaattggcatgctgcttttatatgttagagttgctttttggagtaagtgacatgaaaagttctcacatttttatatcaaatcattaaaattatatagaaaaattgtatatacagtgaatggtattcagtattcctctggaaactttactgataatattctttagtcactttccattatataatcattcttatatggatttacacatgcccaaatttgataatatcttttaacatataactgcttatagtaataagaagaagattgaattaatctgttaacatgtaacacagatgtttctttggacacccttggttaagtgattgctatgttaaaatgtataatgtgtcctgttagtttgggaaattttgagaggaatatttagacataaaggaaaaataagtcaattctaggttagtggctttcatttttgactatgaccacaataagaaacattttatattgaagcccaggacacatcatacatctgtttatcaaaacagaaattccagtggataataaacactctactacatttgatgcactgtgttatttttagttatactttttcaacctgattttctatttgagatccagttgggaatgctgtttaaaaatcattctagtagggtgctgtgtgatgatgtaagcaagggaattacagaacaaggtttaagttttatagacaaaaccaagtaaggaaatatgaaatctagtctagatccttctgtatatcatgtttttttcccattggccattatttttccattgtacaatgcactgattatttttagacacaaaaatgattgataggattaagctcaatccaataaaaaactaaatatttggcaaatacatgtccacctcattccttcactgccaataaaaaaataaaggccatgtttaagctgtcactacatcatggcttctaatacagattttttctagttttgttaatggagggaaagtgagaggcaaaggaataggatagaaaccaaaccaaaaagatgaaatggcgactttacctgtggttctttctttgagacggagttttagtcttgttgcccaggctggagtgcattggcacgatctcagctcgctgcaacttctgcctcctgggttcaagcgattctcttgcttcagccttctgagtagctgggattacaagcatgcgccaccacaccgggctagctaattttacatttttagaagagacggggtttctccatgttggtcaggctggtctagaactcccaacctcaggtgatccacccgtcttggcctcccaaagtgctgggattacaggtgtgagccaccgcacccggccacctttatttttaaatagtactttatgatatcattcactgataccagtgaatagatgtctttgtatctgacactgtaagctgtttgaaggagatagaacccttttattttctggtatcttataatactacttactacctgttgaaaattttgttgctaaaagaatacttgtcttaatctctacccagaaactgtagatgttgctttagtttctaggactaattaggcgacattatctgtttttcaccaatctgttttattcttgatgttatagcttgtgttagtcctttgatgtgtctttaggcaattccactaactccatggctattttgagatgaaccactttttatgcatcatttttgccatcttccatttttaatgctacatacgttctgggcttatagtttgtctattcataaattactcttagtaatcttgtgttccacgcttcttgcatattatttgttaacaagatagacagggccattcctatctgttactgtcctcaaaattctactcttattttggattatactatgtataaagattttaaatctgtgaatgtccagtggggtcataacataattactaaccagtctggttagtgttgaactcttacctagttttcctgaatcttaaatacaaattgtttagtagctatacaagggtgttttgaaactaatggatgtttaaaggaccatggaccattcagtctttgtagaacttctaaatgtactcgagtgatgtcattgaatttattacatgactgaatatttctttgctattgctgtggatttgtacattgctatttgtgaccatttaccttccttttcttgttgattgtcattaggcactttaaacaaatactgtaaatcaaaacagggactcctatatggtcttaggaaagtaataataaaattagctcacaaatctaattgcttttgctctgaaagaataaagtctttttccatcatttttactcagaaagaaatataaattgaggaaggctgaggctggagaattactttaggccaggagttcaagaccaggctgagcaacatagcaagatcccatctcttaaaattatatatatataaattgaatatagacagtgtactttgcaatttaaggaataactaagcctctgaaagtgattgcagtgatattgaaattgtggtcatcttaccttattaaagacagtatgtaggtgaaaaacttagacttttttagtaatgacacatgttgcatatgtttgagctacctgcagttttgagatctctattctagcaaaaaagtagatgaatctctaatttttttttcttcagtagttttgtcacccctttgaaattcagaacatttcatgtctctaaatgatcttttttcctttggacttgagaatcatttttaatacaatggatgattttattttaaaaattcccaaattacctatgttattcatatatgttgactgcaattcaaaataatagataacttttttacccagcttttctcaaacagctttattgtttaatttacataccataaagttcccttgttttaaatgtacaatgcaatgagttttagtaaatttactgagttgtgtaaccatcatcactatctagttttagaccatctccatctgcccaaaaagatctcttatgcctgtttgcaattgatcctcattttcactgttataacctcaggcagccactactgtccctgtctctatagatttgccttgtctctgcagatttgatatgagtggaattacacaatgtgtggtcttttgtgtctagcttctttcacttagtataatgtttttgaggtttactcatgttgtagcatgaatcagtagtttgttcctttttgttgctgaatagtcctacttttttttttttttttttgagatggagtctcgctctctcaggctggagtgcagtggcgcaatctcggctcactgcaagctccgcctcccgggttcacgccattctcctgcctcagcctcctgagtagctgggactacaggcacccgccaccatgcctggctgattttttgtatttttagtagagacggggtttcaccgtgttagccaggatggtctcgatctcctgaccttgtgatccgcctgcctctgcctcccaaagtgctaggattacaggcgtgagccactgtgcctggcctagtcctacttctaaacaagattaagccttagatttgcctcagagtaggtattgtacgtcaaaaaatttatgtccttcatttcatgtccagatgttaggattattaatattgataattatttttcagctgatttgttatgaaggaaggaacttaagtgtaatttaaaaccttaaaataatatacattgccattgtttgttaacatatactgtcagcatgagtaaccctaaatgggaagtctgattttctcctaggatcatttattgtttctctcatagacagaatttacttgaagtgttcatttaaatgcaagttgtcctttgcatagtaagtttaacagtgttccagtacagatgtgttaaaggtatatttaatggagaattttagaaagacatgtcttgaaaaaactgatttcacattatatttcaatataagaagaaaaatattttgactgaaaaacactatcccctactttgatctgtaagttttggtcttttgcattaactctgcattgcttgcagagttgatattgctaaaagaatgattgttctaaatgggcagttaacatttctggtattttcaacgctattttgatactgctttagatttggtgttctttaaaaagtccaatctaatcagcagaattttgagattcttgcctcttggttttccttttccccgcccctgacttaatttccaaaatcctcctatcctaaagtagatttttaaaacttcacagtttttgaattagcaacatcctagtttgtgctgcttgaaatagatgagtataggctttaacctgcctaacactggtgtgactctgaacattcattctataacattagttataagggttttgggagggaggtccgtgtgtgtgggaggggaggctggttttcttttttttttttcttttctttttttttttttttttttttagcatggcactctttcaaacatttttcatgtgcttaggtacatccaagcagaagtccagttccctccaggtagcagatcaggacctactgccatcttttcacccataccagcctttggagtgcatagtagaggagactgaaggcaagctgaatgaactgggacaaagaattagtgctattgaaaaagcacagcttaagtcactggagttaattcaaggtgaacctctgaacaaagataagatagaagaacttaaaaagaacagagaagagcaagtccagaagaagaagaaaatattgaaagaactgcagaaagtggaaaggcagttgcagatgaaaacacagcagcaatttaccaaagaatacttggaaaccaaaggtcagaaagacacagtgtctctacaccaacagtgctctcatagaggagtcttcccagaaggggaaggagatggtagtctcccagaggatcacttttcagagttacctcaggttgacacaatcttatttaaagataatgatgttgatgatgagcaacagtctccaccatcggcagaacagattgattttgtcccagtccagcctttatcatctccacagtgtaacttttccagtgacttaggttctaatgggacaaattctcttgaacttcagaaagtatcaggtaatcagcagattgtaggacagcctcagattgctattactggacatgatcaggggctgttagttcaagaaccagatggactaatggttgcaactccagctcagacgcttaccgacactcttgatgacctgatagcaggtgggttaagaaatatatctgtaataatttctctttaatctgtgtgctgaacttctttatatacccctccaaaaacgtagactttgtacgtttccattttagaactttgtaaaattacccatttctcgaagtattttggaagtgaattaactatgctcaatagcactaacacacaaaagtgtgttttcccctcttcttttttgtcatattgcaaaggcaaagaaataaagttgccacaatcctttgttttaaaccgttggtatcaaaaccactgtgtgctgtgacttgggtaggagatctcaaagtagaatttctttgtaggcttttagaagtattcgtataagattatacttaaaattttcctgctgttgattttcatgtctggaaatttaaaatcacacagcttttttaatttgtaattttattagatcaacttacgtatttccaattaaatgggatgttcagataaaactaagtattccatattataatatttgtggttagaagataaggtgcattaaaatgattgtcacttgatgatttgaagattgggatttttgcattaactttcttaatgaaagcacacaaccacaccacacaccacaccacacacacacacacacacacacacacacacacagaaaaaaaggcctgataaccttgaagtatatgtttctgtttattgttgtgtggaaaattacaactagatatgaaatgaggtgcacaagtttactttccctttcattgtccttgcagcagtgggaaaacagtgcaattaatcatttaccttcctaaagatggctggtgaatgtatcacctccatgagagcccaattcagaaatgcagccagaatggctgttgacagtggatgaagaccaagaactaagatgtagctggagtgatattcaaaggcaggccagtcctctgtctcttgattgcaacatttttttccttactgttgtctgttgcctcttgtcatattctcctccccttctcccatcccaattatgctatctcagtttcctttcttcttttgtgagcctttagtcttcctgatctttactgaatctttttaaatgtggaataagattactgaaatcaggaattttattgggcatgtgtttgacttccaatggttatagaattgtgatattgcctttgaggctcctctgatatgtaataggtatcattgtgcagaggaggaatgtcttagttttcttaaagaaaattaaaattctgggaaatgttttaaggagttaggctctttgttctttaatttgggtttttatatcttcagttggtagacacaaattaactttgtattattagcattgaaagttgttataaattgtgaataaattcttgtagttcatttggaattctaattttaatctgggtaaaaacagattttagaatgtgaagtatgattacgaataataatgatgaaactgatgaactgggaataacatttttaacatgtagtgttctgtaactagcattataatgttcctaattaagtgcacagtttgcagttatgaaatctgtgttactgattagttcagttatgttagaactttttttttttttaaagaatgtagaaatagctctaaaaggaacttgtaagtgttaaggaacatcaagttttatttcactgaagtatttgttaaattagtcttttacaaagtttgcatgaaacttagaaaattggcttagaaattatctttttattaatataaacaaaatttaatttgtgttagacattaatacctaccacattgtacaatattcttttattaataagttttaaattttaaatcagccaacaggtacaaaaattatcttcatgtaaaaacttccatttttgtgaaggctatgtgttttgaactatatggcagtaattatattttctttattcaagatgatgtacctgtcttaaatttaaatattatattttcttaagtcaaagtttgtcttaattttcttagttgaaggtaaaataaataaggcaagggtgaattaggttaatacctaatgctgtaattgtaaaacatattaacatattggtaagattatagagtaggacaaatatataattaattttacttaactctagttcttaccactcatattagtaaagaatactgtacatcttaaaattctactttagaattttactttagaagtaaattttactttagaagaattttagatgtatgataacagtacattttactttttaaatataggagtattatttccttattgctattctttcaaaatatttgttgtgataataagttgtttatataatttattaatgttgcaacttgattagctgattaacttagccctttagtgtgttgtttgatacgtgtcatacatgatgtagttccaaacagactatataaattattgattaggaacatggttcctcaagtccttctgaaagtgagcattgggtttttagcagttaccataatagcaagtgattctcaaagttcaaatgtctaggaatataaagtaatttaaagaaattcaaaatagcttttacctttgagcagttctagaaatacttagtaaaattttctttctttttttttttttttgagatagagtctcactcagtcatccgggcctggagtgcagtggcttgatctcggctcactgcaacttccgcctcctgggttcaagtgattctcctgcctcagcattccgagtaactgggattacaggcacctgccaccacacccagctaatttttgtatttttagtagagatggggttttaccatgttggccaggctgctttcaaattcctgacctcaagtgatccacctgcatcggcctctcaaagtgttggttttacgggcgtgagccaccgcgcctggccaaaattttcaattctaatatagaaagaagattggttaaaaatcacctaatatcaatttatttacatttattgagcatttaccatgcaccaacttctatgataaatgctaaatatactttatttcatgggctaattataataatactttaaataagtccttttcccacctctatttttctgttgaaaaactgaagctggccgggagcagtggctcatgcctgtaatcccagtactttggcaggcagaggcaggcggcggatcacttgaaatcaggagttcaagaccagcctggccaacatggtgaaacccatctctactaaaatacaaaaattagccaggcgtggtggtgcatgcctgtaatcccagctacttggggggctgaggcaggagaatcacttgaacccaggaggcggaggttgcagtcagccaagatcacaccactgcactccagcatggggcaacagagcgagactctgtctcaaaaaaaaaaaaaaaaaaaaaaaagaaaagaaaaactgaagcttagggaaattaagttgctagtaagtaccaagattcaaactcagttcagccaagtttaagaaccttagatgtaatatgcatgcatatgtgtcaacttaaagttctgatttatctttaagtattgttatttccttagacttcgaaattctattaatcatttcccttatttttatattaagatttgatgtacatgtaagttttaatacagtttttgactttttactatgttgttactatcattgccatcttaacaggctcttaaattgtaattttaaagtatctttaactctgtagtagtgaatataggtttaagaattaaaaagtaattaagaaatcctcttaaggagatttgcaataaaatctttaaataattttttctaattgactttaatattttatttataggtttttgtttttttttttttttgagacggagtctcacactgtcacgcatcttggctcactgcaacctccgcctcccaggttcaagcgattccccttgcctcagcctcccaagtagctgggattacaggcgcccaccaccatgcctgactaattttttttgtatttttagtagagatggggtttcactatgttggccaggctgatctcaaactcctgacctcgtgatctgcccgcctcggcctcccaaaatgctgggattacaggcatgagccaccacgccaaccataggtttttatttacatagaactatttaataaagttaccaatacataaaacagattacagcaattaaatttcttaaaaactcacaacagccgggcactgtggctcacacctttaatctaaccagcactttgggaggccaaggcgagcagatcatgaggttaggagatcgagaccatcctggctaacacagtgaaacctcatctctactaaaaatacaaaaaaattagccaggcatgctggcatgtgcctttaatcccagctactcgggaggctgaggcaggagaatccttgaacccaggaggcagaggttgcagtgagctgagatcatgccactgcactccagcctgggtaacagagcgagacttcatctcaaaaaaaaaaactcacaacatattttatgtacacctagtatcagtgagattttttaataattagatttattatcttccatattgcctacaaaactttcttcaacttcataaaaagtcaagtaacatactgtacttacttctctcacctcattttaaaatagtggataaattgtcagacacagtgactctgcacctgtaatcctagctacttgggaggctaaggtgggaggattgcatgaggccaagagttcaagaccagcctgagcaacacatagagaccctatctctttaaaaaaaaaaaaaaaaagcataccgtataagtttaatttgaattatatatagatgtttgtggtagcagtctgtcttggtcactttcagagatatttcattcagaggtaggaaatattttagaatttatgaaaatgtcatagtcttggtgtaattttctcttgatacaacctttattccacatgcactttttaaatctcttgctacttcctagttttagaacttttcatttgtaattagtcctgttaaaggcacttgctatggaatgtttctgactgtcattattacatggagtgaaaaaatgcttctaggataatgtagtacaaaaatgtttagtaattattgtaacaacacatttttgttaacaaagctgttaaatgcacaaaagtactttttaaaagccaactctgtgaagaagtttcttatcacattctggcatagcactctaatcaactattcaaaaaaatttttatatacctgtttttcataataaagagagatgagataacataaataaaatactgatagaaaagtagttctttactaaagtatatgttaataattgtgggaccactactgaagtcttactgttagaaaggttctgtaacatattaatcttcagtgtcttgttttttcaagcagttttccaaacatatcagctattttgaggaggtgtaacaaaatagtatctgcttttaactcattgaatgacaacaatttttcattattactattatttttttcttggccacttcttccaggaaaaaaatgacaaaaaattttaaggctttgtttccattttgcatattcttataggtgaaacaaacatatgtaataattattcctatttgtaactaaatagttaaattatgttatttatgtgatgacagaagctggagaaatttgtattgccaagatggttatatatgttggtggggatgagctgggtagctcatgtagaaatatatctgggcatcttaaactttgctcacttatttaaactagtaatctactaaactgagtcattcacacttacgaatagtatctttgaatgggatctagtcatatcaaaaattctagagagaaaatattttccaacacttaaaatgcttacatttttctttaagtcctacgtgtttttgactgacttttaatctgggtgcaaatgtaaggttattgccatcactgatgctttgttgatttttttgtatattattactgattatatgtttttttctgagtttttcctttcttgagtgaataatgtttttatttttcaatacaatgaataatagtattgacaatcctataaaatatctgatagttacatctattgagcacccaccatttgctaaaaacactgtgttaaatgctttatatacagtatctcttagactactcacaacatccctgagataggtcctgtttccccccgtggtcaaactccatctcttaagaaacataagaaattttcagagatataaaatacataatttcttttaactcagttttctttcttttttttttttttttttttttttttttttttgagatggagtctcactctgttgcccatgctggagtgcagtggtgcgatcctagctcactgcaacctccgcctcccaggttaaagcgattctcctggctcagcctcccgagtagctgggcttacaggcgcgttccaccactcccagctaactttgtgtttttagtagagacggggttttgccatggtagccaggctggtcctgaactcccaaccctcctgacctgaggtgatctgcccacctcagcctcccaaagtgccaggattataggcgtgagccatcgctcctggacttaactcagttttcaaaccacattttgagatctcaaatagaacttcaatgttcattttaaaaatagttggactttcagatactgattttttaacaaagtttcaaaataaatattgaatttaggaaacacatactccctgctatttatgtgagaaatacttgaacttgtctccctcccctcccccacccttttttttagatgtagtctagctctgtcacccaggctggagggcagtggcgtgatctcagctcactgcagcctccacctgggttcaagcaattcttctgcctcagcctcccaagtagctgggattacaggcatgtaccaccacacctggctaactttctgttttttttagtagagatggggtttcaccatgttggccaggctggtctcaaactcctgacctcaggtgattcacccgcctcggcctcccaaagtgctgggattacaggcgtgggccactgcgcccagccccctttttttgaattgtacacaggatatttttatctaattgacttttttacaaactaaaatctagaattccttttatttacttttatttttggaaattttttttcctccctgttggcaatgcaaaaagctactatttaatgtatgtgcactaaatatcaggtgctgtgttaagtattttatctgcattgcctcagtggtctttccaataaccttccaaggcaggtaccattattttcgccattctacatatagggaaaattgaagctcagagaagttaaattacttgcccaagatcagaaagtcagtgttggaactaatatttaaatgtaggtctgtctgattccaaagcttgtgattttactattactacatattactgctatggaaatttctgtttttgtgtttttctatgtacaaataaccttactcttttaagtggaatttagcaatatgaatattgtttttcagctgtgagtaccagagtgcccactggttccaacagttcttctcagaccacagagtgtcttacacctgaatcctgttcgcagactacaagcaatgtggcttcccaatcgatgcctcctgtgtatccttcagttgacattgatgcacatgtgagtagattgctttatttaaacttattttgcacattctgatcttctttggaaaggaaaattattctgcatttattgtgaaaagaaatattatttgctcttaaattgataacttctgttaaaaaaaattttaacttatttttttcttctcctagactgagagcaatcatgacacagcattaacactagcttgtgcaggtggtcatgaagaacttgtatctgtgctcattgcacgggatgccaaaattgaacacagagacaaaaaaggtaaatatcagtcagaaataaaatccaagtgtagttacatcagaaaataattaacttttttattattgataaatagttcctagactatctcagtgataagatggataagtatatttcagttaggaatatctggattcattattctgcggagccaaataattctcaaaacattcaaaaattagacgtagatcattagtgaaatagagcaagttgtggttgcctttgttaatccaaaggtagttcatacagaggcatcaaagttcattatgagtataaactttaataatttttaccgacttagttttttaattaggtgtttatgggttttttgtcactaacaaattagggtttagagcagttttatgttaactcattatcagtgtctgccctgaaggatttattttgctaaaatactagagaattgtaaacagtggctttaaaataaaataaaaaacataaatttgtttaagattttcattttctgatttaggtttcacaccactaatcctggcagcaacagcagggcatgttggagttgttgaaatccttttggataaaggtggagatatagaagcacagtctgaacgaactaaggatactccgctttcattggcatgttctggtggacgtcaggaggtgtgttaatgttaattttcattttgtaaatattttgcttgtattttaaaatatgcatatgattcgtattttagctacatgaataaaatttgcatgtattttgtgtgtttgtttttctgaggcagggtcttgctctgtctcccaggctagagtacagtggtgcaattacagctcgctataaccttgaactctggggctcaagcaatcctcagcctcccaagtagctagggctgttttgtagagatggggtcatgtaatgttgccctggccgatttcaaactcctggcctcaagcaatcctctctcctcggcctcccaaagtacagggattatagttatgggccagcatgcctggccctgcacgtattttaacatgttccatatactttctgaggaatgggtacttctgttaacttttatgggaatgtaaatgccctttttttttggcgggggtttgtggagggaacaggagggtggagatgaggtctcattatgttgcccaagctggccttgaactcctggcctcaagggatcctcctgccttggcctcccaaagtgctgggattataggcatgagccaccatgcctggccataaatccccttttaaaaaatctgtttcttgcccttaaagccaaataaaaattatcttaatccttacatttattcggattgaatgaatcacaattctaacacatatgaagtgcaaatttattgcccaataaatggcaaatagaaagggtaacatcttgttattgcagtataattgggatttcaaaactctgaattcctgaaattgaatccatttctctagtgttgatatttcaatatttagggtctaatgaaatgtaattaaaatatcagatatttagataaggaagttataagtcctgtttctttgtgtttccttcattataagttgagcccttggtgtaaactctcttctctatccatattttactttgtaggtggtagacttgctgctggctcgaggtgcaaataaagaacataggaacgtatctgattatacaccactgagtctagctgcgtctggaggatatgttaatatcattaagattctgcttaatgctggggcagaaattaattcaaggtattgcctgttcattttattgttcatgtttagtaagttactactttggacttaaatgtctacctcttaacgtttagacagatacattttaaattaagatagtactaaagttgcaaagccaacgattatacctataatgtgtttgtttataagtaatctcagcttatttcagtaatgtggctgcttataaagaggtctcatttcaaaaagtgttttgttctatggcctaccaccctaaacgtgcccaatctcatctgatctcagaaacggtattttgttttatatagttggaaatttataatccctaaataggaattacattttattttttaagttatttattttttgagatggagtttcgctcttgttgcccaggctggaatgcaatggcgcgatcttggcttaccgcgaactctgcctccggggttcaagcgattcttatgcctcagcctcccaggtagctgggattacaggcatgcgccaccacacccagctaattttgtatttgtagtagagatggggtttctccatgttggtcaggctggtctcaaactcccgacctcaggtgatctgccctccttggcctcccaaagtgctgggattacaggcatgagccaccatgtctggccggaaattatgttttaaattgtgacattttcttattctttattattggtcgaaacaagtaaaatctattcattgatgttagaaacctctctttttagtgaaaccttttcatctttaatgcttttctaaaataataggcaacatattattttaattttctaagcacatttccccctttaggactgggagtaaactaggtatttctcccctgatgttggctgcaatgaatggacatgttcctgcagtaaaattgctgctcgatatgggttcagacattaatgcccaaatagagaccaatcggaacacggctctcaccctggcctgtttccagggccgagcagaagtagtgagtttgcttctggaccgaaaagccaatgttgaacatagggcaaaggtaagcattttttacttgtcaactatttcagatacatttctgtagaaagaacatggcattttaacgcaaattgaatataatattttaaattatcataaattaaaactgataccaatgcagagttgagggattatgctgtataatagtgagtgacatactgtcaccatcatgacttttattaaggacaatgaagaaaacagaattagtacttttcccaacctcagccttgagtagctttctattaatactgcagcttacaacttttgaatgtagtaagattattttgtattaactcttacactgtagacttttaaagaacacctttaatgaggtatgtgcttatcattgtaaaaatcccaagcaaaaatttaattcacaagttataaaattagggcagctaacatctaatttgaccatggcagattttgacagtttcatgactatttggtattaagaaaataggagttagtggaggctgggcgcggtggctcactcctgtaatcccaggactttgggaagcctaggcaggtgaatcacatgaggtcaggagtttgagaccagcctgaccaatatggtgaaacccccgtctctactaaaagtacaaaaaattagctggacgtggtggcaggcgcctttaatcccagctactcaggaggctgaggcagaagaatcaccggaacttgggaggtggaggttgcactgagcagagatcacgccattgcactccagcccgtgcaacaagagagaaactccatcccaccccccgcccccacaaaaaagaaagaataaaggagaaaagtcataagataatctccatagatgcaggaaacacacacagaggaaagaaaataggagttagtatgtcattggcttgaatttctttgcttagaactgcaaggttcttagaactctggaaagacgtaggttgggtagaatttttaataattagtcaacagagaatctagtgctcatttgaaattggaaagatttgactggaaatctcgtaattcttccctgaaattccttttacttcttaaagtttagtgcaacatttacattcttttaatctaagtaatgaggaagtgtagtttttccttggctttttaccacacaaagagaaatgagtctttcctgtcattcaatttgtctttttctattacaagtattcattgtgtgccactcatccattaaaggtcctagagaaatctgtgttattttggatagtaccagtaggaaatgtcctttgaaaaaatgttggagactaacgtaccaaaggcacatatgcaaaaaatttataaagtgattttaatctacttatttttaatatctctattcattatgcaaagaaattatctgagtaaattcacaaaagtatagaagttacagaattgtttttagcatgagataacatgttttaagttcattctagcacgtctgaatctaacaatttctactgctgtttagtaaaattcaaggcaaaatattgcttagctcttttatgagagctaatcagaactagaattgtcttaaaagttaattgcctcaggtttttaaagaaattatgtagcttagttttggtctacggaatagttaaaaaaagaaatgtaacttagttgcataatttattggtttaaacagacgggtcttacccccttgatggaagcagcttctggagggtatgcagaggttggaagagttcttcttgataaaggagcagatgttaatgctccccctgtgccttcctcaagagatactgctttaacaatagcagcagacaaaggtcactacaaattttgtgaactcctgattcataggtgagtacttttctattatatgtagaacttctcatggtcattttcacttttcagagcttttaaagttaataacattgttttactttattgatattgttaagaaaagattatttgcaagttattttgtaaaagaagaagatagagaaaactagaaaaagccagcctcttcttacaggaaacaaactattaatatgccttgtttacaggggagcccacattgatgttcgtaacaaaaagggaaatacgccactttggctggcatccaatggaggtcattttgatgttgtgcagttgctagtgcaagcaggtgctgatgtggatgcagcagataaccggaaaatcacacctcttatgtcagcatttcgcaaggtaatttgatatgggggaagaaaggtcaattttaagccaattctaagttaaaaccatgtgagaaagataagtttatcttggagaattgagtatatttccatagaaaaatcactgctatctttccattcttttttttttttttttttttttgagacggagtcttactctgtcacataggctagaatgcagtggcatgatcgcggctcactgcaacctctgcctcccaggttcaagtgattctcctgcctcagcctcctgagtagctgggattacaggcatgcgtcaccacacccggctaatttttgtatttttagtagagatggggtgtcaccacgttggtcaggctggtctcaaactcctgactttgtgatctgcctgcctcagcctcccaaagtgctaggattacaggctcccgaccttatctttccattcttttgtggccaaatctaagatctatgtggtagttcactataagcaacttggttgttaaatcacttggtgtcttgactatttgtgatacattgttcatgaaacagaagatttaagaaaaactattatatgcagatggatttttttgtgcctaaagaggaacaaaaaggagtagactttcataaaaacttactgtatcttctgtgtgcgtgtgtgtgtgtgtgtgtgagtatgaaacggtctcagtctgtcaaccaggctggagtgcagtggcatgatcatagctcactatagcctcaacctcccaggctcaattgatcctcccgcctcagcctcctgagtagctgggaccacaggtgtcactaccatgctcagattttttttatttttactttttgtagagacgaggtcttgctatgttgcccaggctggtctcaaactcctgggctcagcgattctcccacctctgcctgccaaagtgctgagatatgggcgtgagccatgcctctcatatatattaaagttcatgcccggcctctcatatatattaaagttcacttatctgctgtatttttaaaagccttcccattggtatagcttcccaaactataaactacttagtagggcatgtaaagacctgcataataagcttcatgtcaacctccccatacaaatcatttatgctactatccccttttgctcactgttttctagttactggcctagaatgcactaaattttcaactgcctcagggcctttgctcactgattttcttttcctgaaatgatttcctttgctgttcacctagctcacctctctactcatctgttagctccaattttacatgtcagttctcaaagagtatttctctaacaccaaatctgaaaaaggtctctctgtttctcttttatagttgagttttgattttccttaccccaatttgtaattatatcttcaaacatgtacttaccattttaatgcctgtctcgccaactagactggtaggtccatgaggacaagagtcatgaccatctttttcagcactgtttatatacccagttgtttagcacagtgcaatttacatatagtgaaatgcatgaatcttaaggtacatggtttagttttgataaacgtatacatacatgtaacccataccccataaacatataaattatttctgtaaccctagaaggttccctcttgcccacttttagtcacttccctgccccagaggcaagcatttctctgatttgtatctccatcacactaattcttaaggatgttttagaaccttggtaggaagggaaactatgcaagcttggttacattaaaatagatatgctggccgggtgcggtggctcacgcccataatcccagcactttgggaggccgagtcaggtggatcacctgaggtcaggagttcaagaccagcctggccaacatggtaaatccccgtctctactaaaaatacaaaaattagccaggcgtgatggtaggcacctgtaatctcagctactccggaggctgaggcaggagagttgctagaacccgggaggcggaggttgcagtgagacaagagcgtgccgtggcactccagccggggcaacaacagcgagactcccatctcaaaaaaaaaaaaaaaaagatatgcttagaattgattacagatctttcaacccttgataatggcatttagaaagtgttttatttagattcaagtcctaaggctcagaaagttgtgatagtccaccttgtttagttagtgaagtagaggcaaagtaagactttgaaatttaaaaaaaaattacttattttaggactcatttcccttttacactgaggttcattttacatcaccaatgtttgtttaatagatttattctaggagatactgtttttctacaaaagctttttctaatttcagtgggattaaattcaggagaaatgttgtctagtccaccatccattcctgagcacacattcttgtcttttatgcctttctttttataagctgaatgctgatcttatttttataattttaattttaagcttaatattctatttggaagtatttgcctttttattcttaaattggtaggcatatatgcaaaatcaagggattcctttgtaattctgttgttttactttcttttattcttaagaataataatttttcttttcatgctaccttgtctaagattgttgtacttcttatagggtcatgtaaaagttgttcaatatttggtaaaggaagtaaatcagttcccttctgatatagaatgcatgagatacatagcaacaattacagataaggtaagtttaatatgctactgaagcacatttttgttctttgtggaatgatatgccaaagtgtgcagttaggaacttgttctttttatattctgaaaggttggtcacctgatctctttatgcgtttgtttctccatttgcaaaatagaggggtataatacttttgataaactattttgagatttctactgtggaccatagtcacagtgactacactaaggtactaaaccattagcctaatgagaaggcttcctaaggacatgcaggtttttagggaaatggtgtcttatttttgtgaaagattggactcaaaggataacttaatttggtttagtgacttttcagtttgaactttaacctctggactttaatgtgctcatcagcttaagttttatttggcctctttcattatatatttacataattctatttcctgctgtaggaactgttgaaaaaatgtcatcaatgtgtcgaaaccattgtgaaggctaaagaccagcaagctgcagaagcaaataagaatgcgagtattcttttaaaggaacttgatctggaaaaggtgagtgggaaaaataattttcctttttagaaattattgagggtgggggccgggcacggtggctcacgcctatgatcccagcacttcagaaggccaaggcgggtggattacctgaggtcaggagttcaagaccagccttgctaacaaggtgaaaccctgtctctactaaaaatacaaaaattagccaggtgtggtggcacacccctgtaatcccagctactcgggaggctgaggcaggagaattgcttgagcccgggaggcagaggttgcagtgagtcgagatcgtgccactgcactccagcctggctgacagagcgagactgtctcaaaaaaaaaaaaaaaagaaagaaattattgagggtgggcgtggtggctcacacctgtaatcccagcactttgggaggctgagcctaggagtttgagatcagtttggtcaacatagagaggatggcctgagcccaggaggcagaggttgcagtgagctgtgattgtgccactgcactctagcctgggtgacagagtgagaccccatctctacaaaaaaaagtttaaaaaacagttgggcatggtggtacatgcctgcaatcctagctattcaggaggctgaagtggaaggatcacttgagtccaggagttcgaggctccagtgagccataattacacactgcagtccagcctaggcaacagatcgagactctctctctattaaaaaaaaaaaaaaaaaaaaggaattgacagatgtcatggctcatgcctgtaatcccagcactttgggaggctgaggagggtggactgcttgagccccagagtttgagaccagcctgggcaacatggcaaaaccccatctctacaaaaaacaaaaaattagccaggcatggtggcaggtgcctgtagtcccagcaacttgggagggtgaggtgggaggatggcctgagcccaggaggcagaggttgcagtgacctgtgattgtgccactgcgctctagcctgggtgacagagtgagaccccatctcagacaaaaagaaaatctgctagagtaaacgtgtcgcctatatgaccaatattcttaataatatatgattcaaaggaaataggtaatagattcttaaaccaccatcaattttttattctgacctgtcattcaaaaaaatatattttgagcccaaatataagggaaggactagattttgagcaagatcccaatttacggctgggagcggtagctcacacctgtaatcccagcattttgggaggcctaggctagaggatggcttgagctcaggagttcgagaccaggctgggcaacatagtgagaccttgcctctactaaaagtttaaaaaattcaccgggcatagaggtgcacacctgtagtcccagctactcaggaggctgaggcgagaggatctcttgggcctgggaggttgaggctgcaatgagctatgattgtgcaatgagccactgcactccagcctgggtgacagagcaagaccctgtctcaaaaaaaaaaaaggtcctgtctgggcgcagtagctcatgcctgtaatcccagcactttgggaggccgaggcgggcagatcacctgaggttaagagtttgagaccagcctggccgacatggagaaaccccgtctctgctaaaaatacaaatattagctgggtgtggtagtgcatgcctgtagccccagctacttaggaggctgaggcaggagaattgtttgaacccgggaggcagaagttgcagtgagctgagatcacgccactacactctagcctgggtgacagagctagattctgtccccccaaaaaaaaaaaaaatcccattttaccaaatgacatcattactgcctaagtggttttaacattggtctgtgaagaaatttagtaaagcattggaaatcatttgtttattgttaagatctgggttacaaatggtttattagattcccaattaaagactatccagaaaaaagacgggaggagccaaggtggccgaataggagcagctccggtctacagctcccagcgtgagcgacgcagaagacgggtgatttctgcatttccatctgagctttgaagagagcagtggttctcccagcacgcagctggagatctgagaacgggcagactgcctcctcaagtgggtccctgacccctgatccctgacccctgagcagcctaactggggggcaccccccagcagggtcagactgacacctcacacggccgggtacttcaacagacctgcagctgagggtcctgtctgttagaaggaaaactaacaaacagaaaggacatccacaccaaaaacccatctgtacatcaccatcatcaaagaccaaaagtagataaaaccaaaaagatggggaaaaaacagagcagaaaaactggaaactctaaaaagcagagcgcctctcctcctccaaaggaacaaagttcctcaccagcaacggaacaaagctggacggagaatgactttgacgagctgagagaagaaggcctcagacgatcaaattactctgagctacgggaggaaattcaaaccaaaggcaaagaagttgaaaactttgaaaaaaatttagaagattgtataactagaataaccaatacagagaagtgcttaaaggagctgatggagctgaaaaccaaggctcgagaactacgtgaagaatgcagaagcctcaggagcccatgcgatcaactggaagaaagggtatcagcgatggaaaatgaaatgaataaaatgaagcgagaagggaagtttagacaaaaaagaataaaaagaaacgagcaaagcctccaagaaatatgggactatgtgaaaagaccaaatactacgtactgattggtgtacctgaaagtgacagggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatatggcaccaaaaaagagcccacatcgccaagtcaatcctacgccaaaagaacaaagctggaggcatcacactacctgacttccaactatactacaaggctacagtaaccaaaacagaatgttactggtaccaaaacagagatatagatcaatggaacagaacagagccctcagaaataatgccgcatgtctacaactatctgatctttgacaaacctgagaaaaacaagcaatggggaaaggattccctatttaatacatggtgctgggaaaactggctagccatatgtagaaagctgaaactggatcccttccttacaccttatacaaaaatcagttcaagatggattaaagacttaaacgttagacctaaaaccataaaaaccctagaagaaaacctaggcattaccattcaggacataggcatgggcaaggacctcatgtctaaaacaccaaaagcaatggcaacaaaagccaaaattgacaaatgggatctaattaaactaaagagcttctgcacagcaaaagaaactactatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcctcatcactggccatcagagaaacgcaaatcaaaaccacaatgagataccatctcacaccagttagaatggcgatcattaaaaagtcaggaaacaacaggtgctggagaggatgtggagaaataggaacacttttacactgttggtgggactctaaactagttcaaccattgtggaagtcagtgtggcgattcctcagggatctagaactagaaataccatttgacccagccatcctattactgggtatatacccaaaggactataaatcatgctactataaagacacatgcacacgtatgtttattgcggcattattcacaatagcaaagacttggaaccaacccaaatgtccagcaatgatagactggattaagaaaaatgtggcacatatacaccatgggaatactatgcagccataaaaaatgatgagttcatgtcctttgtggggacatggatgaaattggaaatcatcattctcagtaaactattgcaagaacaaaaaaccaaacaccgcatattctcactcataggtgggaattgaacaatgagaacacatggacacaggaaggggaacatcacactctggggactgttgtggggtgggggggaggggggagggatagcattgggagatatacctaatgctagatgacgagttaatgggtgcagcgcaccagcatggcacatgtatacatatgtaactaactgcacattgtgcacatgtaccctaaaacttaaagtataataaaaaaaaaaaaaaaagactatccagtatcctaggatgtgtgctgtaatggaaaaattaaaacaaacaaactaaaacattgcctttctgaggctcagtctgcttacctggaaaatgacagtgttgatatactgagtttggaaattatattaaaagaaaaaatgtcatgatcaagtagagttattctaggaatgcaagagatagcttaacataaaaatattttgttgataattaaaggaagagaaaaagtatgattattgagagatgctaaaattttgacagcaaattttggtttaaaaaaacttcgtaagctaaagagagaagaaaagtttgcttacagtcattgaggagaaaaaaagataacttatccataataaaaaatgatcatgtgaataggcaattcacagaaaaagaaatacaggctgggcatgtgtggtggctcatgcctgtaatcccagcactttgggaggctgaggcaggaggatcacttgagaccagcagttcaagaccagcctgggcaacatagttggaccctgtctctacttaaaaaaataaattaaaataaattctataaataggaaagaatcatttttgtaatagcttcttgtcaggatttttacagtgaaatttatcagtattttgtaaagatccatgatagctgcattttaggcacataaatagatgccacataaatgtttttttaaaatagcattagtgaaattcactccacaaaccatacaatttacccatgtaaagttacataattcacagttgggcacagtggctcatgcctgtaatcctagcactttgggaggctgaagtgggcagatcacctgaggtcaggagttcgagaccaggctggctaacatggtaaaacccttctctactaaaagtacaaaaattagtcaggcatggtggcacacgcctgtaatcccagctacctgggaggctgaggcaggagaattgcaggaacccgacaggcagaggctgcagtaagccaacatcgtgccactgcactccagcctgggtgacagagcaagactctgtctcaaaataaaataaataaagttacgtaattcagtggtgtttagtatattcacagaattgtacatttatcagcacaattttggaacattatgactgtcataaaaagaaaccctgcactccatagctatcatattcccattcccccactgcaatccctgtgtcctaggtaactgctaatctactttctgtctctatagatttgtcaattatggacttttcacataaatggaatcatataatatttggtcttttgtgactggctttttcacttagtgaaatgttttcaaaattcatccatgttatagccaaaatcagtactttatttctttttattgccaaatacgaaaacaattctattctgtagacagaccacattttgtttatctgtttatcagttaatggtcattgggttgcttccacttcttggcaattataaacaatgctcaatgattgtaagcaaccttttcttctctctttagcttactacgtttttttaaactaaaatttgctatcaaaattttagcatctctcaataatcatactttttctctttaattatcaacaaaatattttcatgttaagctatctcttgcattcctagaataactctacttgatcatgatgttttttcttttaataatggaattataaataagtatacagtttttgtatgaaaatgtttttatttctctggagcatgtacctatggatggaattactaaatcatatgctagttctgtgtttaactatttgaaggattgaaggagtgccagattgttttccaaagtggctgtaccattttacattcctacctgcagtgtatgaaggtttcaatttctccacatcctcaccaatattattatctgtctttctgattgtagccatcctagtgggtgtgaagtggatatcttgtgacttggatttgattttccctgatggctaatgatattgaacatctatctttctctgtgcttattggtcatttgtatattttctttggagaaatgtctattcagatcctttttctgtttttaaaaaatagctttattgaggtatatttgacaaataaaaatttgtgtatatttaaaatgtataacttggtttttttttttaattaatttttttctttttcctttttttttttttttttttttaagagacagggttttactctgttgccaaggctgagtgcagtgacatgattatagctcactagagcctcaaactcctgggcacatgcaatcctcctgcctcccaagtaactgggactacaggcataggtcaccatgcctggctaattttcttatttttttacagagatgggatcttgctatattgcccaggctagtctcaaactcctgggctcaagcaatctttcctcctcagtctcccaaagtgcttgtattacaggcgtgagccaccatgcccagcctgcatataacttgatgttttcataatctgttttttaaatggactgtcttttcattcgtgagttgtaagattttttttttatatattatagatacaagtcccttaccagttgtatgatttgcaaaaatatttttcccattttataggttgactgtttactttttttttttttttgagacagtctcactctgtcacccaggctggagtgcggtgccatgatctcggctcattgcaacctctgtctcccaggttcaagtgattgtcctgcctcagcctctcgagtagctgagactgcaagtccgtgccaccacacccagttaatttttgtatttttagtagagatgaggtttcgccatgttggctacattagtctcgaactcctgacctcaggtaatccaccgacctcggcctctcaaagtgctgggattataggtgtgagccaccacgcccagctgattttttactttcttgatgattcctttgaagtataaaagtttttaattttgatggtgtccagtttattttttcttgttggcatttataaatgtgttttgagagtaacatccatggaaatccctgtgtatcataaaaatatcatttcattctttattttacattactgccttattggtaaaattatatacctgctttatttccagtcaagagaagagagcagaaagcaggctcttgctgctaaaagagaaaaaagaaaagaaaagagaaaaaagaaaaaagaggaacagaaaaggaaacaggaagaagatgaagaaaacaaacctaaggagaattcggaactaccagaggatgaagatgaagaggagaatgatgaagatggtgagaaacaaaccatctgaattaacgataaaattctcctttgtttatcaacttcattttgagtgctctttgctctagttaactctagttaaacatttgattactttattaatctgaaatggacaatgacttttatagtaaatatttgtaagtgttttgcattgtaaattaatgcagagaaacaagagggaaaacaagcgcataatttgaataaattcagttgtaatttaagtcaccttgtaaaacactgcatatatactaaaagcaatacagtgagaagtttgccacctttttttgagattcttctctaactcttcctctcctgattagaagtaaaatttctcagtttacttttagctgagattcaggctcaaggatatagaggcctgaaatgtcagtagagatgggtttagtactctcaaagagttatttattgtactgtctggcagtgcttgtagtaggcaaataattttgttctacttggattctaattctaaaatactatttgaaaaatgtcctaaattcaaattatattgtggtttgggttcatgagactagaattaagaatattaagaatattgggccgggtgcaatggctcacacctgtaatcccagcactttgggaggccgagagcggatcacgaggtcaggagtttgagaccagcctgaccaatatggtgaaaccccgtctctacttaaaaaaaaaaaaaaattacaaaattagcctgggattacaggcgtggtggcacatgcctataatcccacctactcaggaggctgaggcaggagaattgcttgaacctgggaggcggaggtggtgagccgagttcacgccattgcactccagcctgggtgacaggagcaaaactctgtctcaaaaaaaaaataaaaagaaaaaaaagaatattaagaatgttgctagtatgtgtgtcctataccaccttagacaagaaaatatattttatatttgttctaacaacaaataatagtaaatatttattaggctaacaagagcaaagattttttttgtgtgtttttttgagatgaggtctccctctgccacccaggctggagtgcagtggtgcaatctcggctcactgcaacctctgccccccaggttcaggtgatccgcccaccccagcctccccagtagcagggaccacaggtatgcaccaccatccccagctaatttttgtattttttgtagagacaagatttcgccatgttgcccaggagatcttgaactcttgagctcaagtaatcaatccacctgccttggcctcccacagtgctgaaattacaggcatgagccactgcacctggccacagtaaaagatttctttatttcagctgggcgcagtggctcacacctgtaatcccgcactttgggaggccgaggcgggtggatcttgaggtcaggagtttgagatcagcctggccaacatggtgaaaccctgtctctactaaaagtacaaaaattagccgggcatggtggcacatgcctgtagtcccagctacccaggaggcagaggttgcagtgagccaatatcgcaccactgcattccagcctaggcgacagagcaagactccatctaaaaaaaaaaaaaaaagatttctttatttcttagtgaatactggtgaaaggaaaatatgatgtaaaacactgaattattatgaattatcaaatatattctgtcagaatttgttttgagatctgtgactcagtatgatttttattctttttaacaatttcagtggagcaagaagttcccatagaacctcctagtgcaaccaccaccactacgattggaatctctgcaacatctgcaacattcacaaatgtgtttgggaaaaaaagggccaatgtggtgacaactcccagcaccaatcggaaaaataagaagaacaaaacaaaagaaacccctcctacagcacatttaattttaccagaacaacatatgtctttagcccaacaaaaggcagataaaaataaaataaatggagaacctagaggtggtggtgcaggtgggaatagtgattcagataacttggacagcacagactgcaacagtgagagtagcagtggtggtaaaagccaagagttaaattttgtgatggatgtgaattcctctaaatacccctcactgctccttcattcccaagaagaaaagacaagtactgctacttccaaaactcagacacggtaaatttttctgatttgttaactctacctgcacctttccttcttcatgcctggtacaagaatttgaagtatattaatccaagtacaagttgtgttaaacaattgaagtctaccacattatctatcttcaatattcaaaactgaaattcacccatgtcctctttatcatttgctagttaggaaatgagattattagaaatttttataggattcatagtctgaagttgaaaatatttgcatgctttgattttatctaactatgtcatttttattgattatagtctaatttttggcatctgaatccattttaatactaaaataaatgatgggttctttgctctatttctgtttttctgactcattgattatttgatgtgccaaagtttaatacgaatatttcagcgtaactctggctataaaggaatagtctcttgagtttctatcttaaaacttatcttttattgtacttgctatttgtctcttcttagacttgaaggtgaagtgactcctaattccttgtcaaccagctacaagacagtgtcattgccattaagctctccaaacataaagctgaatctcactagccctaaaaggggtcagaaaagagaagaagggtggaaagaagttgtacgaaggtaaatagaattagttccatctttttagctttcatatattttccctttctcatgtgagatggctacctagttaattaatgaataatttgaatgtggttattattttaaactgcattgccacactaaatccagaatatgctaaagcaaaattagaagcagtatgtaaattttgcatgcatattttatatgacacaagaaattttggcttttttggataacctcagttgctttttatgtagttcaaatgtaaaggctttctcttgctttttttctttctcatgtctcagtaattctagaactaaagtactaataatcaactttagattcagaatacatgtcagctcatcattgacctgaggctttattttttattgctaagtatgagctgttgatactggtttaaaatgaatatgctagcatagttattctgtgtggattttaataatatggtattcattattttaacagggtcattgcagtttagttgatgtgtaatattttgggcagatttgaatgcttatattgtgagtgatttaaatataatttttgttttcaatggcagtgtaatttttaaaattaggttctctgaaactgcagagcaatgtaatttttaactttactaaattcaattcaatattacaagagatcaatttctaaaataaaaacttttaataatttcctctttagcatttaagaaatgttattctccaaaatgtccatgaacatacttactaagacatctttcttaataaagagacatttaatttcataagctcatgtgtattcttcattttataggtcaaagaaattgtctgttccagcctcagtggtgtcgaggataatgggaagaggaggatgcaacatcactgcaatacaggatgttactggtgcccatattgatgtggataaacaaaaagataagaatggcgagagaatgatcacaataaggtaattgtgcaaaatgtatactgctagttctgagtagaaattataagaagcatacctttgtcaggtatggtataattaagaactttatttgatggttaagattacctttttttttttttttaatgtttttggtcttgtttctgtttttttttttcccttaggggtggcacagaatcaacaagatatgcagttcaactaatcaatgcactcattcaagatcctgctaaggaactggaagacttgattcctaaaaatcatatcagaacacctgccagcaccaaatcaattcatgctaacttctcatctggagtaggtaccacagcagcttccagtaaaaatgcatttcctttgggtgctccaactcttgtaacttcacaggcaacaacgttatctacgttccagcccgctaataaacttaataagaatgttccaacaaatgtacgttcttctttcccagtttctctacccttagcttatcctcaccctcattttgccctgctggctgctcaaactatgcaacagattcggcatcctcgcttacccatggcccagtttggaggaaccttctcaccttctcctaacacatggggaccattcccagtgagacctgtgaatcctggcaacacaaatagctctccaaagcataataacacaagccgtctacctaaccagaacgggactgttttaccctcagagtctgctggactagctactgccagttgtcctatcactgtctcttctgtagttgctgccagtcagcaactgtgtgtcactaatacccggactccttcatcagtcagaaagcagttgtttgcctgtgtgcctaagacaagtcctccagcaacagtgatttcttctgtgacaagcacttgtagttccctgccttctgtctcctctgcacctatcactagcgggcaagctcccaccacatttctacctgcaagtacttctcaagcacagctttcttcacaaaagatggagtctttctctgctgtgccacccaccaaagagaaagtgtccacacaggaccagcccatggcaaacctatgtaccccatcttcaactgcaaacagttgcagtagctctgccagcaacaccccgggagctccagaaactcacccatccagtagtcccactcctacttccagtaacacacaagaggaggcacagccatccagtgtgtctgatttaagtcctatgtcaatgccttttgcatctaactcagaacctgctccattgactttgacatcacccagaatggttgctgctgataatcaggacaccagtaatttacctcagttagctgtaccagcacctcgagtttctcatcgaatgcagcccagaggttctttttactccatggtaccaaatgcaactattcaccaggatccccagtctatttttgttacgaatccagttactttaacaccacctcaaggcccaccagctgcagtgcagctttcttcagctgtgaacattatgaatggttctcagatgcacataaacccagcaaataagtctttgccacctacatttggcccagccacacttttcaatcacttcagcagtctttttgatagtagtcaggtgccagctaaccagggctggggagatggtccactgtcctcacgagttgctacagatgcctctttcactgttcagtcagcgttcctgggtaactcagtgcttggacacttggaaaacatgcaccctgataactcaaaggcacctggcttcagaccaccttcccagcgagtttctactagtccagttggtaagttattaactattgctgcagttgagtttggagctcctatggcctaatctcaccttaagtggacaaaaaaagtagcaagaggtaaatcagtcacatataatgagctgctttagattctctctatgatttttctgtccctcatagtaaggaagttataccatagtgtaagtccattttcttggaattggtgtctattcatattaataaaaaaaactccagggatgtttcaaggattccaaatttacagacttaaaaaaaaaatcatagtgattgtttgcatttcttagatttaaaaaattgaagttgcaaaggtgtttaggcacaagttcataatttacattgtttaatagtactcttgtttattttaggtatagctatttgttttttatgtattttattttttatttttattattttattttatttttttgagacagggtctcactctatcacccaggctggagtgcagtggcccagtctcagctcactgtaacctccacctcctaggctcaagcatttctcgttcctcatcttctcaagtagctgggactacaggcatgcgccaccatgcccggctaattttttgtatttttagtagagacggggttttgccgtgttacccaggctggtctcgaactcctgtgctcaggcaatatccgcctgccttggccttctaaaatgccaggattacaggtgtgagccaccgtgcccagcctagatacagctatttgaagagacccagtcatttataggctcttacttttgaaagaccagtgtagatttagctgttgcttctttgaaattataaattagctgccgaggcattatgagaaatatatagacagatctgaggtcagttttggcttggagatatttggagaaccagaatctattttctatggtttaagagccaaattttagtctaatctgcactgttctgaaaaacaaattaaaaatgtggccgacccagaatatggcactattgcctcttagcatttctcttccagttggaaaactgccccatattccatgctactttgttgctaattataaactgacctatgttgtttaaaattatttgtgagttatgaatatggcgtagccctagctttcatttcagatatgtttccatttacttgtcttttcaggaaaacatagctgttatattgtatttcaaatagaaatagaagcctgcatatgactatctatggtccaaaatattctctaaattttttccattcctctctgtaaataggcatctattacaacttttcatttggggaaagtaatatagactttgagaagccccagggtgaaagaagagctcatttccagtacccaggatgtgataggaagcattaatccttgaccttccttctagggcctaggattaataatcttggccccatttcttaactgcttgtatggtttcttttgttgatgctcttttcacggatatagtttactttcctagttttcaggtaagaagtagtaataccgactgagcgtggtggttcatgcctgtaatcccagcactttgggaagctgaggcgagtggtttacatgaggtcaggagtttgagacaagcctggccaacatggtgaaactccatctctactaaaaatataaaaaatagccaggcatgatggtgcaggtctgtagtcccagctacttgggaggctgaggcacaggaatcacttgaacccagaagatggaggttgcagtaagccgaaatcatgccacagcactccaagcctgaacaaaagagcgagactgtcaggaaaaaaaaaaagtagtaatacttaagaagatgggaaaagatagagagaaactgaaaccatcatacatggtaggtaggaatgtaaaatggtacatctgctttggaaaaacagtttcacagttcctcagaaagttagacgttaagagtgatcatatgatcccattattctactcctagggaagatatatgtctatagaaaaactggcacaccaatgttcatagcaacattattcataatagccaaaatgtagaaacaaccgaacgttcattaactgacaagcagataaacaaaatgtggtatatctatagaatgtaatattttgtatttggtataaaaagaaataaagggccaggcgcggtggctcacgcctataatcccagcactttgggaggccgaggtggttggatcatgagatcagaagttcgagaccagcctggccaacatggtaaaaccctgtctctactaaaatacaaaacattagctgggtgtggtggtgcactcctgtagtcccagctactcaggaggccgaggcaggggaatcacttgaacacaggaggtggaggttgcagtgagctgagatcgcgccactgcactccagcctggtgacagagcgagactctgtcttaaaaaaaaaaaaaaaaaagaagtactgattcatgctataacatggatgaactttgaaaacattttactaaatgaaagaagccagtcacaaaagaccagatatttattttatgattccatttatgtgaaacatccagattagcaaatccatagagacagaaagtagattagtggttacctaggatgaaggggtgattggagggtgggtgatagcttaggggtgcagaatttctttttcttttttttcttgagacagggcctcactctgttgcccaggctggagtgtagtggcgtgatcatggctcactgcagcctcaacctcctgggcttcaagcaattattctaccttggcatcccaaagagataggattgcgggtgtgagccaccatgcccagcttcagagtttctttttaggataacagaaatgttctaaaattgatgtggtcatgaatgcacaattctgtgaatatacaaaaagctactgaatagtataactttaaatgagtaaattgtatggtttgtgaattaaatctcagtaaagctattaaaaagtacatttatgtggcatctacatttaggtccccaaaatgcacatcatgatctttaaaagctatcatgattagctgggcatggtggctcacgcctgtgctgggaggctgagttgggtggatcacttgaagtcaggagttcaagaccagcctggccaacatggggaaacccccgtctctaccaaacataccgaatttagccaggcatggtggtgggtgcctgtaatcccagctactcagtaggctgaggcaggtgaatcgcttgaacctgggaggcagaggtttcagtgagctgagattgtgccactatactcagcctgggtaatagagcaagactctgtctccaaaaaaaaaaaaagctatcatgatctttacaaaagactgacagatttcactgtaaaaatattgacagtggccaggtgtggtggctcacacctgtaatttgagtactttggaaggccaagtcaggaggatcacttgaacccaggagttcgagaccaccctaggcagcatagtgggaccctgtcttgataaaaaataaatttcaaagttagctcagtgtgggaccgggcacggtggctcacgcctgtaatcccagcactttgggaggccgaggcgggcagatcacgaggtcaggagatcgagaccatcctggttaacacggtgaaaccccatctctactaaaaatataaaaaaattagccaggcgtggtcgcaggcacctgtggtcgcagctacttgggaggctgaggcaggagaatggcgtgaacccgggaggcggagcttgcagtgagccgagatcgcgccactggactccagcctcggcaacagagcgagacaccctctcaagaaaaataaataaataaaaataaattagctcagtgtggtggtacacgcttgtagtcccagctactcagcggggctaggcaggaggattgcttgagcccagaggtcgaggctgcagtgagccatgatcacaccactgctgcactctagcctgagtgagagagcaagaccctgtctcaaaaaaaaaaaaaaaaaaaaaaaacaagaagttattatagaaatgattcatttcaataaaaaaagaaagaaatgattcatttcctacttacagactttttaaagccacattcagtattctcactacctctaggttttgctaacatctactttggttagcactagaaaatttaattttttttgtcaggaaagcacagtaataaattgcctactgttgcctaccacaataatgaaagtctgaaataagtaggaaatgcattaagttacccacatgtccagagtaggcaaatctatagagacagaaagattagtgattgcttagaaatggaaatatgaggctgggtgccgtggctcacacctgtaaccccagcactttgggaggccgaggcgggtggatcatgaggtcaggagatcgagaccatcctggccaacatggggaaaccccgtttctactaaaaatacaaaaaattagccgggcgtgatggcagatgcctgtagtcccagctacttgggaggctgaggcagaagaatggcatgaacccgggaggcggagcttgcagtgagctgagatcgtgccactgcactccagcctgggtgacagagcaagactccgtctcaaaaaaaaaaaaaaagaaatggaaatatgagggtgaggacccagtgaatgacaggtaatgagtatggagtttcttttaagggagacaaaaatgttctaacattgattgtggtgatggttgcacaatcctgtgagtatactaaaatccaatgaattatatactttaaatgggtgaattatatggtatgtgaattacatctcgaagtcattttttttaaatgatggggaaatcaaagtctgaaaataagacctgcttaaaagaaattttgacagtcgatgttgatattaactactttttcctgaaataataaaccataatccttttccagaccttcatcctcttttcctaatacattttccagagaaagcaatggaatttgagaagatggctaagttcagatttatacaaactagatagaaactttgataatagtttgcaactgttgatattttctatcagatagaatactgaaattatcctcagtagtaggcttttcctctttgtgaggaaggaaacattggtagattttgttacttatcttctatagaaaatgactatagttatacagatgaaaagctgtactttgactacaaaagggaatgcaggagttattgttgggtgctacttagttacagcatactcccatttcatatcccctccagttaaaagctttgagattcatctagaacattactccaggtgactgacactcttaaacattgagcccattttcctgtatctagtgctgtttggcgatattcttctggactgtaaggaaaaagtggatttggccatacagtatcacatagatggattgtttttgctgtggtctatgaaaatgagccacatgctatcttttatttatttgtttggttatttttacagcttatctcactttggtggaagtcttcttgggctttcaattttaaagttttagctaattggatgtcttggacctgttttatttcagggttaccatccattgacccatcaggcagctccccatcttcctcttctgctcctctggcaagtttttccggcataccaggaacaagggttttcctgcaagggccagctcctgttgggactcctagtttcaacagacaacatttttctccccatccttggacaagcgcctcaaactcatgtaggaatcctggaggaactcttcccaaagagttttgaataagttattaaatcatttatttcagttacaacaccatgttgtaactttagtaaactaagtggtatacagatgcccaaggtttgttctgtggtcatgtgaaaaaattgtcagtcatttttagcatagaaaacttgagaattattctttcaagccaaaaatgttttacagtagaacttggatcaagaaaagaggtactaggctgggtgcagtggctgacacctgtaatcccagcactttgggaggcctaggcaagaggatcgcttgagcccagcagttggagaccagcctgggcaacagcaagaccctgtctctattaaaaaaaaaaaaaaaaaaaaagtaccgcaagtagttttacaaaaggaccctttggaagcagtgttgtaaaattatttcttaaatctggaaagaagttgaatttttgtatatggtcagtttggtgtgatttctcatgtatttttacattttatgaaactattgccttttataagttaaaatattcgtttgttctattgattgattgattgattgattgagatagagtgtctcgctctgttgccctggctggagtgcagtggcacgatcttggttcactccaccttctgcctcccaggctcaagcgattctcctgcctcagccttccgagcagctgggattacaggtgcctgccaccacgcctggctaatttttatatgtttagtagagacagggtttcaccatgttggccaggctggtctcaaactcctaaccttgggtggtccacctgcctcagcctcccaaagtgctgggattacaggcgtgagccacctgcctgacccctttgttctatttatttcaatgtttagaacagatgaagtatgtggaattgaacggaattggatttttattttattttaatgagcatcatgaggtagtcagtgagtattggcttttttgacaaggaaaattacccaaatcacccaagagttccattaagaaacaaagctgtgaatcaaaatcgtacaatgctttgctaacatttgaccttatttccttatagaaacaaaaagggctgtagaaagggaaaaaagaaaagactaacaagtatagagggtcaccagatgttttctagaaaatatgctaggtactgtgcaaatattgccacattttagttaattttcaaatgtggctgggcgtggtggctcacgtctgtaatcccagcactttgggaggctgagacgggcagatcacctgaggttgggagtttgagaccagcctgaccaacatggagaaacccgtctctactaaaaatacaaaattaccaggtgaggtggtgcatgcctgtaatcctagctacccgggaggctgaggcaggagaatcgcttgaacccagaaggcaaaggttgcagtgagccaagatcacgccattgtactccagcctgggcaacaagagcggaattccgtctcaaaaaaaaaaaaaaaagtgacagtaatgttttgagcagattatttagagctagaataaaaacaaatgtggcctgcttcctttctagcattgtttagttcaattgggaaaacattttttagactgttgtatacttattataggcagaaatcgtgtaggataatgtctatagaaattatgttttatttgaatgttcttttaaaatgaaaattttctttacagaacttatgttgtggaatagatctttccaacaaggtttctcatattcttatagttttttatatgtaataaaacaatagagaaatattttgccaccaggtgactctcctattccatctgtttcttcgggatcatcttcacctctttcagccacttctgccccaccaacgttgggccaaccaaaaggagtcagtgccagtcaagatcgaaagatacctcccccaattggaacagagagactggcccgaattcggcaaggagggtctgttgcacaagccccggcggggaccagttttgtcgctcccgttggacacagtggaatctggtcatttggtgtcaatgctgtgtcaggtacaattgccttgctctctctctggagggatatcttaagtaagctgtaggtttgccattaaaacttagttccttagaaaaaacaaacaaaaaaaacttagttcctatgtttaacactcaattagggaagggtgtttatatctttgaggagttcagtccaatttcagagtctggaatattggttgaggtaatacatagagttaatcagaaacaaaagattcaaagtgtgtgtcctttctctcttaaataatcatttgagttctttcagagagtacttaatcttttaaaagacagggtaaagtggagtattcagaggactttacctagtttttcaggaactggttttttttggctagcaagactgtgataaatacgctttgagctcttcagaggaaagatttcagtaacatttggtcatgtttggtaataacaatggtaatgttttgttgttttatccaaataaatttaaaactttgttttcaattattctttccagaaggcttatcaggttggtcgcaatctgtgatggggaaccatccaatgcatcaacaattatcagacccaagcacattctcccaacatcagccaatggagagagatgattctggaatggtagccccctctaacatttttcatcagcctatggcaagtggttttgtggatttttctaaagtgagttgacaaacatcactgtaacttgattgacactttgtcagccaatgtagtcacattaaggaataccttgtattgaaataatgctcccttttgtttctgtggctttgctagatcttttgcttaatttcaggagtgcacagagttgtccacagtagtttgtcctgaagatgtccccatcccccgaaaacacctgagggatttgggttttgccactttgtgctctgctactacagctttgagggaggcctctacccctcttaaaagctggccatgagttcactgatgctttcttgtctgctctgacagctttatgtcggcaatcaattatgtagagttcccattttcttcttagctcaagcttattcatgaaactaaaatatgggaaagttgaggttatttttatcaaatatgagaaatttcctgatgatttcatattggatttagtttctttctctctcttgttttttgttgaaaagctttgcagatgcagataaacattttgttttctcaacactgccatactgtacttataggatcttttggagttctttaaatgaggaatattagagaagtctaagctggtattatgggatttatagtaattttataatttatagtaattttaagattaaatcttttttcctgctgttttagggtctgccaatttccatgtatggaggcaccataataccctctcatcctcagcttgctgatgttccaggaggccctctgtttaatggacttcacaatccagatcctgcttggaaccctatgataaaagttatccaaaattcaactgaatgcactgatgcccagcaggtaaaatgggcttaatgctcttttgttttttagatttgtcacatcattctttttgttttgtgagaagtataagtactgaatatcaaaagtcataattgaccatttcgatctggattgctttttcaatatcaagatgatgctactgaacactttatttaatatatgtgtattcttcctaggcagaaacagtgaattgccattgcatttatatattcattttgtaactgtctaaagattcctaattagaaattccaatttttcctcccccttttcagatttggcctggcacgtgggcacctcatattggaaacatgcatctcaaatatgtcaactaagttagaaggtctttactctttagccttgtttaagaaacctatgaccttggaagaaccatggggatttttttttaatgtgcctaagaaattttctctgaggctttagcaatggaaatttgattgcccattgtataagaacaaattgatttcctatccacctgattatgttctctggttagtttagccattttgaacttaagatcatatgaccttagtgcttttggctaaacatacagaatactacttgtatgcagaagagaattagttgattacatgtttcaaccttttagggtgataaatacatgtataattgtttacatacttaaaaggaaaaagttgagtaaatttcttgtcatatagtggctctacgtaatgtagcctgtattaatgtgaaatatttaccagaatattcaataaaaagatgaacagtctttagaagtggggtgtgatcctttcagtggtcatgcaggtaccactcaatccacattatattgaaccagatggttaatactatatttgtaacaggcttctcacatttaacacttgagtcccttcttagactgccttaaaaaagcacttttaagactatttacctatttattctgtgttaaacattccttgttcccttgttgtcttccataatcctttaacatatgagaaagtttcaagctctggcaatgtgtcttatctgactttagctagcagataggccactgataggttttttctctatggatcatgagaatgtcaataagaacaattggatttaaatcagatgacactaaacaaatgtagggacacccaaattatcaacttcaggttccttctgtgcttcctgaccttttttatctgaaagatttgtctggttatagatattttaagctttatatgagttgggacataaggaggtgactcctgtcattctgttgtattattgaatcagctgagtaatatttataaatatgtgagtaattccaggcttagttccatggccctaagcatggagagtcaatatgtttaacaagctaaacagaggaaccctggaatgggctgctttggccaaaccataggctatgccgagaatcagcatagagaaggaaaagttatcccactgaaaagtatagtcatcaacttatttgtgttttaatatagctgaatttttcctggtcagtataggcaatacagaaaagaaaacaagaaaatgtttggagctgatggagaagccaaaactcatatcaaggcaaagaaggatgcacagagaaagagtagtaactagggacagaactatattagcagcacctttctacacttatgccaacaggaattcttaattttctctgcccaggtcctaaagccaggaccacatcagacacaccatgtttgttctgtgtcagatatacctgcttctttaatcttctatatcatcttacatatgagaaagcttccttaattaagcttatgtcttatgttttgttttgaatggattttgaaagtgttgtttattgaagctactactttgtagtgattgataaccacatcaagtatcattaaggggccccttgacctttgtgggggcagttgggtggggcacaaaagactccttggatcacctgtgtatcttgctgtttccacttaccattaacagcaacaagaaaaatcacctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttaggatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaagctttatggccttaggcaaatcatctcacctttctgggtttcacttttctcatctgaaattgaactcaagagtcttctagttctaacacaggatttcttcttgtgaatgagaatataagatatggaaatatttgaagccattagattgtttacagtgctgagatttgagagcccctagcattggttctgataaggaatcgaaataaatcctgccattattatgggggccagtattgagattttagtggaggcagaagaagaccttgcacatctttagtgagccttcaagttgtgaagaaacatcctgctaaggtatagatcaaacccagtgaaatgaaactataggaatgaaactacatcatcaaggtttctggacccacttatttcaacttgtgttcaatgtaataaaattccgctaccaataaaattattaatgttttaagaccctttaaacctattgtggctacagtgtgctgacttgcccttttataggccagtctgcttccttcagtccctgctctcaaaggggaaatcccatcacctcagctaaccagaccgaagaagagaattggacggccgatggtggcctctcctaaccagaggtaagaaatttcaggacttggaactacggtttccctctcttcatgtagattctggccaagtcctccccacaatccgaaaactagtgcaagagagaaccatccttagtttaagttaacttacagaagtggaggccgggcatggtggcttacgcttgtaatcccagcactttgggaggccgaggtgggtggattatctgaggtcaggagtttgagaccagcttgggcaacatggtgaaaccccatctctactaaaaatacaaaagttagccaggtgtggtggcatgtgcctgtaatcccagctactcagcaggctgaggcaggagaatcgctagaacccaggaggtggaagctgcagtgagccaagatcacgctactgcactccagcctgggcaacagagcaagactctctctcaaaaaaaaaaaaaagaaaagaaaagaaaagaaagggaaaggctggctacattataatttcaagccagagagaggagtacttagtatatgtggttccttcccactgtttaagacctttggggccgggtgcggtggctcatgcctgtaatcccagcactttgggaggctgaagcgggtggatcacctgaggtcaggagttcgagaccagtctgggcaacatggtgaaaccccgtctctactaaaaatacaaaaattagccgggcgtggtggcatgcacctgtaatcccagctactcagaaggctgaggcaggagaatcgcctgaacccaggaggcggaggttgcagtgagctgagatcatgccattgcactccagcctgggtgacaagaacgagacttcgtctcaaaaaaaaaaaaaaaaaagacctttggaccacattgtaaatccaagaaaaggcaagcaagcttgtaggaaaacagcttctgaatgaacatcttgttctctgactagcaagaagtatttctaccaagacatacaactggttatgatgtcttcccagtggaccctgccccctatagtgaggggctctggtaatgctgcattttctatttatcctcagtgatttgtcatttgcaaacaggcaggttcatgcgcctccatcctctcctttaggcaatgggtgagagaaaggtggttttaagcatcaaaaacttaagtgtgttaagaccacctccaataaaaggcatgaccctgggcttcaacacctaatttggaaaagatcatgaatcagacgatcttgtttgcaaacctattttgtgattacttttcacattctgttttatcttgatggtatattaatgtgaatccaaagtaatttgcctgataacagagacctggtatttccttataggcttaatcagatctctgggggtggggcctgggcataggtattttttttaaacacttccatattctaataggtaattagttgttttttgttttttgttttttaatgagacagagtctcactctgttgcttaggctggagtgcagtggcgccatgttggctcactgcaacctccgcctcctgagttcaagcaattctcctgcctcagcctcccaagtagctgggattacaggtgcacaccaccacacttggctaatttttgtatttttagtagagatggggtttctccatgtttgccaggctggtcttgaactcctgacttcaagtgatttgcccgcctcagcctcccagagtgctgggattacaggcgtgaaccgccttgcccagccagtaattagtattgaccctctgatttaaattcttgtttcttcatccagattgcatggatgatgaatctggctttctctctaaagccaattacctattccccagcccttacagcacacagtgactccagaagagttagctgcaagcagtagtcattatagtagtagtaactgtggctattattttgtggtagagattagtagaaggaagacctcacttcgacaatgaccgttcttgaaaacttttgatacttttctcctgattttcctatttccgactcatctttctcagtctcttttggtgaattctttttctctactatcttttaaataaataaatgttgatgtgcccaggcttctacactgtatcttctccccagatgatctcatcccacatttatttatttataaatagagatagggtcttgctgtattgcccaggtcttgagctcctgggctcaagcggtcctcccacctcagcctcccaaaatgccagaattaacagatgtgagctaccgatcctagcccatccccacactcttgaatttcacaccacccaaatttgagccactaactcagagttctccccatggcttcactatatctagcttcctcctgtgctccatctgaacacatattattcattccctcatataagatatgctgctcttcttgttttccctatcatattagttggtgctactagccaccaagactctcaagccaaaagactgaaaattatcctagtttacactttccctcaccccactcttaatcagtcactttattcttcctctgtgtatctgaatctcatccacttctctccatcctcacagccatcgcccgtttgcccacctggtttcactagactggactctaccctcaaatctcaccatcctccaccctattctcccattccccctgtcagacacttcctcacgttgcataaaaggttagttatcataaatgattcactacaatctgttcccaagctttaccctccagcactgctaagacacttcattttggcatgcaccattttgtaagatactcaaaatccttttcgggacaataaaatatacatacccttgatacctgaagtgtgtttctgaggccctgaagcgtttgcattactgtattaaaaattcacagttgcagtcaggcccggtggctcatgcctgtaactccagcactttgggaggccaagccaggcagatcactggagatcaggagttcgagaccagcttggccaagatagtgaaacctgatgtctgctaaaaatacaaaaaattagcccggtgcggtggtgggttcctgtaattccagctactcaggaggctgaggcaggagaatcgcttgaacccaggaggcagaggttgcagtgagctgagatcatgccactgaactctagcctgggtgacagagcaagactccatcttaaaaaaaaaaaaaaaccagccaggtgtggtggcttatgcctgtaatcgtagcactttgggaggccgaggcaggctgatcacctgaggtcgggagttcaagaccagcctgaccaacatggagaaactctgtttctactaaaattacaaaattagctgggtgtggtggtacatgcctgtaatcccaactactcaggaggctgaggcaggagaatcgcttaaacccgggaatcggaggttgcggtgagccaagatcatgccatttgggcggcaagagcgaaactccatctcaaaaaaaaaaaaaaaaaatccacaactggctgggcacggtggctcatgcctgtaattcttgtttcggaggatgcctgtttgggaggatcgcttgggcccacaagtttgagaccagcctgggcaacatagtgagaccccgcctttacaaaaaatttaaaaattagccaggtacagtggcatgcacctgtggtcccagctattgaggacactgaagtgggagggtcacctgagcccaggaggttgaggctgcagtgagccatgattgtaccactacactccagcttgggtgacagtgagaccctgtgtcaaaaaaaaaaaaaaatccaaaatctcacccagaccaatactgtatcagaattatcattttaacaatatctccagatgatttatatgcacattaaagtttgagaagctggccaggtgtggtggctcacaccagcactttgggaggccgaggcagataggttacttgagctcaggaattcgagaccagcctgggcaacatggtgaaaccttgtctctataaaaaatccaaaaattagcccggtgtggtggtgggcacctgtggtcccagctactcaggaggctgaggtgggaggatggcctgaacccaggaggcagagtttgcattgagcggagattacaccactgcattccagcctaggcagcagagcaaaaccctatctcagaaaataaatagtttgagaagcaatctttttttaaatgagtgaagaaatcagacctaaggagaaatctgatgaagccagagctgagttaatattgataaatggatgcagtcaggtggtctatacttaatttttggtgaggggaagggacagtggaggcagtattgattttgaggaagccaaacaggacagcctgatgaattcaagatttccagcatatatacatcttcaccaatcccaccaccttgctccagcctgtcatatcactgtgtctacataaaaaaaaaaaacaaaaaaaaaactccaaggccaaactctctgacctttctttccttctaaagaccaagccctcctcactagccccctgcccctccttagttaactggcaaagagatcaaagggcaggccttctgactggtgatgcctcagctgtagcccccaaacttgactcatccttttattagtccaggtaccacttcttcagaaagatgaccagccctcactgaccttccccttcctgctgtgctccaggccatcaaggcatgtgtcacccaggctggagtgcagtggtgcaatctccgctcactgcaacctccgcctcctgggttcaacctatccttccacctcagcttcccgagtagctgggtctacaggcgcatgctgccgcacccggctaatttttgtatttttagtagagtctaggtttcaccatgttgcccaggctggtctcagactcctgggctcaagctatccacccgccttagcctcccaaagtgctgggattacaggccgtgagccaccgcacccggccttgtactgttactgtttatgggaggcagtacacagctgggcttaagggcacagtcctggaatcagatgcagtcagatttgaatcccagcttcccttcctgcaagatgtgtgactttggctaatcatagtgctttactatccaaaagttggcaaggaatgggtgaactaatacaggataaaaacgcttgccctacttcacctgcccccagctcccggctataaacagtaaatagctgagctgctgcagcactcaggcaggttggccagcgctgggccagcaggaactggaagctggtgtggggcctgggactttggacgcatttccagctttctctgaaccgggctggcttcctagcagatagggcgggaccgtcgggttgagtgacggccggtggcccgccctgggcgtgacgttgttctagtgttgttgccagcagctgcacgtggtcggctgagtccgcctcagactcagagctgcgctcctcgacctcaacgccaggcggttactttgctgctcctcccgctcgctatgtcaacgtccactagctgcccgattcccgggggccgggaccagctgcccgactgctacagcaccacgccggggggcacgctatacgccactacccccggaggtcagcgggccgggcaggggtccgcaggctgcggacatattagcgcgtgcgtgttgttgcggggcgggggtaggggagggacagacctaagacttgtccgcaggcccctctacaggttgtagctttgggggagaatgtttggagcggaagctcagttcccaaaaacttctaagtgatgcaacaaggccatgagcctagcttccgggtgtttgggctgtaatccttcactgtggcctgggttcttggcgccttacacacgctccttacccctcgcgactttgcttcctaggaataggggccagggccccctactgagcgtgacctcagccggaagcaccgggtcttgagaagtggagtagttagaacagttggggcagttgctccgtttttgtgctgctggctggcgtctgtttggttgggcgagcagcctgggatcacgagctgctgggctcccgacccagggattcctgccacgcggaagcggaggggaggaacagggcaggaccctttgaggacattatgcgggccaagttcctctgagctagtgtgaaccttataggacctgggaggggtcaggattagaacagtacgtttctcctccctgcaggagatagcccaggtaacagcactgggtggaacccttcacaactgctatttcacttcttgaaccacctgaggctgttagtctaggtctcaccttcactggtgagaccaaagcagaggtttcagagtggtagaggagcagcatgaagtacctgaactcaaagtttggtgttcctcttagagccaagatctgaagctctcccaaacataaagcccctgcctataccagctgggatgccccccttgctttatacccacatcttggttaggtctggaagattttaagcactatgaaggcttgtctgctgagaacctagctgggcttcagagccgatgtcctttgatacacagggaaatttgacaccaccctcacctccaggccccaaaaggcctgagtctgggaccccagtcacctcggtacccaagctcctgactcttacctcagtcccaaccccttgacaggcaccaggatcatctacgaccgaaagttcctgctggagtgcaagaactcacccattgcccggacacccccctgctgcctccctcagattcccggggtcacaactcctccaacagcccctctctccaagctggaggagctgaaggagcaggagacagaggaagagatacccggtaaggaaagcaggaattaagaattgtcccagcctttgagttcaaatgccactgtgacacagtgcgggggttcagttccaagaggggtttctgcactgatgctgagcctgcagatcctcagaccagcaacctgtcttcctgccttttctctctccagatgacgcacaatttgaaatggacatctaatccagtgcagatgacctggcatgtggagttacagagggatccctcatgccactgctgccaccacctcttcctggggcatccaaaggccagctggcctcatctaatctggaagggagtgacttgttagttccaggcctcctttagttctgaggcagctagaccagggataggagtgggcaacttgccaagcccttaactctacttcctcttcagtctgtggtactcctcctaaccctaaaccctctatgctcaggggctggaactggggaatggagtaagtcaccttctgactgcttagtaaacattcaaagaaatgccttggctccagtgttctcctcaatgctgattttctcatctcagccacacagctgaaggccctggcaggcctggttaagctcagaggcctcagatcattcccagctcccaccaggcccacttccagcagcaattagaacctgaggcacgctacagtggcaggttacatgagcctccaaaccataaacagcaatagcttggccactgccaagggctgttcctgtcttcccaggaagcagccttcctggaaccagggccccccagcagcccctcccctatccattccaaagcaggactcttggaaaagaggtgctgtcccagcctatagccatcctgtctctccctgtgccttttctgcttcccacctctaagcaccagttcctctattccaacaccaaaaaccttgtacccttctcacagcatgatagtccaccaagtacctctctcaaagggttacaagagaccttagagttcacactgaaacccaaaatgaggcagcagtttgtttggcaagtcagagttacaatccccaatctcagtaatctggtctttttctccttcgatttacacagaaaaccccactcaatgtggttctaatctctgtaacagtagtatctcaagggtgatacagtgcaaataggactgtctttccttttgttgagggaaaagtctccccgttctatttgagtctgttctcatgctgaaatgaaaccatccaaacacagctgctccgcccagcacaggatgtgctttcagtctactttgggaaaaagtggtaggcagtagtctgactttacccagcagatcccttcctgatgaatggagaagggagaacagaggtttgcagatacacagggagcagggcagtcgaggacaccagaggggactagcttggcaccggaagggttcatctctcctacccaaggcccaccgcagagatgtttttattgaaatgcatgttatgagtaacacatgaactccctctggcccaggtgggacttcttccctcataggtgggtcaggcccagtgggacagtcttggtggtggtaagaagggagccaagtgacagaaggtctccaaggcataggagatggtgtccggtgagtctggggaaccgaggattatgaagcctgctggaagcctggtatggtatggttcttctcagctgtggctgcagatttctcttcattggctgcctcctctgaaaacagactcctcttttctgcaattaatcttttaactcctaccatccactgactgacctcagtcacatggtcaaccatgagggagcggtggatgtcatctgctgcgtcccaccggtggcttgaaagctctgaagagagacgggggttgagcaagcagcctgtggtacaagagcttccatgcctcccctcccagtcaatcaaaatctcagcacctgctccagcatagccaaccacagcaggaaagggatttaggctataccaaagaacccacccataccttgcaccagtagagccattctcttctttacaggtattgacaactttcctccagcccactgttcctgcagcagtgccaggcgtcggctgatgtcatcacatacctgcttctaagagacagaagcccccctccaattcagtgctgccagcccaatgaggggaggagaggggaagacagcaccacataggaagcacctgctttctctggcccacactttagaattctggttctttacccaaagattagaggccccactgagaaactgatgaaaccttcctttccctgctgtcttcttctgacactgcctgatgtttcattgaaaagtagaggtcattaaacaggaattctctcatcttcccaccaccagtcttcctaacccacctcctactatgactagaattctaaaatttcaggggcttctcagactctcagaagctcatcctgtagcgttacttcacaaaaagaaaactaagcgccaaagaggtgaaatgaccatgctactttccctttctt

SEQ ID NO: 14179 - DNA, 340380 bp, Human
  misc_feature (1)...(340380): n = A,T,C or G
tggagaaaacagacacaaagaatttatgcacaaataggaatcaagaagggaacttcaacaatagtctagacaagtttgcagcaccctgaaatgcaggccaggctctctggtacagctgaactggggaatgtggccttgaccctctcgtctatagaattagcaggaaaagggggaagaattcctctcagcacttttgtctcaagtttaaattcattggatctttattatattgtacattctttggtcatgttttaggtgaagtcttagtatctttaatatcctgatttcttcttatttgattctctttagtttggtagagaaaacagtggagtggggacagcatgatttgtagttgtcaggtctaaatttgaatgccacagcaaaccctgaccctgatcaagttattgagcctaccttggtcacaatttttatgtctatatattagaaataaaaatatttacaggattattttgaggaataggaaatttatagaaagcaactcacacatagtaagtgtgcaataaactgtagcttttatatctcaagtttattgtcccttctcaattgtagatctctttacattcatatttggtgagcacacttcagacaaacaaaaatcaaaattatgaatcaaatgacctatgggtgtataacacaaaacattttaggttaggcttttcctaaaaccctgaatgctgaattttttgtagtagtgcatggtacattataagtgcttggtaaatgttatttatgtagtagtatttattttcatcattatttcataaacaaatttaagctttctctgcatatattttgttttaaattatgcaaaaatgcttatattctctccatgtcatttagatttctaagcttgaaactgtacctggagcttgggctaaaataagattactaaaaaattgtcatgaacaggcaagaattactttagcattgattgtgtggaattctattcagattgaaatccaaaaatacctgctctgctcagaagtttatgttctcttactatattatttcatgtataattctcaagcttttactcttgttttccaattacatgattataaattaatgtttaaagataaaacacatgtatcagtattaagattggtttattttggccgggtgtggtggcacacgcctgtagtcccagcactttgggaggccaaggcaggcggatcacgaggtcaggagatcaagaccatcctgactaacatggtgaaaccctgtctcgactagaaatacacacacacacaaaaaaattagccagaggtggtgacaggtgcctgtagtcccagctacttgggaggctgaggcaggagaatggcatgaacccaggaggtggagcttgcagtgagccaagatcacaccactgcactccagcctgggtgacagtgtgagactccgtctcaaaaaaaaaaaaaaaaaaaaaaaagcagattggtttattttatcagagacccagagaaaaagaggcttaagtaagatagcatttaatttttcctaatgacaagtttggaagtaggaaggtcagggctggtatggtagttcagtgatatcagagaccctggctcctccttcatcattgctttgaattcttaacatttaagtgtctcatggttcaccatggctgcctgagctccaaacatcatatcctccatccagctaataggaaataagaaggaccaaagatggtgagcccctgccttttaagaacacctctcagaaactattttggacatttcatcttatatgccattcatcagaacttaggcacatggccacatccatctgcagaaaataatggaaactttcatctttattctgggtagccaaatgcctagccaagatttagggatttattatccaggaagaagaggagaccaggtggtggggacaactgggaatatctgtgacctttgggattgacctgagcctttatctttcttctctctcatgttttcttttgtcttcttttctaaatagatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaattcacaccctcaacacacgatcactaacctgtcaccatacaccaatgtcagtgtgaaactgatcctcatgaacccagagggccggaaggaaagccaagaactcatagtgcagacagatgaagaccgtgagtacctttgaatgatatgtttgtgtaaaacatgttctttcaaaaaacaacttttgtttcgagatctttgctgtgcagatggaagaaagaactacttattttgttgaacaacacaaatgtgtatctgtactctgtattcttaagcgctgattgaaagagggaaaagggagtagagatatagaaatgtcattctttattactcatacagttacttttctatatataatcattccatattgctctcaatagttcttcaagttttatttcattgggctgaaaaattgttgttttgggtattagattatttatataaaatcattggactgaaaaattgttgttttgggtattagattatttatataaaatgtttacctaaatatatttaaatggcattctgaaacattttcctagttcagataaaatttcagcactaaatagaggctgcccttgcttttcaacacagtcttgagaaactgtaagttggtggtcatgaaacaggtcatttttctccacaggaacaatgttgaaaccggatgttactttaataaacaactactttacaaataaaccatgcatgtcaccagtaacgcatcaaaaaagcaaatatacaggaaacctccatagtaatttaaaacagtaaaattatgccttgaatctcaatgcgtggatataaatgtttctttacacagatgacacagggaacccttgtgtgtaatgacatattcatatagtacataaaatacaatggtagtatatcataaatttgacctaaaaatcatttttccggcatcaaaatgaatgacaaagaatgtaggaagaccattaaacgaatgaactgactattcctaagaaaaatagttgtttagctttttgtttcttcatgtaactgataatgtaattttgaccattgattaaattgtgagttgaatgtttagactactttatcgtttcatttaaagagctaaaaaagtatttttgagtgtttctacctacccagcacctgcgtatttttgtagaagaaaaacatagaaatagctggagtagatgaggaactcactgcacatcctttctttcctcttttattgtccctcaagtcctgcttgtgttggttcctctcaagcagttgtttgagagggagtctaagtttgatggaagccactcaggcaaggctgagaccagaagctctatttctgtttcttccaactctctctcatctcccagaagaggagaagatggtgtccacattgtcatcaagttatggctggctccttcctgccttacatttctctattgactctggtcctaacatctgttgtttctacttccaaagttttagattgttcttttctgtcaatttccattggctgtattcaaatccttattattttatgctgaaatttctataattgtttctaccttttctttgtggttccagcctttttctattctaatgtccccctactcactcactcactaatcttaaaaatgtattttcatcttggctgtctctctacaaaagtcttgagtggctcttcacttaatcttcattccagtgccttggctgtcaaggtcttctgtattcttggctcatattctaggagtaataacttctccttcacagcatcttgttctgcaaagccatccctgagtgctggtccctgtgcctgctctgtgcatcctgggcttcccatcgttgcctgattgttctccttggccagtcggggcctctcctggccgcttctcaagctcgcctactctgctaccagctgaagctctcctcacatttcaggtccttcacatagctgtctccagctcttcagtctgtgttattcacatccctctgaccttaattgtacttcataagatccttaactctctgaccctcaatttcctgatctgagaagtgagaataataacaattcttagatacattagggatagaagaaatttatgtggagagctggttgtaggctgtcagaaaggggcctttcttagtattgtaatgattcatagccactcatgattcttctttgctccctcattatgttatttgtatgtatttttttctttttattgtaaactacttgacaagaagtactgtctgtttttcttctatagcaataggcgtgatattgagtaagtaataaacaccccaaaataccttaggtctttaaatgaaataataaagtattgttgataagcatttagttcatgttttaataaacaataatggttacatcaatgagagaaataaaatgcagtcacttccagatatatattgctaaagcatgaacctattgaacactatgggtttcaaattgagaactgtcatgagctaggaattctgttaaattccatcaaaacatgaggacagaattactttgtttgtttaaattatcttgctagtccctgaagctggagcatgcattacttccaaataaaaatctattgttttcctagcacactagcgtttcattaattagaaaaaactttaatttcaaattatattttgtaacccctccaaaaaaaatacttcagaaaaggcagagagaagaaagaaatagaataattgtcaaacagtatccagtttgaagagaaaagaattggggagtcactttgtttatccatcaacaaaagttataattcattgaacattgtgagttttattatagtataatacttttattgaaatacagtttttttcatcagaaattgtgtgggaaaaaatttacctttcattaatgttagtagaatcctatacagcccagggataagttgtacaaacttaggtattatggctttatatcccagatcctgaattcccagagcttctaaaaataggtactagacctaagttactatgaggtactatcttccgtaacttaattagtagtatattaattatttattcatattgttttaatttacattgtctttctctgaccttaaagtgattatctgaatccccattagggtttcctgtcaactattctactgccatttaccacagggtcaccaccagtacattctaataagtccatccttctgagatatcctcttcctaacatgattttgaatacctcctgtgtcatattactgttagtattttcttttatacgaattgaatgaaacaaatatttgttttgtctaactcttcaccttctttacatctgcacatggattaacacatattttcaaataagaaatatcactggctgctccgcctatggagtagccattcttttattcctttgctttcttaataatcttgctttcacttaaaaagaaaaagaaatattatcacaaaatagagtcactcatcttagttatcttgatggtgtgagaaaactgatgatgtcatcatcataaacactttcaaggttaagaggaagagacttagtcgagttttctcaggcatggcctgttttagttcaacttctaattatgatgaacattttagtctcagagcttggaattccagtgttcttagaactcaccagtgttgtcatttctaatgttttttgttgcttcaatgtagtcgtatataaatttcttcaacataggactaacaattattttcatatttatgtgctatttagggtttcaatgttaaaattaacttggctgggtatagtaactcatgcctataatcccagtactttgggaggccaacacaggaggggaccacttgagcccaggagattgagaccagcctgggaaacatagtgagaccctatcactacaaaaattaaaaataaattagctggcatgctggtgcatacctatggtcccagctactcagaaggttgaggtgagagatcacttaaacctgggaggttgaggctgcagtgtgcaatgctagccccactgcactccagcccggatgacagagcaagaccctatttccaaaaaacaaaaaatcaacttaatccaacttcattttaggaatgaggcaaatgtgacctaaagaggttcaatgatttgtccaaattgcacaatttaatcatttattagtcttaagtcagaacccgggcctcccatatgaatcagcattttttttgtgccaaacaacacttgactttaattggaataactgtaaatgttctacatttatatataagtagcctctaatctcaaaaaaataggcatactatctatgagtccttttgaaatcctaggcaggctttccaatctgtggtagtcttagcaatcattaaaaaactgctcatatcctctcacaatctaaaacattttttccaaccccttttaaaaaagtttattgagatatgtttgtccattcaccatttgataaatatttgggttgttttcactttttggctattatgaataatgctgctatgtatattcatgaacaagtttttgaattaacatttttttcacttttcctgagtacatacctaggagtgaaattgttgggttatgttgtaaatctaccagtgtttaaccaattgaggcactgccggagtgttttcaaagtagcggcatgactttaccttccctccagcagggtatggggtttccgattactcttccttcttgccagcacttgttatcatgtcttttcgttatagtaatgctagtgggtatgaggtgatatctcattatggtttcgatttacagcgcttgctagctaatgatactgagtatcttttcctgtgcttattgactatttgtttgtcttttttggagaactgtttattcaggtcctttgcccatttctaattgtactatttgttatcttattattgggttttaatattgttacttttacagtctagatacaaatctcttatatatatgatatgcagaagccttctcccattctgtgtcttgtcttaatagtgtcctttgatgcccaaaaggttttcattgtgataatgtacattttatctagattttctttcattgcttttgcttttggtgtcatgcctaagaaattgttgcctgatccaaggtcatgaagatttatttatatgtatgttttctttaagagttttatagttttggttcttacagttaagtctttaaactattcagatttaattgttatatatggtgtgagatagaaatccaacttcattcttgtgcatgtggatatccagttgtgccagtagcattggttgaaaagattaatctgtcctcattaaatgttcccagtactcttactgaaaatcaatgtactgcaactgtaagggtttcttgagtactgggattctcagttcgattccatatctatatctatctatctatatatatatctttatctatgtaaagatatatatgtctcctatgccaacaccacactgtcttgattactgtagctttgcagtcagttttgaaatcaggatgggtgagttctctccgactgcttattggtcattcacttcatcaccaaaaaatgtgatcatgtgccccaaaatatatgcatatttataaacaggatagctgttttgtaaataagataggcatactagtacactaaattgtctataacatgaagcatactaaaaaactacatttaaaatgatgatgggataaataacattttataatgatattgaatattattttatagaaaattggcaaatgacatcttcacttttgttagtttttttgcaaacttataagaaggtgttatgtattttaagttttgaaaaatggcatcaaacttcccccaaatcacatatagtattaacaaataaaataatgtttaaagactatattgttatttcatctatatcaacttctactttgtatgtattttaatagatatattagtacagtagttcatatatatttttagcatggttttatcattcagtgttatggttataacttgaatccatgtgatatataactgttacttactttcaatcttttcagtattttataacataacttactaaaccatttgacttgtttctcatttattattattacaaaaatcactgctttgtgaacatttttgtatatgtctcctggtgcatatatgcgagaattttactagggaatatacctgcacgtgggaccattgggtcatatgttctgtgcatcttcagctttactaaatgctattaataattttccaaggtggctctaccagtttacacttccacaaggagtatgtgagaattctcatcacttgaaatccttcctcatttcttttggaagagtaaaaacgtttatttaatagatgggactgagctctgtctaattgattaaaacttttaagaaaaaaaatgataaagttattcttttaatcaagacagtgtagctaaaattgtttaagattccagatttttaaagaaaaattgagtatatgtgtggactattaaaatcttttctctcaatagaaggttaaaaccaagtctagaaaaatctactttttaattgtttattacttaaacatttatttcctcccaccctcctttagtcccaggtgctgttcccactgaatccatacaaggaagtacctttgaagagaagatatttcttcagtggagagaaccaactcaaacatatggtgtaatcactttatatgaggtaatatatatgtttgttagtaatttttaattagaaatactcatgatcatgataatgtaggctatctagtatttaaaaatgcatacttacataatatattttaagaagtttaatgctttcagtagttataatggttgttatatagaagaaaattgtaaaaataagtttttgaattatatataatttgaggatttagctttacaatgagttggacctttccagattatatgttattatatgttaagacacagcattacatttaaaaattacctttattaaaaacaataagtattttgaaacatgcattgattataagacaaacacagaattctattcttgcttagctattaaatattttactactgaattatagaaggacactgattatccagttagcaaagtcaataaatattgtctcaggactaacaatagaataatatcttttggtttcttagtattaccaaaacatcctttcgacttctgtgacatagttttgtctactgaggcatatcaaatggttgaatgatagatagcagagaagaatttgatgaattgttcaaggaaaaaagtaacagcaataacagggtgacattcatcatcacatctgtgcaagcatcatttcactatgcctattgtcatagaaacaagcaggtgtgtttttttaagctagcatttatttgaatgcaaattccacaaaattatatgttgtaaagtttctaaaaatcgtggcaaattctcatatggaacctctgcttgaatacctttcagaactactgacaaaagcctgtaaagatgagctgtcagacagtgatcaccagtaaaccccttccctgacccaactagcctcacatttatgtttccttgtaatttttgaaaattggtattgaaacacacacaaaaattaattcaaagctaagcgaagaaagataaaagaaaaaagttgatttttgtactgttattgatgctgttcattggctgcttcattgtaaaagaattgaatattatgaaaattcatggctcagcttttatagagctaagtgttataaacaaatcaaacaagttcatattattttttctcagtgatgagaatcttttagtttttatttttggccccattgccatttttaggtctcagttttgggggatttttacctagtaacaggattttaaactaggaaacatgcaatctttgaaatcaactttaatttccaagccgtaagttcacctgtcctaaaagccacatgttgctatctagacagacagaaaatatttaacagattctttctttttaatcctacaagagatatatctctgtgtggtaagtcactttaacatgaaaacaatgggaataataattcaaaggaaaaacccattagtctctctgattctgcagccaggactacccagttgaacactgatctaaatactactacaatggggatgcatgaatgtgtcataaatcagggttttaaaaatcagatatgtgtaagtagaacagattggttcagttttgtagggaccaaaggggaaatatgtgatccaggccaaagtgattaaatacaagctttctggccaacaagtctttctccctttcccatgttttctacaagtaggaaggaagggagtccccagctccctcgaggtaggtcttaggtggagtctcaggaggagctcttcttgagctgaaatgcacctgtgagctacgattcacccagcctatgccagagtttacaacaggcacatacagcttcctcccggagctgaagatacatgttgaaccagattcagtacctctctggagaatcacagacttctgagacaaaatcatgctaaggaaatcaaacacttgccccaaaagaagcagggaccatggcaacattgttttctgtcatggagtcacatttgaatactggtaaaaatcagagggtgagataaattgccatggttggaaaaaagtttagtaaccaatgacacaggtgtttctttaaggaaggcagcacacaggataatttttgaaggaaagaagaaagcacagatggaatattgttgatgtttgtattaggccgctcttgtttggctataaagaaatgccagaggcttggtaacttataaagaaaagaggtttaactggcttatgcttctgcagaccgtacaagcatggcacttgcatctgctccaggcgagggtctcaggaaccttatgaatgtggcagagggtgaagggcagcaggcacgtcacatggcgagagcaggagcaagagagagcaaagtagggggtgccacactctcctgtgaactcagagcaagaattcactcatcaccaagggggtggcccaaagccgttcacgaaggttctgcccacatgacccaaacacctccaacattgggaatctcatttcaacatgaaatttgaaggggacaaacatccagaccatatcagtgctggaaatgaatatgctgtagctttagattattctctgttctctctttgcttattatgaaagatacacaaaagcattaatgatcaaaaacggctgacagcattgttttttccaggagttatggcagttcacagccttacatcattcttctggttttcttccttgctttctccttttcactcctctgactccattctcagccttccagcactagccttgcctctctgaccttgtcttcgttctggctcaagtccttctcgtacgttaccctccacctcagtcatttaattttgtcaatcatcttcctacaacctgggtctgatcattacacctttactcagtagctatcaaaatctcttattttgtcgagttgtcaatttaatactgccctctgaaagaatacttgtaagtgcagaagtattcaaaataaaatatccttgcttccgaattttacttttcaaatgtaactactattaacagctagatacacatccttctaaaattttacaaggtagaaactgtagtgcaaattcattaatgaatataaaatggatgcagtttaataaatattatcaaacccagcattttattacaagaataaaataccatatgagactcccacctcacatcatacaaaaataaacaccagattcatgatctaaacacaaaagtttagaagaaccttctaagaaaaaggtaggaagacatttttgttatatatttttctaagcttgatataaaactcagcagtcattaaaaataaagattgacagatttggttatataaaattttaaacttctgaatgatgaaagataccatgaaggaggtctgagtacaaacagaagacttggagagattattttcagcacttacagcagtcaacaggctggtggctataatatatagagacctgctacgtagtaataagaaaaaaacaaaacactcttttaggaaataaaatggacaaagacacttcaaaaaaaaattcacccagcatgtaagtatatggtaaagtacctacccagccttactaatgattgagaaatggagtattacaagtgatacagaagtttaaatttctataatatcaagtgttaatcagtgatgtggagaaatgtgtacatgcatagtctgttgatgggaacacacattttgcagtctttttttttgtaggcaattagggagattctatcaaaatgtaaacatagtatgccaaacctatttctagaagtttattagtaatactccccaatgtacaaggatatttgcccaagtattttcattgtatcctactaactttacatatctctagtgagtaaataccagactcctggtcatgagactaacacatggattgttttaaaagctttagtatgtctgagatattggaaaaagacaaaagtagaaaaggtactgttccttttctgttgaagtaactaccccatcagcaaccaactatagaaagaatgaaatgagttccaaacttagggactcaatacatgagtgtgtgactagagtatcaagtgcagttttggttgggcactttaatcaagtagaatggtctagatttgccagctgattgggacattcaagagtctagagttgaagacaccttaatatccttagcctggataactgggctgttagtcaccatcagctgagataggtggttatgtagagggaatgagaatttaggggccatgttaagaagtttgttttcaatactcaagggcttctgtgatccaacccaaatctatatttataacgccatctcctactatttttcttctggaactcaatgagccatgtatatgaaattgtctcttcgccaagagccttctgagccatcacacaccctgcttttgcttagattcattctgcctgtgccatcccatcgctctcctcctatagcagctctgcctatctttcagtattttattcaagtactttacttttccttgaaatatcctaggtcctttcctcccctaaaatcagatttaattattcattcctttgttttctcagaataattgcttaaacctcaattagaggatggtgttttatgctggctggaattaccatcaactcacagtctagaagattttgattcccctcttctataacatgcaagtcaaagattgcatgttattctatcttggtttcccatgaatctctcagtttagaatttgaggctttaagtagagaaagggaagacaattttggaagatttcaggcacttacctgcaaatcagaaatcatccaatagaagcaacagtttactccatctcacccaaatctaaccctcacacatgatgttgagatctcagtttgcttttgacatggcacctcccataaaattacttacatccaacactgctgcagcaacgttttttacagaggcttcattacagtttcctggaccttcagccagggacagagtacaagtacagaagcttccagacttccttcttgtagtttgctgctgtactgaagtacttaacaggcacttaataagcatgtattgaatgaacaagtggaaaagtaaagctgaaaccatatggacatttgagtttgagcatgggagtatattttggtgccctttagagcagctgctgaggttggtgaatgtctaccatcagctctgtggcaggcagtggggttgtagagttagagtgcccctgctgccgagaagcttttctcattctgatattcagactccagggctctgtggatgggtctgagatggggaaacccatcacctttgtgacatttggtggacatatacatgcccaacatatttgtttgttaggggtgagggagaggatctgtaatttttaggagtgcatgaattagtgtatacatgtgttttttagaagtaggaaagagaaggtgtctaatttttaccaaattgtcaaagggctatgactggaagccagctaagaaccccagtgttattttgcagccacaaggctttcagcaagtccaagcccatcagccctgctggaacaacaagtcccttagtaaagcgtttgcttgatagtctctgtgggtggagcaaagatcccacttgtcttgagtgtttacatgagcggatgcacacacccgctctccccaggagtagttttaggaaaatagatactgagtgccaaatatttactgatcacagtgggatcaggaaaagaataagacatcagtcactcctcagaaagaagatacaattacatgaaatgttccaattcctctggtatatttaaatcatgatttaagatcaaagaagagatttcacagtactccaagattcattgcccagtgaattgtatgaatagtcacaacacaggcattcagtggatctagtgattgttaggccaggtttaggaaggctttacaggtacacagaatgagaactctggattgggacatggatgggtactttttttgtcccagtctcatctttggaaaccaaccctccctccctccctccttttctccctccttctctccctccctccctctcaccctccctccctctctccccttctctctctgcttttttttcatttggtttctgtgacagctttctctcctttggctctcttcttgcatttctggctcttctgttggcttctcctcctctatcctgtattaaatacctacattcattagggagtggtaccaggctcccttcttttttttctaaacttccttccctagtgaccccctccattccagaattgaatatcatctcaatgttcatcacccccagtcttcacttccagcccagtcctttcaaatcacagcttcatgtcatacatgtgtgtccacctgactgccgtgggcatttccaacttagtatgtccacctgtgtctgtaaatttctcctcatatgttccattcttttcgatacatgggaccgtcttctgatcaagcccaaaatggaacctatcctttattccatcctcttttttttatatccagtccttcactgagttctgtccattttatctctaaaagatgccaattcttttcatctcttgctgtctgtaccagccccaccttattccaagcccctgtattttctcccttgtgctatagctctaggccctggactctgctgtacttcctagtgccctccctactacttcaattgccccaccaatcaaatcaaccttccacctgcagtcagggtgaactctttataagggaaattagatcattttattttcatgcttaaaaacgttcaagggcttcctgttgtatgtatccaaactttttatcttggggtgcaaagcactgtacagtatggtcctacccacttctcaagcccccaaggaaccacaccgacctcctttctgttcatatactgtgcccactcactcccgcttcactgccttagttcctactgttcttccccaaactctcagcatgattaactccttgggaaagttcaaatctcttcagcttaactgacatctcagtgggcccttccccagccactctaagtggctgtgtaataacctctctcccctgacagttctccttattttagcaccctattcgtttcttccatggaacttggtgttttgaaagtattcatttacttactgtatgcctccccagctccatcccaccctgtccagattctcagttatctgaaacagggcgtgtatttacctgctggccatggtgcttgcagagtgtcagtgttcaatcaatgtttgaataaagtaaatgaatctgaataggtagaaaacatggaaacagagctaactgtctcatgttccaggcaggtgaaagcttacgagcaaaagcagtgtcagaaaagccccattagtgtttgtagggcagttagtctttatcctctgaccagaacagaaaggaatataatggtgtagtatcacagattcagaagtaagtttggagaaggtgagagcaaaactaaggagtttgggctttctctcgtatgcatttatgtttcattaaggtttctagacaggcaataaaatgaatgagaacactaagctagccacggtgggcagcgtcagtcctcattttaattatactttgtcatagttgttggatcacttctccccttcccctaccagactgatacctccttcggggaaggtacgattcctaaagcaccatgcaagaccccagctccgaacacagtgcttggcacatgagaggggctcaatgaatatgtttcaaatgtgtgggtgaattagtgagtaaacattggaagcaattatgcattcataatagaggtttagatccgtctcctccaaactgccttgttccctggaggtatccgaatggaggaccaagtaatcatacagcggttacatcgctgacgtccttcgctcagccactagggggtagattggctttgtctcttcttgacttccttaaccttgcagaggaagtctgttagaggattaacaatagatactctgcatgactccaatagtgtcatgcagtgcagtgattaatatatatagcaaacagttttcttgctaaagcttagttgattcaatctaaatattctttcagagaggtcttcctaattgtaatgacatggtataaatataagaagaaagaatgtcaattatcacttcgtataataacagtgttagtgttcatgcacataaattacaagtaagtttacctatttaaaagcaagaaaagtgctcagttttgcaatttaaaactttcgaatatgccacattttaaaattatgtcattacaaccagtagaagttagtaatcaccactaaagtgcatgttcttgaatagttgatgaactactcatagtgaaattctttaaaatatcatttgaaagggtaggatttaaaggcacctatgttatatttattttcaaacacttcagactcatccaacatgctttgaatatctgttatgtagctagtatcatgaaaacttctagaactgcactgtctcatatggcagctactaatcacacatggcaatttaaattcaaattttcagttcctcagtctcactaaccacatttcaaatgctcagtaaccagatgtggctagtggctacatttccatcatttcagaaagttctattggaagacattgctctaaagaaaagaaattaatatgacccataatgatcactctatttgtagcatcaggaatgactggaatctgtctaggattccagtcattggagcagatgtcctcacccacattgatgaaaacacttcagtgccctcgttcccaataggtaatgatcctaagtcaaattatggccactagattaaagatgaggccttatccttgtcagtatcttatctgtttgagctagttgtatattttcttattttgttctaaacccattgtaatgtagttttacaaaatgacattttgaaagcaaacaacttcaaagtattagcttaaccccgaactcatcctgtatattctaatctactggcttaagttcccctgtctataaaagtaataactcagcagctttggcggagttccttcatcccttcagtggattcaggatttcaagagtctgagtaggagcttatcataaagtgtctgacagtgcatacatcagaagggtttattggataaagatgcaatctgagtccatctgctccagatattttatcactttctcattcttttgcagatcacctacaaagcagtcagttcctttgacccagaaatagatttatccaatcagagtggaagagtttcaaagctgggaaatgaaacccattttctgttttttggactgtatccggggaccacatactcctttaccatccgagctagcacagctaagggttttgggcctccagcaacaaaccagttcaccaccaaaatatcaggtactctacattcgtgagttgtgtcttttatcagaagtaacatttttgtccgttttcattcccattgtcaagtatgccaagctcgcccacactaacattgtatccaaaggaatactcctggatgcctgaagctcagactcacagctttaaatgaagtactacaaatatttctcatttgggagcttaagatcctcacatgttaggaagtggctattgttttagcagggcgtcttggaggacttgggcatgaggcagaaggttctgttgagacactctcatccccttgtcaatcccaagttgccagagcagtactgttggaaaaatctctgtaatgaaccatgaaccatcgggagctctgcagaaagacagtcatatagagtctgcttcctgaaggatcagcctccttgggatctctaccataagaaacttctgtcctgaagagagaggcaaatacatgagggtaccaggaactgagggcctccagctttttgcttttagagacttaattatgccatctaacaaaagacgtaatttgagaaatatttctaggcatgttcaactgtgcagaaaatgtctttgtacttcagactagaggaaattaagctgccatctggtatgggatatacaacagcaataaaaaaattgcatgaatattttttcccattttttcccctttgggtatgagtgtggaagtgttgagttttggctttaactattttgtttggggtggagcaggtggggtggaagtagggaaaggagctaactcttgttatcagccatggttaggtcaataatatttagcctgacctttatatcttttatctctcattccttgttttgtattaataaaagttatcatttggagttgaaggaaaggaatattcacaactagagtattgtaagtgtttggctaggttttgagggagggtttagaattttctttttaagcaattataacaagggataattttttattgtgtaatattttatgagcacaaacttgacttgaaatttaatacacttgatattctgtgtatagaattaggttatagaaacagtatggagagttgagaaagagaaaataagtctttgggaagttagaataattagagattagaaaactgacacagattgaagaaaatgggttggtagaagaaagaccactggacttggaatcaaaaaatctaggttctagttatgattttgccaggcacttcctctctgattttgatcaaataaatttactcctacatacaaattaagataatattatctagcgcatgaatttatcatggggatttaaagatgaaataagtgccaatatatatacctcgaagcatgttttaagaaatttttcccatgtaagttacactacaaagattattgtcataatgagtgtattttttgaataaaataattcatttttgctatttttattagataagaattctgatcaacatggccgtattagtccgttctcacactgctaataaagacatacccgagactgggtaacttataaagaaaagaggtttaatttactcacagttcagcatggctgaggagacctcaggaaacacaatcatggtagattctaatcaatggttttgaccactttcagcatgccaagttcaaataattttattgaaaatcaagcaacctgacattttcattagcctatatggctcatcaagaataagtttttgatttttatagtcttaaaacagttacagtttacaggtcctgttttcaattttcatggacctaagagagggaaccactcttgttaattctatgttatgaattggagttaatttttaagagaattgaaataaattttaatgctgagatcattcaataaatggaactcagaagtaacccatatctgttataaacaaatctttttgtatatgtaagacaattttaaaaactgtatttgcaagaaaacgacctctagctttctcatcaggagtctctaccagtgggctgtgaaaatatggtatgccctcccacatcacagctccgtgtaatgatttgtcttgtccgtaattactgaagacctctgttgctatcataataagacttaacagtctagagaaggaagatgctggaaactggccttagaaataggatttacattgggaggagaactaacatttgtagaattatatttgcctgtctctctgttctctctttgaattacgataataaacgtagagggtagttccccccattttgagatgtatagaagctcttatgctaattaaaacaaaacacagcaaaaagtcaaacccaagcctttcttatttcagttcctatgtgttttccactgtcatgcttttctgagagcccacagattgtcactaattaattccaacaaatctctctgactcccactgtcctctttaaatccccaatgagtctctggtacatgaaaaaccttgatttagatggaataactataaagtccaatgattatttcctaaatatgcctttagcataaacagtttatttgagaattcatatgtacagaaaagtgtaccaattgtaagtgtacagctcggtgatttttcacaagctatgctcatttagccagaatccaaatcaagaaacagaatattactcacaccttagaagccccctcataccatctcccaacttcaactcaagatcacagaggacagtatgggctgcttttagcagctgtccctgtgattctatgtagggagtatatgtgaagcttgctcgtggttgttgatagctgcaatgtaaagtaaatgcactgtgttcttaatgctctttgtaaaagaaagtggaaactaaactgagaagataaaccagaaataatgagtctcccattctacgcctttttccccagcaccctctatgccagcttatgaacttgagacacctttgaatcaaactgacaataccgtgacagtcatgctgaaacctgcccacagcagaggagcacctgtcaggtatggaacagagggttgggccggctctagatagaagaaaactaaatcaagttgattaattcctccaatgtgttttctagggatttgctgcaaatctcagccagcatgtaaatccatatctttattagctctaattaaaagtaatgactgaggaaaatgaaagggctttgatgtaagatgatcaagtattgtttaaagggttttattctgatgcaagtgagttgttcttttgaagataaggaacaaagcactagtctgttgaggaggtagttttaaattaaaaggtgactgcttgatgcaatttggttacccaagggcagatgacatttttgttctcagctctgttctttgaatggatgtttcgattttttcatttgtgtgtttactttgggttttatgtcatttattttttagtaaattggctaatttctcaataaaatatgagatgtatagttttttgaaaaaataacagattattggaaagaacattgtgaagtctttatctgaacagattagagttaattaccaacatctaggcccgcatcttattccatgatgatttatatagctaagcaattataaagtataacttgtatagtgactgaataaaataaattgattatttccacgacagagcaaaggatgcctgaatagctctggagtatcaacttgtcataaactcattaatctacataagtgaaatttctacttgattcagagggatttaaatgttttacctttgtattttggaatagtttcccttcagagtcatctattactttgaatagagtacttggaagaaagatttacattgacaattaaggcattatagggtttattttcatgtttcttttgtagaatttgatttcattaatgttttgacacctggctatatttgatcatgttttcactgcagtatcataaggcaatcagttagatttctttctattcagtaaaatatatatggaggtttcggttcataaagtcataagtaaaaccagaatagtattagtttttagtgaagtcagattagggaagagtcacagaaatttttatttgaaaaatctccaaaatgtttaaaacaatttttagtttatactgtagaataatgcaacacagtagctcatatgaggtttcatgcttgctgttcatagatgcagtttgtgagaatactatgaaatatataaaatctctattccaaattggagatagtgttactgctacctttcgagtgatgtgcttgacactccccaggccctctgggttgattcctgtgggtggcactgagaggttgcactaatccaatggacccaaggcacgcattagatgctatccaagactcaagtgtacccatgaccatggctcagtcttttttgactttaaaagctgaaatttattaaatgaaaatgtatgctctgaccatggccttgggagtgtcatttgtttctgacccacttaacagttgctcagactcagcaataaagggtcattgggacaggactcaatattttactgcaaagcatcatgatcatgtgaatagttagagttcactcagattcaatgcctccaaactgaaggaagctgaaagcttaatcatttttcaaaaacagccagttatcccatggtactttgttcttatatggataccttttgcacattttctatacgtgtatcttactttcaaaccctttcagttggattttcattcgcatctttgtatagatctttccaagaccaagttttgttggtttgtttgtttttgagatggagtctcactctggtcgcccaggctggaatgcagtggccttatctcagctcactgcagcctctgcctcccaggttcaagcgatttcttctatctcagcctcccaagtagctgggattacagacgtgctactgcacccagctaatttttgtatttttagtagagacagggtttcatcatgttgaccaggctcgtcttgaactcctgacctcaggtgatctgcccatcttggcctcccaaagtgcagggattacaggtgtgagccaccatgcctggccaagactaaattttaaaataattgctctttgcgcaatatacctgcacccctttcccagtcctcttccctagtctttacaaggtgccaggcacactccaaactactgttcctatttctagcatatgcctcactaagacattattttgttgttgcttacttttacacatgtctagttgtttttcggagactttgggaccttactggtagttcttggtgtcctcaggcttcctattcttacatctataaaaatacagatccaaatgcttgtcagagtccaaaatacataactttcactgcagaccttacatcatttcatcactttgtattgcctcaccctcttttacagttgtcataacatcccggtttccaagttcaacactgctgtgcttttaggaagggtcatgtcagtattggtgaatatgctccttgaatttgccaggggcactttgcatccagtctctaataccttcttcccctgttagcatcttgaaattaataaatatatccatgttcattattcacatctgtaattttagaatcatgatcaatccttaaggggcatcattcagtaagcattatggggaaacctgctatagacatcatctttattggaaggatgcctatcttaaatgggtaaatcgtgttggcacaaatttgagagaggaaattatttcaacctcacctgtcgaaaagatttttttttttttttttgcagaaaagtgaatgttgtcttcaagggattcattatataggacaacataattggactgattatctgtagaatagatggaagaccaatatagcgagaaagactaggttggggaaaaaaatgtgtatagtaccctctaactaaatagggcatattaaaattctcaatttcatgtaatgtttagacaaataagaactctgattatggaatcgtatggacctaaatataaagccataatgtaaattaaaacatttgaacacatctggaaatctgcaaaatgcacatgtaatcaaactgcagtacaagaaagcttttcccaaatgataagataaatactagaaggaggagggaaatggaagcgaacatctgtttgctttcctggattttgcacagtattgtgtgttcaaaaatactgtcattgtgtgatttccaaaacccatttttttcaattgatttgatttttttttaaatccgtattcattgatgttgaaaattcagtcgaatttcgtttatgcacttcactaagtaaggtggtcatgtattgatttccctacaaacactcagcttggttcatgtagattcttgaaattgcactaaactctcaatgtaaatgattgttgtctttttattgatcaacacatcagctctgtcacataaaattatttaaatcctgagatggccaagaagaacacaattccatcattccagccagtaaactagcatgtaggagagaattttaatgtctgttcatggattcaaagttttttcattaataagatatggaaaagtgtaactttctttcatttatttatgtatttattctttttttgagacaggttctcactctattgcccaggctagagtatagtggtgcaattgtagctcactgcagtcttgaccttctgaggctgaagcgatccccctgcctcagcctccagagtaggtattagagacaggatgcacagtgcccctggcaaattcaaggagcatattcaccaatactgacatgacccttcctaaaagcacagcagtgttcaatttggaaagcagggcacctcaaatgtggaactgaagccagagagagattattattgctaatgaaagtctgtcccagcactttgggaggcaaaggtggaaggatcacttgaggccaggagtttgagaccaccctgggcaatgtagcaagaccctgtctctacaaaaaagaaaattaaaaaacaaaaacaaacaaacaaaaaacatagcggagcatgggtatgtgcctgcagtcccaacctaggcatggttgtgtgtgcctatactcaggaggctgaggctggaggattgcttgaacacaggagttcaagatcagcctggacaacatagagaggcccaacatagaccctctaccaaaaaaattttttttaagaaagacaggagataatcatgcatttttgttttaaaacgtttctcagaaattatggttgttggcatacaaatggttatggtttagtagttcaaggttatgaagcataaagcatgtttttttttttctcaagcagcagcaacccatttgtttatctcactgtccgtaagtccaaggaaagagatgttcagtccattaacactaccttcctagacatcctattctcttctccacgctaggagcctttgagcatgccaacctcatggggttcttgtgaagactaaatgaggtgatattatttaacacttcaaaccatgctttgcacatactcagcaccatgtaagtgtttactcttgccttagcagtagttctcattacacgtttctattcataagaccagccctggtcctccagcatttccttttttcgtctcattttattcaaatctgatatcatgaaaaatctaattttacatgaaaaatataattatttcctctatcaacagaatcataaatagaattcatataaattcagatttctctgatgaatcttaagtttgattgcaaggagctaccagtttatttgtgcatttgcaagttttcaggaattgatcttataaataattagcaaactcccctgaccccaaatctatataataactcagaaaaaaaaatggatgtgtttccctattgatccctgaatcattatgtgattgtggttattatcagcttaactgaataaacttagccataaaacaagcaaaacggtcttctgtttataaccactctaaaaggaaataaacacttggcaacatagtaaatttcacaatgtgccatgggtatgaagaaccagtgagatgtattacttacgtaacttaacaaagcctaatgttctagtcaccctttaagtatatgaatctctttccactttattaaaaaaagatatttgtgatttacatgccattttataataattcagtccttataattatgttagaattcactccccagattccagaatttgttcttttaatcagaataggtttgttcaagagtttgatcctggcttagaggagccagctaaattctattatttattcaaaaaagtttatccctttatagtattttcctgctggaatgacaatattattttgagaaacaaaaaacttatagtgtaaaaccttgcaatgcaaagtttaccttaagatataaatattctggccaggtgcagtggcccatgactgtaatcctaacacttcgggaggccaaggtgggaggattgtttgagctcaggaagtcaaggcagcagtgagctgtgattatgcactccaacttgggcagctgagccagaccctgtctcaaaaaaaaaaaagatataaatgttttgtaatataaattttaaagtggctttattttaacttagcctattataaatcaatataggggctagacacggtggttcaaacctgtaatcccagcactttgggaggccaaggttggaggattgcttgagcctgggagtgcaagaccagcctgggcaacaaattgagaccctatctcaattataattaaattttaaaaatttaaaacaaaatataaataaaataaatcaatatatggtttccagatctaaataatgcttactctaaattaattagaaactactgaatccattaataattaatacaactattgcccctaagatacaagatcatatcaagtgtcgcacatagccttttagacagaatttttcattcttcctttggcaaatgttaaggaggaaacttctaatattcaaataatcactcactttatatatcacataaattatgggcctaatttttaaaacgagtgcatgacatagagaaggacacattttgaaattagataagcatagtttcaaatccaggctctctccacttgtagttacgccactgttaaaaattccatcttaaggtctctgagcctgggcttgcctgtctttccacagcaaggataataccccttatatcttacagctgtgctaggattggatttgttaaatactcatgaggttcaagcacaaggtggtgctaagcattggggatatggaggaggctgctaagggctctcttctccaggggctggcaatgtagattggaaagagagcaacatggaatctagtgtcctgtagtaagtagggatgaggatgggaaccagtggcctgaccagggagtggtcagtacagggaagagtcagctaagacttcagagaggaggtaaccctggggccaagtagctgaatcttgacagacggctgttgttcagagcatctgtgtgatgtggagtatgttgccagggaggttagatatgtggcaaggaataaaaaaatgagagagacaggttggctccatgaagacagggaggactgagtttggcctgatctgagaatgagaagtgtgttataatcagagagaggggtgggatgggagaagaagcaagggagatagaggatgaattggacaaccttgtactccataccaataagtagccattcaagggattcaggtcagggaaaaaatgtaaggaagagctgcagcagcaatggaggatgggttagagggcgtgcggcctcagaacaaactaataggagcggcataaaggctggaggatgtgctgggcccagttaagatagagctaaccctggcggcatggaggaagggggtttcataaatgccagatgctgattttcattagaaataggatttagagaaatcaaaaacacttagtcctttttagaaggaaaaaaagagaatatattgatgttaaaaatactgtctggggtattgttaaagtgaatactagaacgcttgaaattgaaaaactagcctagcaatgactttccaataattcattggaaatcactaattatataaatatttttaaaccccaattttcataagcagtaaaaagttgttcttagtgtctcttgtttggaagaaccttctggatctttcttttgttgcttctcctaccttccttatattgcaccttaacccctttgctgtgggcctgtgtccatcaattttgtgacaatgactgtacgtgttgaggtgtgaccatgatgcctactcagtggatgtgggtggcacctctggttactaaaagctagagtgtgaaatgcttctctcggcttcagaaggcatgccagcagcacacttagtgggtgattgtggctcattcttggctagggccggggaagacctaagttttttatcatactgctttgctatccccaaaagaacccatgcctgtccctgaaaaggcaaatatttgagttggaactacagactccatgaaagctctcgaatgtccttcacagtggaggccacaccttgcacattcgtggaggcgagagccaggttgtgttatgcgttcccctcttattgaccagctgcacagaagccattcggcaggaaggagggagacattaaagtctacttcattttccattgaccgtagagaaagttacatgctgtttcttttccctcatctagatagaccgtctttaaatgttaatagtggaataaattagaaatagtttcaattataaactcagagcactgaaagattgcaaatgcctgcactgaacaatatattactttacgaattgtaaagctgctctgccatttgctctcgggaacccttgggtcttcttaatcacagttattgatttagggagtttaagggatgaacttctagaggtgttccaagctagggctgatagcctttcttggagaggatcttggacattttgagaaagattaactgatttgactatagatgcctcactttcacatatgtgaaatgtgaggaaaggttgcaaattccaagagactgataaagtcatgtgtgatcactaagccggtatgcttcttagagccctagacttttagaactgaggacgaccaactcagaagtcctgaccacattcctcatgttacatttctgcttcatcctattttggtggtggggagaggaatgagggcacagatacagaaggaattatgttttacatcattctcttcagcagggcattttatcaaccagcacttataagtatactcaatgtaactatttattataagaacaccagtgtacacaaaagtgctaatatgccttctatttccttaataactattttttaagtatattatattatgcttgtgaggcttacctgtatttcattgcaacttaattaaattaatattcagctcttcaatcagacagtagaaagattagggagtggttttggtgttttttcccatataattatgtcccttttgacatgtatgtatggcccagttccatctcatctctacttctacctgctaagtgttttcctgtcctgtatcaatgtattttccactcaatgagaagtagtaagagctctgtccagttattagtacctggttaaaatcctggcccttcatagcattgaaaagtgttgtaggaaatgttaggattgacacttggctactgttcagttattcttcattcattcaccagatatctactgaacacttattgtcttcatgtcattgtgctagggttgtgataaaagctgtctagaaaagtacagggtactctaagagtatgtgacagaaggatgaaatctcaacaggagaatcaggagtgtcttactgagaatgtgttacttaaactgaaacctgaggaggaggtaggtagataggttcaccaagtaggagagcaatcagtagaaaagcctaagataagagaagttaaagagacctaaacagtggtcatcctagtcaacaaaattaaaaacacacaaggtttgaccatcactcaggagcattaattagatttacatgcagttgtgcagagcataaggacatttcattcaacagactgcgtatacagcagtggtcctgaaatattataatactgtcttttcattgcaccttttctacatttagctttaggtttacagatactccccactgttttacagttgcctacagtattcagtagagtcacataccatatagctctgtagcctagcagcaataggctctaccatacagcctaggggtgtagtaggctgtaccatctagggttttgtaagtgcaccgtatgatgtttgcacaaagatggaatggcctaatgaggcacttctcagaatatatccccatcattaagtgactcatgaccatatttaatgttgagagtgagcatttccctaggctaaacattatgtaaaacatataaaaatataatcagaaatgcaaaatcatttgatcacaaaatgattttaataatttagtttttgaatatcatgcaatacctctaacctaattaagagtgcaataaatgtttattgaatgaacctcatctttttcttgccagcagtaataattatcacctgaaacatttattacagataagaagaccctagaccttcatttaactagtgggacataccaggaacaagtggagttttaaattatattttcatccctaaataaaagttaaatatcatgaaccttccatagaatgcagagctataaaagaacaccctgcctttacctttgaagcaatcttttttttttaataagaagagtaattgagaaagattgcttcaaataagccattgctataaattcagatccaatcaggaaggtcactccaatttgcaggcttatactgactcctgcaaaaacttgtcttctcacctcttgaggacagtgatgacaccccctcccctccttttcgctttaccttccatcccccacaatcactgtcttagttcatatttgtctttctcaggtctccaatccccattcaccctgtggctgcagggtctttcctcccagcttaataacccatcagtgtctccctattgccttcagcataaatccagacttcctctaatggggaagcctctggcttctactcacttcctggggcagcctcccttccacctgtaaatatttgcctgagaatatcctgggtggttccatgccattttgtgggtttattttgcagctgatgtttctttcatggaatcttctctcttttatcttccctctgtcctgcctgcacacacacacacagtctctccacagtctctttctctctctctctctctctttctctctctctttctctcacttatttccactcccctcctagctatggcccagatgtcacctccttggagagcccaccctggccccctgcccatctgtgtcctgcagctctcccagagagctcagccctagattcattcactgcactggctggtgaccgcttgtcctggccacctactagctccttcagggccaggcctgtcctctgattttacttctgtatttccaatcctggttctatgccagacacaggcttccatgagtatttgtttatttgttttgtttttattatttgtttctcatttttttaaactgtagaagaatttttactgaggcaaaaactatgactgggtttgcatattagatcaaccactggggccgggacattggggaagtaaacaggccaatgtgtcttccggatggaaaattaacagattaccgtggatggatgcatcaaaactgtcttttgccaaacacaaagattttgaatggagcaggctgtgctcaggggttccacctcccagttcccaccaaatgactgaagtttcatttggtagtataagtgacatctaatctctctgatgtaaacaattcatacaagttaatagtttagaaaggtagtatcacaaattaagagaacacgtggcacagacacaagaagacttgggtttgaatctcggctgggacatttactaattgtgtgacctgaagtcaccctgtgtgtgaggctcttcttgcattgctataaagatacccgagactcggtaatttataaagaaaagaggtttaattggctcagcattctgcaggctttacaggaagcatggtgttggcatctgcttggctgctggggaggcctcagaagcctccaatattccacttaagaccatggcggaagacaaagaggaagaaggcatgtcacatggtgaaagcaggagcaaggcagagagtgaggagggagatgccacacacttgtgtgtgtgtgtgtgtgtatgtgtggaaacggagtcttactctgtcacccaggctggagggcagtggcgtgatctcggctcactgcaacctctgcctccccggttcaagcagttcttcttctgcctcagcctcctgagtatctgggattataggcgcctaccaccatgcctggctaattttgtatttttagtagagacggggttttgctatgttggccaagctggttgcgaactcctgacctcaagtgatctacccaccttggcgtcccaaagtgctgagattacaggtgtgagccgccactcccagccagatgccacacgtttttaagagaccaaatctcgtgcaaactcagagtgagatatcacttatccccaaggagatggcccaagccactcatgaaggatctgctcccatgaccaaacatctctcacctggccccacctccagttcccaattgggaattacattcagtatgagatttgggcagggacaaatatccaaactatggcaccctgtaaattctctaagtctgttccttcatttgtaaaattcgcatcaagtatactacttgcctgtctcacagcctggtcagaaggattatgatcagtgaaaattatttgcaaaccgaattgctcaaagagaataaagctatgatatcatgatttgcttaaaaaatgttgactagattgctattcagtctttatgcccattatactccgcttttagtaatacacttaaaatttcctatcattactgccttttatcttctatgctgatattctgtggttatcacctatataggaactatgttttaacagtcactgatatttgacaatacttctatagaagttgtaagaaatatgtgtgtttggtattaatattgtgcattcatttggtaaaatcatcaatgttttagatctcttgttccatcaaaacatcccagcaataagagaaggcattgttggtaggactgtttatagataacagctcattccagggagtaaaagtgcaatgttgttaagaagcataaagaatgcaaccatagcatggagcttgatgcttctgggtttaaattcttatttgccaagatttatgtccacctcaaaggtaataataatatctacctcaaaggacagctgggagaattagtgacctgtaagcaaagcagtcaggacagcatcaaacacagatgttatctgttcagtacaggaagccttttcttattgttgatttctatagtgatagaaacaacttatagataacatggtagccccttttattctgcctatgtcttgggaaattttctgggtcctagcattgtattcctgagcctcagttatgttcttcttagcagcttgtgatagataaataataattacagcaatagaaaatgaataatcatggttacttggattgaggagctgtgatgtgccaagcccatgcttggtcccaaatgaaataatttatcatgattcagagcaggcttcctcgctagatgccagcatttccccattacagttgaaagcactgaggttcagggaggttaacagacttgtctactctaaccccaaagccatgagctttccgtgtaacacttaatcttgtgctcagagccacagggcacgtgagctgtcaggaccttgcctcctcctgggagctgtgctcattctcttgtcccccactttgcttgatcagaagacatctttcctcctgacccttcagaaccaagatggttacacctccctttgcagacgtggactattctgcaaattaatatcctttatttattgtcttttctagtacaggcatatcttggagttattgcaggctcagttccagatcactgcaataaagtgaatatcacaataaagcaagtcacacacattttttgtttcctagtgcatagaaaagttatgtttatattatactgtagtctgttaagtgagcaatagcattatgtcttaaaaaatgtatctaccttaattaaaaaatacattattgctaaaagtactgatgatcatctgagccttcaatgaggcataatctttttgctagtggagggtctttcctcaatatggatggttgctgactaatcagggtggtagtttctgaaggtttgggtgactgtggcaatttcctaaaataagacaatgaaatttgccacatcagttgactttgcttttcgcaaaagatttctctatagcatgggatgctgttggatagcattttacccatagtagaacttctttcaaaattggagtcaatcctctcaaaccttgtcagtgcgttatcaactatgttaatataatattctaaatcatttgttgtcatttcaacagtggtcacagcatcttcatcacaagtagatttcatctcaagaaaccactttctttgcttacccataggaagcaactgctcatccgttcaagtgtgatcatgagattgcagcaattcagtcatgtcctcaggctccacttctaattctagttgttctttccaccacatctgaggtgacttcttccattgaagtgttgaacccctcaaagtcacccttgaggtttagaaacaacttcttccaagctcctgttaatattaatactttcacttcctcccatgaatcacaaatgttcttaatggcatctggaatagtgacccctttccattgactttgaccagacccattagaggaataattatatatggcagctatagcatcacaaaatctattccgtgtataataagacatgaaagttaaaatgactccttgacccatgggctgcaaaatggatgtcatgttagaagatatgaaaacagcattcatcccatgtacgtctccatcagagctcatgggtgatcaagtgcattgtcaaatgagcagtaatatttagaaaggaatcctttttttctgagaagtaggtctcaacagtgggcttaaaatattcagtaaaccatactgtaaatagatgtggtatcatccaggctttgttgttccatttgtagagcacaggcagagtaggtttagcatgattcttaagggccctaggatggtaaatgagcattggctttaacttaaacttgctagcagcatgagcccgtaacacaagagtcagcctgtcctttgacaccagacattgacttctcctcttcagctatgaaagtcctagatggcatctgcttccaatagaaggccatttcatctacattgaaaatctgtggtttagtgttgtcaccctcatcaatgactttagctagatcttctggataatgtgctacagcttctacatcagcacttgctgcttcgctttgtacttttatgttatgaagatggctacttttcttaaacctcatgaaccaacctctgctagcttcagacttttcttctgcagcttcctcacctccctcagccttcatagaattgaagaaagttagggtcttgctctgcactaggcttggtttaagggaatatcatggctggtttgatcttctatccagaccactcaagttagtttaatattctatccagaccactaacactttctccatatcagcaataaagccgtttcactttcctatcattcatgtgttcactggagtagcacttttaatttccttcaataacttttcctttgcatttacaacttggctgtttggtataagaggcctagctttcgaactgtcttggcttttgacatgccttcctcactgtgcttaataatttccggcttttaatttaaggtgagaggcttgcaactcttcctttcacttgaatacttaaaggccattgtatggttatcatttgttctaatttcaatattgtgtgtcttagggagtagggaggcccagtgccagggagagagatggctgtcttatatggacacagttcatagcaccccaaaacaattacaagagtaacatcaaagatcactcatcacagatcaccataacggttgtaataataatgaaaaagtttgaaatgttgcaggaattaccaaaatggcacagagacatgaagtaagtgcatgctgtaagataaatggcactgacagacttgctgaagggagggttgccacaaaccttcaatttgtaaaactttagttcagtatctgtgaagcccaataatgtgaagtgccttattaagctgggtacgcctttattaagaaaatacgttacacctttgtttctatattatgatcattggaatctctggggtttatccctactgcttgcttaattcttaaatgcaatacttttgtattcttcattatttccttgttattatttttaagctgaaacattttggggttttgtttgttcgttttgttatgttttagtgggggaatcttgctccattgtccaggctggagtgcagtagcatgatcatagctcactgcagcctcaaattccttggctcaagcgatcctcccacctcagtctcctgagtagctgggacttagaggtggtgtgccaccacacgcagctgatttttttttattttctatagagcagggtctcactatcttgcacaagttggtctcaaactcctgggcccaagcagtcctcccaccttggcttcccaaagtgctagaactacaggcatgaggtaccacacccagcccttgttaattgtttagccatataattttgagaacttgaagaacttaaacgaaattgttttagaatattggattattttaatcaaattaatcagtgtttttctgctggtatgtatgttctttttcctttcaccatttttattagtctccaaagaatcaataaattaaggatcagtgcttttgaggtacttataagtggctttttaattgttccctttttatttattggagaaatgcagactgcaggagcatcttaaaccttcagggctaaatgcacttttgtcacagttttcaaaccttttgaaaaggctctatctgtggctaaaattgtttagggaaagcaactgacttctaataattttcctttattcattgaggtacacataggatcaaaatgtcattgagtggtaaaacttcagcctgctttttatagaatttgtttttattattacttactgttgctgaatcgctacagtgagtgttagcaaaaggtgccagatcccttactatcaccaccaccactacccccaccccacctgcttttaagtgagttttattgtattaaaaaataatactctggattcctttactgccagaaaacaaagatcatttttattaatgttgcttctaggatgacaatgtcagtcatctctttgaaaattcattttggaaactaagtttgttctttaagaacctttgaaaagaagctttaaaaatggcagaggaagataataataatagagtagatgtatttgagcttttatacaatgaaacttaatttaactttccctcaaactccatttcagacttgcttttgtgcatgaaaatatgctgcctagccttccctcccctacttttcacattttcttttcttcaaagtaatctcttctgaaggattctctgcatgggatcagacctccattctcattcccaggcccccagtgctgagggcggcaagcccagggcgcctgtgggagggtgtacagggaggctgctatagacagggaaggtcaggaatggctctcagagccaaattccactgccagtcaccccccagaaaaaccaacaaaatacttacgtaatattttgatataactttaaggattaaaatggatatccagtgaagtactgaaaacaaaaaattatggcctttgtagcctaaggagtgattatagactcgacagagagtagttccaagtttgcctgacagtgatttggaaagagagaggagaacaaagacgaagaccatgcatgccttcaagcttctttcccggcccaccctcaggtacctccttcttcatccttacctcaggccttgtgggcgcctagaggagtcaagactaggaagcctggttttcatgctctgcaggacaggaattgaatgaggaagaccctgccattcttgtgtagctcttggggccactctggggactcctgggggcatacctgctgggacctgggcagtatgtgaggtaggacccagctcattgtcttccatcttctgtgctgatgaagggtactcacaagcaattggagtgaatggagactgtattgggatctgttaataaacatgttggcttttttttttgttgctgttgtgttatctttaattcagggagaatgttggtgactgtagcattgcaggagcagttttagggtgagaacatttgggcacttggttcaggtcagatgccctcaatgtagtagatgctagaagagattttaacgtagagattgacacatccctgggtcctgttactttgtcctttgtacaaacccttatcagatccttggcatggtagttcttcattggtgtgatgtatttctgacactcttagcctgtgcttttcaaggacggggcagtctgtgcctaattcctctttttattcttcccctgtgcctggaacaaggcctgatacgtggtgaatattgtggaaagaaaggatggaggaaacatgaatgaaataattttcttctcatttgctgatgtcacaacttgcctgatcttgtgctgagagtcataaaatattagcgcctgaagggctttagtggtcagttggtgattcaggagcaaagcaggagccagtcacctgtggacggtgattcccaagtcaatgctctctcatcagcacccccttgggcacagctgcctttctctgatagttgcatttgtattccagcccatctggcccaaagcactggaacttttcgggactgaaagattttgaattggataaaatacaaactataaaatatcattcagacaaacatacaggaacaaagctatttggtgtggctttgatagtattctctttctatttttattcaaatcattaggactatttaagagaacatacttttcataatagtaactaattttggattatactttcataatcatgtgtttatgaaattgagatgattaaattgtgttaaatttatatgaaataggaaatgcaaaggaaattgtcttcacttgttaaaagcaggagacatcacccttaaagatgttccatctaggactaatttactcgaaatgtggtgcctgttgtgaagattaatgataggtggccttttacagagcttctcagcctgagcctaatgttctagttgttctttttattatcccaaacctccataactaaagaatttttttcaccctgccctttgttcataatatgggatggtaattgagttcatatttctcacccaacctttcatctgtaattaatattttattatatcagattttatcactaactagcagagcagcagggtattgaaccgagtatgggagcatgtgcacagacacacacccacagagcaatagtaacttactgatgccaggcaagctccttgttatgagttacggctgagagaacataaaaaatgcttgtggtgccccacaaatattccacagcaatttctggccagtcttgtctatatcagagcaggacaaagagaaattaaagttgctaatatagaatattcagccccacaggtctatttatcctgtgtgatgtgttacccattgccaattgtctgtataaaactaattaccatttatcattgataatttaatcaacaggtgtgtgtccagtcagttactctcagtgttacctgaaggactctaaggaatctgagcagtaataacaaacactgaattctgatttttttccagtaattgtaatttggtgacatattttttaaaactgagtttagttttatcaggttgtttagagtattagggtgtcatttcagtaaatgctgacagatttaggaaaagacaatgtcagagcaaagaacaagaggtaaataaattcagtgtggctgcatggcattaacccttagttacacatttatttttcatgctttgcatgtaattaatattttcattttctttcatctccccccatattaatcttcaggaagctatcaatactaatatctattctttttatacatatataatggatggtttttaccaaaaattacaaatcaagccaaaagtcactactagatatgataaaatgaacaatattctaagtccctgaaatgatcagaagtgcctgttttagaggattagcaaaaacaacaatgaaagcgttacaacttttctccttctctgttctcttccttacctccctaccttctattatccaattggtaaccctctgatatcttatggtgaaaagaaatacgataaatggataacaaaaatggatttacaactcatcttgaaatgaattaggacaaaacattttaagttaatttcacatatgtatgaggcttcctctccaggaactcgaaagttaggaaaaaactaaaaacattttatcacatttgaactttcaagtctaaaaaagtagatgaaagatgttcagatgttcttttctagattatacttcatgtgctattccatataaatgcagatttttcattctccttgtaaaggccttagaattttgttgtagaaatgcctagcataaattaaactttaaattaaatttccttccataggaaagttctgatataatgatgtcacagtgttggcagattcatcctcactgtggattgtgcttttaatatcgcacatgcagtaggaagatttgatgttactttaaattccagaataatggtaggacagggctagggtggtgcaactttaataaacaaaggcagcatgggcaactcattaaaaggataatagaatttaaattcagctcactaagctagaaatttctgatcagttttctattctcagaaatttgctttttaaaactctttctagaaacaccattccaacagtgagattttcaaagctagttttgagattatgattgtggatggaaaaattttatgaaactcattagtgaagtgatgttacttgtacagatgaaaaacacatcagctataaagttctgtcaaggtactattgacctaggtgctaataatgtgttaatttccatcagggaaacagcaaattatggcaattgggcagcagataggatttagctatttttcattagcacttgggctttgataaaggggactagaaaagagctgcttgacctttcagtgcttaaattattaaagagcaaatagatttgaggtctggatgcttgaaaatctaatttgtcttgtggagcaaggatgaaaagacattttgggtttgaaattgctccagtcaacttagttctttctttaatatatctgaagatgagtggatagtagccatttaaaaagcagtatgtctggagtagagtgtataatagaacccatgccaactggctaacatggaggcctgtccaatgattgtttaattcttaaattttcacctaatcctcattaaactactgcttgaaacaaatgatttttttcatgtttgcttagatgatatttatattacaaaacaaaattttgtatcattagagaatgtcaaacattgtgttgtttaaggcaaactagagcagtgcctgacacctattaggcactcaaaaaaatttgttgaaataataaatcagtgtacacactcacccatcacacctacgagccaggttaggagagaggaatgggaagtgagagatggaggtgtggggggcacatagagacacagcgtttgattcccttaggttcattatttaattgtgggttatccaggataaactaaaacataactagcatcctcttaccataaaaccttttccttggtcattgctttctctttggctcttgagtatttgggtaatgaatacaaaataaacttcacattaaattttaataaggcaaagcatcgttgtgactatcggtgtgcttcctccctcctggtacatagaatgtgtaatatacccccaaaccaaatagaagcaacttcaggattatagcatgctttcagaaatatgtacttcacagccgaagtgtcacgagacacaacagtgactaaacctttgcccttcttcttcagaagcttgtaggacttttgaaaatagtgataaaaggacacaaaatgactatgtgctcacagaaaacatgtttttgtgcatttggagcagagcaagagaacatgaaaatgagggaacagactataagcccttgagagagactcattgagggtctgtgttttaggacacagggcatctgagagtgacctagagttcattgccttgaggagaactacatttaagtggcaaacttgagtccaggccagggtgaaggaaaagaggcaaagatgtttgcagtaggagaatctaggatcttgggacatggaaagtctaggagcagctgtgctgcttttttgtctagctgggttgtaacaggagggagctccttgcaggttgagagaggtgggaagatcacagtgctccgaggacaccagcccggtgctaaagtcactgtggagcccaggagaacgtcctccctgaaagtaattaatgattcagatatagaattgaggaatgattctgtacataccttgattcctcattccagtgaatgattcctcaatcattcattgaggaatgattcagatacagaaggaattgaggtcaaagccaacattatcgtctataactcccttgatgtgataagtgtgaatctttacaatactcaaaagaagttgactgtggaaagtcagtggagactagcttatgtgttggttgtgtctacaggagcaagtgaaaattcccttcaggccagatggtttccatcagtgccttcactggacctgtgaatgaggaatgccagcacagcctggtctgatgattaggagaactggctctgctgtcagaccacctctgccacttctgtagaataccctggtagaatggcacttcacctctacacctcagttttcacattaggaaaatgggaaagataaactctgtgtgtgttgggcacctggcctagcacttccagtatggaatatctgcaacatttttttcttcacacatatccttattttcctgctttgtctagtatatggatttcccagaagttgtttttaagttgaagttttgaaaatcatgtcatacaggaaatgaactggaaaaacgatttgaaggaagtgatgttaaaaattattatattggccaggcgcagtggctcatgcctgtaatcccagaactttgggaggccgaggcgggcggatcacgatgtcaggagattgagatcctggctaacacggtgaaaccccgtctctactaaaaatacaaaaacaaaattagccgggtgtggtggcgggcgcctgtagttccagctacttgggaggctggggtgggagaatggcgtgaacccaggaggcagagcttgcagtgagccaagatcgtgccactgcactccagcctgggtgacagagggagactccatctcaaaaaaaaaaattattttattaaatggagaatcactttgcaaagaaaataattattcttacggtttctctattttgtgagatcagtccttgtaagttgaataaaaattctagatatatgaactccatgttagagattcacttaattctctcatttcgtaggagaaaaataaaactcaaataaattaattgaaatgcatttaaaacccaagcttttagcagaattagaattagagctcagaccagtgcattgtctttacccctccaaaagcgatttcaagagaatggtcacgcttccttaggcctgtttgtttttaatggtattccaggtgagacttctttcaccgctgtcaactgtggctgtgctacagaacaggtagtatttagtcttccactttgaccttgaccctttacctttactactgtatgaatgatccactaatgtggagcattttacgtgactcaatccgatagaaagtatctgctgtttaggaaataagagttgtactcctttttttaagtttacatcactggtaatattcactttatcattgccttataaacctgctggttacctgtctacagagaaatcagtctgatattctaaaacaattgatttttatttagacagaattaccaacgaaatggcagcacacattttgtttctgtaatagaaggtgctaagtggttgtgcccacagagataggtggttctatgagtgcagattcagaggtcacatagacgagagtgtagagacaaacctttctaggcattccccccatgggtggggatagcaggcagccctcttctgtgctttttccttggcattaatgggttcttgtactgggcagctcttggttcctgggaattctggtgcctttctgatactgtaagaaaaagatccctcttcctgccagaggacttaaaatctaatctggactcagttcagggaagctgttgtcaggctttagtttttctcagcatgagaaaggtttttttccaacaaaactgcaaacaacattcatcactctggcaaatgtattaaataaataccttaattttctaaaaatctatcagttcaaggtttctgccattctcctgaggttacttcagaattcaaagacattggaagaggatgagcgggtaccagagacctactccttagtggggctgtcatccttgcaggcgtcttcagagatacccagcccattcttatatgagattcgaggggccttgttcattagttagtcttactaatcacttggaactccaaggctttggcttttgaaactataatcccttatctctgcttttcttatgcatttctttccactgactgaatacggtgagtgcaaaggaacataagaaaacataggaagataaaccttagttaacatgaatcactacacattgtgttttgtgatttgttaaaactttacttgtgttgtcattaaagaaaataatgcattgctttttaaaataaacttacagttggtataatttaattgtatttatcaggtaaactgagttaattatctgtaaaatcatcgtcagttacatgtgagaaaaacattacttctgctcacataaacagtagagattatcatattaaaaatttaaaatgatggtgaattttgtttctctcactaaatagtgttgttttgggtgagagagttctgaagaagaactgaagaaccctccctgtctttcactgagcaagtgctgcatgagagtctgttatatatcaagcacttagtatggactgcgtccagtgtgttctttattttgcgtgtcctgtgggtccatgcagttgaaggcagagtggatcagttcagttatcataaaatatcattgatggtactcttgtttttctagtgtctatcaaatagttgttgaggaagaacgtcctcgaagaactaaaaagacgacagaaatcttaaagtgctacccagtgccaattcacttccagaatgcttctctgctgaactcacagtactactttgctgcagaatttcctgcagacagcctccaagctgcgcagccttttacaattggtgataataagacatataatggatactggaacactccccttctcccctataaaagctacagaatttatttccaagctgctagtagagccaatggggtaagttgtacagataactgtttacttaggctatttggggttgttaatgtgaacatagattaagtaaaatagtagtaaaatggaagtcatgcttttctgcatttctacttgtaaacaaatgtgattttcttctcttaaaattatttttgtctagagaaatttatggaaagaaacaaatatactcatctttttttttttttgattgggggagtttatcatcaacatgataggttttattttcagttttcctgttaccaaaagttggctggcaattctgcttagcttactattttacaggaagacagtatagctccaacacatacattcagctcatttaaaattttgtgagattcacagcatctgtcttttcagcatagtctgtcccattaaagaaatgggaactgaagaagttccacaagagtttctacttcctatactttgactaaatttggtatcttttttttttcctaagagaaaatagaaaaatgagacggaaacaaaataaaaagtgtcatttctgaatttgcttccccttcctgctcagaccaacccagaactctgataagattgtaaactctccttagacagaaggaaatgtttcgcagataccacagtgggtccctccttcgcagcataggtctaggtatcgtggtcaacttgacttttgccggtgtaaaggggggaaatctgagatgcatcatgcttctccaatactgtttgctcaggggcaaagtacagatctggtcctttactttacctccttactaaaggaggtccggggccaccaggcagagacattttatgtgtagctccttgctcatcacctggtctagaaatgcccagcactgcctgccactggagccagaaaatgtatctgagtatggttcaaagaataattgctgtgtgattaaagacacgctcagaacagtgagatccttccttatcagtgctatttaaatagaattacagatatttctatttgtcttaaagaaaacatgaataatgatttttccctctctttatttgacacaggaaaccaaaatagactgtgtccaagtggccacaaaaggtaggttgaaattgtgggatattctcctaattaatgttccttaaaagtttattttaacctatgtttcaaaactttttgaactggaacttaattgaaaataaaatgtgtgtattatatatacatatatatatatgcatgaatgcatgtatgtattaggatctgatggtaattaacattgactgactggaactcatatagatactttttaaaataagaagctatatttctgtgttccaagcagttttcaatagttacctttttcagattttttcaaatgactttaatttttatatgatctcagtacacgttttttaatccatagtgtcatgcctggtagtaccacatctagtgaatcttcatatgcaaaggaataaaatatcacccactatttttaagtagttctctagttataatagcagtagaaagtggagtctacgcgggcttttttcactggtggtgcgtgtctctctgaacctagtaaccaggttatgttgctgtggagcatctatttcccaagcctggttaaaactctctgagagaatgtgatagaggatgagctgcaaaagtgggtagggcgagttaccctgagctcccccagcatctcctgcagaagcaagtgcagacgtgtgtttgtgaacatgagctgtcatctggtcaacttgacagtgttgttttaaccgtcacatacagaaatgtataagaaatgctttgagaaatttaaaatgtcgtcttaaaatgaggcaatataaattaacactcaaagtcaaatacaatcatttagatcattggagtaaccatgaatacagtgggaagttctgtatgatttaatttagagacgatggtaaaaacacatcattaggtctgtagcagaagatttaatcaggtcatacttgatgagttgtgttggataaaataactttttgttgttgtttaactctcaggtgaacatagtttgaatataccatgatgtacatgtgcattttcaaaattctcactgaattcttattttgtgaacttacatgactcttttagtcagtgttagctcaacaaatatttcttggttgcatgttttgtgccaggcattgtgtgaggtactcacctcatttgtatcttgtttgtcctcataggcttgtagttctatatccaaaaatctatttatactaattttaaaacactcaatttttatatcatattgtacctaagtgactttatgtatagaaataaattgatatttactgaaattatagctgcttatgtgtttcataaactgccgtatgctatcagctattaattattacaggacgatgaagcccttgaaccaggtatccattgatgctcttagatctcaagattatggtccatactcaacaacaggaatttcaaaatactgctgtattacatttcacttacacttaaggtctgaaaaagtaaatcctgttccagggcccctagtttataatgcttaacgtttaacgtcacagctgaaagttttgaaatctctttcatgcgtgtgttctcatttatttcttcattactatgaaaagggaaacaggtactgctattcttatttttaagatgaggaaaaggtgtatttttggagacgaattgactcaccaaggtgactcagctgataatctgggggtcaaggcctgcactcctagccccagtgtttctttcaccattgctcatggctcgtcacccagcagcacctctggccagtgacagtattgtgtagtgtaagcatcagacctcctcttggtgaggattgagtcactgcccaatttactgtgaaaacaacaaaatatctgtcatcatgctcatttacatagttaaataattatataaataacacactagtaaatgtggaaacctgacaagtttgctgttttcacaatagattgaattagatagtgatttggatcattttcttccatcagctagatttcatcaatattgtaatttgtttttcaattcaccaaaggatgattaagcaatcagatgacctgattgactaaatattccccactcctattttctgagtcatttgcaaacatttacacagcaacaaactctatccaaagaacctcttttggggaaagagggacacattttaatatttcctgcataacattgtcattctgtttcataaaatcacagcacaagaggaaaccttggaagatattctccctccaggcaaaactacactgttttgtgctattttattaagttctacatggacggattcatcaaccctcctttcagcacagtgtaatgtttcaccaccttttagtcagaaaatgtgtccctattgatactagaaattctcttgcaacatgggaagccattccatcttgactacatagtcaaaacagagaaataggaagatctaataactgttgataccacagagtaaagatgtttaaaatgtagaagagttcaaacatcctgagtgtgtgttgccacatactgctcacagtgcgatggcttaattgagttttcagatacagaattgctttcctaagcaacattttgaatgtacaaagatttcaatgttctcctgaaacaactgttgacaagtatctttatagagaaagtatggaggtggatttgttttcactaagagctagcttataatttaaagtaagggtatgtctcttaaaaatatatttcatactatttataaatttaatgcagtgattattttaatcatattccaaagacatattttgacactcatcatcttaaatataaacttcataaaagttagacaggaaaaaacctaagctgtattattatatatctccatacgtgtgggggattgcctatatttttatgcatcctcttcgtttatgcacctagatgaatttcctataggtacaagttaactataggcaaactcatcacagaatattctctcttgagttaaaagataaagacaccataaaccagggtatacgtgatgtttatgtgttacctgcccaattcaagggattgtttttaattgtatagtggagtgaatagagtagcttttaaatatttcttaaaatctatgaaattgtatttttcattaacattcacatttttatagttggatttttttatgaccatttggtccaactgtgttttagtgattagtgtatgtgttttctttagcttttatattcaccatggtggtctcatggtaactagtagggtggaaactctttgcagctagttttagaaggcttcattgatgatcaattctaaacttgtagggtacactaaaaaatccaaatgtgttattagtaagttaatttcttatattgaatgaggtctattcattctaattgatgtaacaatcagtttaaagtatgcacattatattaatcttccataaaataagattttttcataatatgttagcaccgcatgtttgtccttggcagtatagccatttgggagctttcctgttgttcatttaaaaattatttgagtgcctccttgatttataaaagtgctttggggtttttttgggttttgatatatggggagcagtcatatatgttaatttgatcctctccttgctgttatttgactattgtctagctcaagcttgtacaacccatggcccttgggccacatgcagccccggatggctttgaatgcttcccagcacgaatttttaagctttcttaaatcattatgagatttggctgggcatggtggctcacgcctgtaatcccagcactttgggaggctgaaacaagaggaccacctgaggtcaggagttcaagaccagcctggccaacatggcgaaaccccgtctctactaaaaatacaaaaattagccgggcgcagtggtgggtgcctttaatcccagctactttcaaggctgaggcaggagaatcacttgaccccgggaggcagaggttgcagtgagctgagattgcaccattgcattccagaccagaagacagagtgacattccatctcaaaaaaaaaaaaataaatatatatatatatatatatgagatttatacatgggcttttttttttaagctcatcagctgttgttagtgtattttacatgtggcccaagacacttcttcttcttccagggtggcccagggaagtcaaaagattggacacccctggtctagctagaagtcaaagcaaaaacttcacgtaaacacatgctgaattattttccaaaactattagaaaaatcagactgtaagccttaaacaaaaagaaaacaaagcatttttcaatgttatattttaagggactttttcatgaaaaagttattcatttcactgtttttgtaagtaacattttatttaagttaaatttgtaatggaatgtgaatatggcttattggaagaccttgaggaaactttgaaggatttccattgtcctgatataatttctagattcagaaatttgaatgtttctttttttaatcactaagctttttgagaagtttctacagactgtttttctgttcactgttttgttcaatgaaataccatcctttgtaggccataatggtacagaatgaaagagcgctgataaaagaactgaaaagaatgtctgttgagatgtaaagctaattaagattccgtttaatttctcatattctctacatgagaaaaccaattatatagcaagaccactcatatatgctaatctgctgttatttaggctttggattttgaaataggaacattaacattcatcgttcagcattttatagagaaaatgtacttttttcatgtctgaaatagtctttataatgtacatcatgagtatattaaggccccctgagaagttcctaaagaaaagaatccggaaaaaccctatgctttccaaatttatttgatccgaattcattttttaaggaacactcgagtcatgcaaaatgcagttaggtaaatgctggctcaacaagcttccaggagatcccgctgcacgtaactgaaatgaccatttagaagtctgatccacagggaccttacatttatcagcaccagatattgtcttcaaagtgtaggattggaatttctgtctttattccaattttatactttgaagacaatatctggagctgataaatcctttatcttttttcattataaaagagaatatcaccaaacttagtgataattctcttttataatgcatctttattgatattttaagttagaggtcagcaaactttttatgttaagggccagataataaatatttgaggccttgtgggccatatggtctctgtcacaactacgcaggtctgctcttgctgggcaagagcagccataggcaatacattaacaattaagcatgtgttccaataaaactttatttgcaaaagcaggtggtaggcctgctggcccatttgaagataaagtatagcataatcaaattttttcctcatgactaaaaataatagttacaaataaacactttacaaagcagaacatagagatcatataaaaatccttcctggtatttataatatactttttacatggtagacttagcttctgattatagtttgagttcctttttatttgtgaatacctggctgactgacatagctattttcgagtaactttttgttcatattgtttacctttttggatattaggtgctctgtttctctttttctttttctttctttctttctttttttttttttttcttgagacagtgtcttcctctgttgctcaggctggagtgtagtggcgcgatctctgctcactattgcaacctctgcctcctgtgttcaagcagtcctcctgcctcagcctcccaagtagctgggactacaggcgcaagctaccacgctagactaatttttgtaatttttttagagatggggtttcaccatgttattcatttgatcttaaactcctgagctcaagcgatccacccacctcagcctcccaaagtgctgggattactggtgtgaaccacggcacctggcctgctctgtttttctataaaacaatttcatttttctcaaaaggagaacaggtcagactctcctacagataatgcggaactgcataggagtattggttggagcaacagtagtctatgaccaaacaaaaatgttatgtgtataaaacttggaattggtaccaactttgtaaccatcttagaaataacattttactgtgtacagcttattataacagtattcaaaattgcataatacgtcatattaagaaaattatctctgtaatgcgttaatgcactgggagctgcctattctctgaccaaactgttagtttgttaatctcacttaacaaaactagaatatgttcattaataatgtgtgaaagactgttacaccatttttaactcagttgctgcagttgtctagttgtaagcagcactgcttgcatggtgcagagggatatttcaaaatattatgcagcagcagttttgggtttaattgtctgcagatggtagatgatctattttccttactcgctgccacatttctaatagtacccaggctgttccatgtaaattagtaatctttcatgtaagcctgtccttaattttccaatatttttttgcatcattttccagctgtatcatgttagaactgatgttttaattttctattttttttaaatatctgtgtgtcattaatgttaaccacttaaacacaactgctgagctgtgcaggcaaactaagaagccagcctggtctgcttcaagactcttaatcatttctttgttcacatgttaaccatgataactatagcaaaggcaattcgtagtttctattcttttccaaccaatacttggagatgcattttttattctcttaaagtgaaaaaataaagttcctgaatggaaagctgcatgaaatttagatatcagagaaatttttctacataaaaacgtttttagtgaaagagtgtaatattcttctttacaaaagggatttagtaagaagagaaaacattgtgatttcaacaatagaatgttgaaaaacctaatacgttctaaaagcctaaagtttggatcaccagaattaacaatgaatctttcagcaccacactcaatttcaattggaaacactgctcagtcttcacctttatttaggatgaatgtttttggttttgttttcctttttttcttcttcagttgatctatccaagatctcagccaaaccttgcaactgtgtcatagttagaaatccaactgcctgactagagcttgtttaagggaaaagaattcagaatattcagcaccttgctatgttttttttttctttttttccttttctttttgttgttgttagaacaaagttgagacaatttgatatactgatggggattcttcttgctagcctagcttcagtctggcttttttttccctcatgcatgctgacctggaaatcctcctttgccttagctgcgataatcgtgactcagcttacaacaccttacattcgcatcgcccccgctgcaggcgacggccaactaacaggtcagatgttcaagtatagacgagtcatcttgcccatttcccactcatttttctcagctctgtttcccctctacatttcctcctttgcttaaggcctgtttacaatgtttcagacccttggtacagacctttgctcgtattaaattaagtgacatgcttggcctcttctgtgtgcacatttatatccatgcattaagtacaactccactgcatgttttcattgtgtgtttggtctgttggtatgtttctttctagactaatgttatatagaaatgaaatttgctggacttgaaatagcaataacatcaaacagggtttccaacaaaatacataaagatatattcctagttttccaaattagtctaaaatggtattcagatttgagggtgcaagagatttattttttaccttgcctggtctagtttgcacatacatttagctatacacaatcttggctgccagtagtattaaacgaagccccccaaaggtgtttagggtggcagtgttctaacagctttgtgtgtatgtacaatagttgcagagctgattgcattccttatagatccttgtttcaaagcatagtgtttatataaatcatgcagtggcatatctgcaagtcaaatgctttgaataatttaggaaagtttagaaaaattgaatggcttagagtcatggagttgaactgtgcttccttataccaagagaagtgagcttgttcactcttccctctaaagccttatagacatctctatacattcatataggaaaagagtccagtaaattacttcagattgaaggtgagtagttagtgaactccaaaagacaaacttttttgcttcagcaaaggcaagtcattgtcaagatttctaacatgattacctgagcaggactcaaaattctggtttcagaagcacctgcttacagtctaggcctgatgaaagccaagtaagaagcagaaactactttctatatgattttcactccagcaattgttttttgtgtgtgaaactaggcaatgtcccctaacatttaagaaaatggtaaagcttaactcatggtagtaaattacaaatgtttaagttgttctgtgaacttattattttggacagtaaagaaaactaagcctcaggaaaattgtagactgatgttataaggtaaagaaatgtaaaataattctatttccttctccactggaattctgtacatattttcagttttaaagctatcaatttattgacagttctgttgcccttgcctgcaagtttcttttaagagtatttcttttcctgattgaagttctacttgttacagactcttcctgctcctgaacttctgaagtgttcttcccacaagtaaaagtatttgagggacagtgcctttcttaataagtcctcccctctaaaaccttgacctttcaggactggcctgtggcactctgtgtagggttaggagtccatcttgaaggttattgggatccttcagcaactctgaccacccattgtgtctgagctggccccagactcatcagtacattgttaaaaatgggttgttcccaccttcataaaacaagtacttatgaaatataattcagtagtccttttaccaagctttacctataatccactaacttcagatgaagcatgctgtttactaggaatgaagtaagcgaggcttctgaatatagttttcactctaaaactcgcctgattcagaagatacttcataaagcagcccccgtcgtaaggcatttagacacagtgagtgtcattattttggagctagtctgaaggacacacacacaactgcagtgcatggctgctattcctcctaagggctacaggtgatctacctcatttactttggtttattagggattaaaatgatggtgtatcagaataagcctcaaaaaccagtaaaaaactactcttgttctttcttcagtatttactgctggttttaatgatggttagtcttacccagataaattcacactcaaataatatttcttttgcattttccatttgcatcacccatcaacttcgatagcagtgacactgtcttttttaagggatttattcatgagtcatactgcaagcctgagacttaattcattcagtcatttatttgacatttattgagcaccttatgtgtgccaggtatgaatcgaccaactcttttcaggagttttactttgtatggttgcctagacaccttggcatcaagtacatttgtattagtaaccccaaaacctacataagtgcatactcagatgagtgaaaaattggtatcatacttatcatttagcaaagctaagaaaagacagcagttttataactgatgggaaccaaaggacctgtatttcaaaccgtttctcactgtggtaaacagcctaggaagtggtcagtgtgacagctctgaacattttctatctgtgacccattcaaccgttgtgtttaatagatcaatcctgtcccttccagaagccaatagaagatataggaggtatacattctgaagtcttcagccattttttgttcattttgttctaactgtgctgacatcttgcccctaaaaatcctatttgatgctatacttgcactgggaagcttttgtgagatgatgagtcctttgccttgctgtccctgttgtactggtacgtggtgcttgctggttaggtttcccttggtgtaggtgggccctcccctacttgtctaccaccaatgaaaacaagaaccttggtgatctgaccccagcacctaggactgtgccaggcatgatagccactcaggaggctgaggcaggagaattgcttgaacccgggaggcagaggttacagtgagctgagatcaagctactgcactccagcctgggtgacagagtgagactctgtctcaaaaaaaaaaaaaaagtgctcataaatatttcttgactgagttcattgaacggcccagttgtcaggagggttccagagaaggaatttgtggaatgctaggacatttcatgagcagtcctgtcattgcactagggagtgttgcttaaacttcttgaccccaatcaatgataagaaatacataactacccagtactgtatatacacatatacatacatgtacatttaactgtaatgaaaacttttagaaccgtacttccaacactactcactgcaaacataagatataccctgatttttgtattctgttctacattattctttttcatttttttaaaaaaaattctggttgctgccttctaaattgatttcatttcccgttaatgagttgtcatccacaatttttaaaaaaatgctttgctaagttactaactagatttaggagatagtaaaggggagtggaatgtctgattggaatgaaggttctgtctacctcagaaatcctactctaaagagtacacacagagtaagttctagaaattggaaatgcccctagtctctttcttccttttatctcgcgattcactgttcataatacagaaatgatttgggaagaaagtagaaagctatacatggtaggaatttctctttaaaaactttttatttttcacatatatctaggctttttaaattaagatatctttgtttatgatttaataacccagccaaccctgacatgctgtggagaatgctatatgtgtgtgtatacatatatatatatatatatatatatatatatatatatatatatatatatatattttaaatcagtagacctttccattgcaaataaaacaaatcctaggtgtttcaactcacaaaagcatgaaacagcattgtctgtctgtcttgttcccagtgtagcccacaggcacccaggaagtgtttcaaattgtttgctgaatgactgaatgaataacagttgatgacctgtcttactaaatttattcctaggtattgtatagctttcatttattattgtgagtaaattttgattgaggggaggaatattttgaaattggtttattttgtcttcttttgactgattttatgttactttatgcaagattgcaaaatatctctttttaatatgtatatatatataaatttaataagcttttccattgcaaataaaacaaaccaatggtttttcaacccacttacaaaagcataatttcgatcacccatttcttttggcaagagccataaaaaggttgaatgttaattgattttctaagagaatgacccagccactcccaccaacattatctgttttcctcctactctgctgactgtctgtccatttctctacttcccaccagtcagatcccatctcacatcctaagtcctctttatcttcagtaaaccgtggcagagctaagatgtaggtagataatgtctgtccttctggggacccaaggttctctatttgtaagatgaagatataactgattggatcttagccacactgagtagcaaggaggacagtatatggcttgaagatggtgggattgtttactgaacattagcttagttagtagcagtaacagcaggtacaaaggtccggtggtgtgatgaagcatggtcagatatgaagaattgcagaaaggtcatcatggctggagagcagagagcgaaaaggatgtgtggggtgagcagtaaggtgatacaggcagagcaaggccaactgtgaccgtgtaccttacattaaggactttggtcttgatcccaggaggagtgggaagcaattggagtgttttaggagagacagaaaggatcagttttgcactgtgtactccaagccacactagaaacattggagaagagatgaaaaaggccaaaagaccaaaagtaaaactataagaaatggaagactgtccaacacactggaaaaaaaagaacagagtaagtagatgtgaatagaagaggtaaaagccaggaattaatacagtaagtactggtcatggggaatggatcagctgcagccagcatggaggagcacatgctagggaacttaagggacagggtcagccatatcaaaggaatgcttagaatcccttccaggggccatattttatatatctttaaactttcctcagcctgccactcagtgcttggcacatgaacggcactcagagtccagctgtattgtttttttttttttttttgatgggatgaagttatttgtaaaagataaaattcccttgaagggtgaactaattttcacactgctttttaaaaaaaataacatccttgccacagtggcacttccacctgtgactgcagtcagggtgaatgtggtttcaggaggggcaactggaccaagagctacacagaccccctccagttagccttccttcagacggtgcatacagtttagctctgacagaaaccaaagttgcagctttctgtccctgaaatatgtagctttagggagctgtcctgtgagcactatcctctactactagagaagctatcattcattcattcattcattcactcattcattgtttccatcgatgcgctttcaccccctaggagagctggccctaccatgagctctacataagagaggaggaacattcatggaagtgtagggtatgctctttgctctgcaggaacttatatttagtgcctttgttaagaccaacataaacagttcaataaatgctccacttccataagcttaccaacaccttgaactatttgtaatagtggtaagtgggtaatgaactaagttaacatatactcagttgcactcgaaaacgtactatctctatgataccagagtcattttcagtgtcagaagcttcaatttaaccttttgagagaattttggataaaaattaagggaagaaaatgcctcctttagatttctttgtaaataaaagatggctaaactcttcatttaagcagataaccaactgattgaaagtagtggctaacttaaaactaccattttccaactaactaggtatcttactttttgtcaaatgtagtattctgtaaatataagatgattaacaattcacacacactgttgtgggcatttcatattaaatggcagagggggatatcagtgctatgtgtttcagctacggaagttaatatagagggttggtgtgaggagaatttgagatttttgagattttcagcatctctttcaagggctgcttgaggattctgaaatttcctttctggctagaaagaatgtaaaatgagggtaaaattttattctttctgcaataccagctgactgcattttaatgggctatagtgtcactgttgatttattgccctttttgttcttttatgtgttatatttgtcattttgctgtggcagtttcatctataaaacagtatagttacaagaaaatggtgagaggatacaggcatgccatgagggatgctgttgcttttttcttgtcattatttggaatggaatactgagtcaaatgtcaagtatttgatttcagaaacaatatattttaaaatctctatattgcactgaaatagtattattttccatttgtattatgtaaacttaagaatttctatgtaaaagattttcaatgtataaaaacaatttaattttttgataccattttgtggttttcttttctatcagcagtgtgatgaaggaaaccaaaacaatattttatactgtcttttgtttgcttaaggcatagagctttctggcttgaatggcatatattgaaatttcatattttaggaaacctaacttttaattttgacgttaatttggtgtattacgcatatccaaaaagaatactgaaaagaaagttttgagctcaaaattagccaagagtttggtaaaagatacgaaatactgtgaaaaagaaagtactttcagtttaaaaaacacttgaagatttttgcatgaaagattttatattgatagtgaaattgttcttgcctttttgataaggaaatatattatttcaatttttaagaaaattaaaccagttcattcttgatgttaataaaaatgagaaaggctgaatgttttttaagtatttatcaaagctgaataacaatatctgtgtcactagttctttatctttactctggtgactagcatggaactagacacatagttgctgttccctggctgtactgttgatagataccaattgtgatattttgattttcatccatttatttattttaggaaattattactacaatttaaagtataaggaatcaatattcagtctaacagttttcagtctaaagatcccagtgatgtcccttagcatctgtaggcaaatggctgtgttgtactgctgtgtgattaacgttgtggttgactttggatttaggctctcttgtacataaacacttttagattactattattataaaatacctagtatttgtgagagttctttgaaaatatttatggttgtgttccaatatattagatccattcagaatggaaaggaagtcagaatttccgtcatcatcataagacagcaggatgtagaggaggcaacagatcaagaaaatatcaagaattaatttagaataaatgatacccctttttgaagaaaggattcttgttttaaatactttcaccaaccttgtcaaaaaatcaagggagaagtcaggctggtgaatggaaagagaaaaagcacagtccttagaggagatgcacctcatttgccctttcagcaatatcagtgtgaaacgtgttcttccatgtctccaatgggctgagagtgaggcccaaagtcttttaaaagttgtcttctaagattctatcatgttaaaaatatcacctgcctccccattctgcaacatgcacatactacttttctacttttaggattgctgctgttgtttttaatgtgaaaggatcttggatttggcgttcatttctgattatttctcaagtcatggcttttccagcttagctaccctatattcttgaaataacctctctctgtctggggaggttgtccttaggaaaaggggaggagaggtcgctctccatggtggaactgttgagtgagagccgttgtccagctgctgtcccatctcaaatgcttgttgactggaaagcctgggctccatgaaaccgcaaggccaagcatggtgcatcttctgggagcatcactttccttgatgataaataatgcaaaaacgtttttgtcaaaaattgatgtattgtggaatgaaatgcaacatttgcatgctttattagaaagatcaaaagtcttaaaagaaagatcgacagtcttaataaaaatgtcaagcttgcagtgggccacctaagataaagctgagcttcctgctggaatttgttctctctccttcccttaatggtacagatgataggaaagtgtacctcaggggtagactccagatcattttcaaacccacatggcccacttcattggcagttttctaacatgttagataggaatctggacttaacagttccctaactgtgattttaaaagggaaattcacacaggaactctggaacccaatgcacacagtttagaaagcatgtacacagcaagcagtgggttcaagtccaggcttcttggggaaatctcttgatctctcaacatctcagcttccatatctgtaaaacagggagaatactatttctttacctcatagttagtggtgagacatcgagtgcaaaaatgcacgtagagtagagcacaaacctggctccaagggaaggcagtggaaatagcagttgctggtgcttctcatgtggctttgttgttgttactctaatataggattgttttatggcccatgaggctttcaagatgactcagtaattaatccaggccactgccagtcccaagttgacactgcagctcttcagagacattcaaaattgaacttctgggaaaatgaatggatttcttgacagtatgtagggtattatttacttgaacaccatgtggatgctgtggtctccaggagcaccgaagcaagagagggacattattattctgtcacatgtgaagacctgtgatgagtctcccactgatgatattttccatttacctgtctttgggataaaagcagcatcagcatgacccaggctgttaccttgctgttggcaatgataagcaatgctggtgttggtgatgctgatgaataaagttactgcattttcaaatacagctattttatttcaagcagtaatagcccaaaacagagcataacctattttatacttccctgccacccagcacactgaatagaacaccaggctccctttcttggccatttgaggttcctttgtccctcagcgtccttagtttagatgaggatgcctttctttgtgtttatatttcaacagcatcagttctcaagagagcatgaggggatgcactttaatagaactctattatatggattatagatatcttatgtaataaccttttcagacactaagtatgaaagtagacaaatataaagctatttgtaagggaatgagaagtcttacttagaagcagggcttagccacgaattttcttcaacatgctgtttttctgtttagaggaataaataactgtctctgagaaacaatgtttgaaaataaacttggcacctgcctaggagttaataaatggcatctgcttagtatatcgatcagtatctctgatgagcttttccatttgctctagtaaatatccaagcaatgcatcactttagcagtgtaactgatgttcagtttaatatgtgtaatttacttattggtgttgctaatgatgcagttattaattatggcttattattaattataacatagtttattcaagttggagctcttagtcaaaacacatactggcataccaacttttgtctgagattttgtgtaggtgttgtccttacagtgatttaatttggtattttttactcaggattttatgtaatacctcttcacagtaaacatgataaacaaaagtctttgtgattgtagtaccaattcagtgggttctccttatatgtctttgaataatttctttagatattggtatatgtttatgtacaaatgcacacacgtgcacataggtaaagacagcatcaaagtgagttgcatgtgtcttttagccagtttagggacttaataaagggaattatttatatttctgccttacttctatgagtaacaaagtccgaaaatgctcccatggtaggatcataggactgcaatagccattttgttaaataaaattacttttaatagtttgaatcctactaattatcttattagacatttctctgttttttactttctgaagagccccagaccattgtaattaatatacagcagaaattttggctagtttaaagacttctaaaacaaactccatatacaatcatgacaaattacctatatctatttaatcattgcaagtattgagtttataacactttattcttgacagatactcactttgtgtctctctgatatgtacctagttaacgttctagtcattgttggatatatatttcacagcgttgagtgctgaagatataacgttttgccactagtatttatttccatgctcttacttcctgttagtctctttttatcattgatgaaagtttggccagcaaattttctggtaaggattttgtcttagtctgttttctgcagctgtaacagaataccacaaatcaggtcatttataaacaataaaaatttatttgactcatggttctggaggctgggcaatccaagagcattttgctggtatctggtagggtcatctcatgaaagaaggcagaagcaagcaagagagacagagaggagaaatcagaccaaactcatccttttatcagaaacccacttccacaataatgacattaatccattcatgagaactctgacctcatgacttaatcatctcttaaggactccacctcttaatactgactcttacaatggcaactaaatttgcaacatgaattttgcagaggacattcaaaccacagtagactctcatctgtcatcaccatactaagaaaaacccttcttttcttcctggccatctcttggcatcctcagtggagctcatgttcaaacatcttccttctttcttagcatgtgagggccacaaagatgagtaagactacttttgtctcaaggaatttatgtttagtgtatgacataaagatttaccaaaataactgaacttgagtttgaaaatagttaagttctgtgcaagaggggacaagcaaggtgctctaggagttcagcaggagagagaatacttttctgcaaagcaattaggagcagtagttggaatgtgtggcctttgaagatggataggatttgaacctacacaaattgagtagggaaagctcctatgcagcaggagcaaaggccttgggaagggaaatattgagggtttggggaaattgggcatttccgtttggtgtatttcagaaaggagggtggcataatattaggaaagggggttggagttagctcatggaaggccttttgaaataatcatttagaagctcttggatttgattttgtttttttaaatgaaagagtgacttgattggagctattatttaggaagatccatacggctgcactatgtcaaagacactggctaaggtatctacttgggagtcaggcataaaaatccagaagagaaatagatggcagtgagaataaagaaaaaaatatgtagcatttttagacttgttagagattgggaaggacagtaataactgacctctctagtgtcagatgacaattctttaacccaagggcggaataaacctcctttgtaatttattccagtttcatggactgaatacaaccaaaattcatttacttgctcttttactgaatactgactacattgtgcatagacaggggaaagcctctctcagcctttctctgtacaaacttgaactcctgcttttacacttatatgttcaaaaatatttttctccatctatacacagaccactcatggttattgttctctttacaaatgcttcttgtgtcttttacaatatccgttcagtaaaggcttgtcaaatgcccaccgtgttaaagagactgttaatcactagacagcaaaggtggtaagaaatgatctttactcttgggaagctccgatggcaggtcacctgcttgccttctcctgcattagataaatgaccctagttccttttatccttcttcgtagtccttcttttttacctcgttgatcatttgtgcttcttttctttgattccttttcctcatccacatgatgactagtatatcatgctccaggattatgtgcatgccattactctcatacatttcagaattgtattgatcatattaccagatctttcttttctgcactttggccaggaagtcctttctcctcttgtttttctttcggaattattagttccttattgaattgttcattctttcctttttcattctttcctttttcattcttttgttaggccctcctctttacaactgaccaagatcacttttaacttgagtcttgtattccatagcatgagcaataaccacttgagttttctgtattatattggggaatgctgtagtgcaatgaaataggagtcagcttcacagtcagacaccctgggttcagagtatagcaccattccttctctttcactgacttaggacaagctgtttatcttgatggcttctgttgcttcagtttcctcatttgtaaactggtattaattatacttcatggtataatattaaataaaaattatataagttacccagcatataaagtaggtcttcaaaaagattagttttcttccttcctatcttatttagtagcacccaggcagttgatcaatatactttaaattcctttacaattcagagtgtcttccaatctctacatactggggctagtcataaatgaggatttgattccaccacgtttgcctcttcattgtataaaaggatcttttcaaatagtgcaatcaatgatggaaattggatcgctgagaaagtaagatattattatattaggagatgttttaaggataacaacacaattacattttttttctcattttgccatagtctgaaaaacttccccactcatactttggagccatagttctagagttggttttttctccatgttgtgtagggaatccccaaaagtgttacatagattcctgggtcctacctcagacctttgatccagaatccacggggaacccagccatctgcatgtttcaaagctctccaaatgattcttcacccagcctgagttttaaacttcctataattggagaccctctgttttagaatatattaaacacaacgccacaataaatataagccatatttattaaagccatttattgtttgaggaactattgtgtgtttactaaatgagagtctggagagtacatgacttccactctctcctaagaccgtgtgagtcctcatcacaattctaaaaggccatcttttgtgtgtgtagttcttaggccctgtgaaagtcatgtcacacatctcatgcaatttgctaggctctacattttttgagcctcagaaatactgatacttctagcaagcatacagaatagactaggtatacttactttttgatgagatggtgaatgacaaatttcagacagcaggaaaagctctaagtggtttttgcaaacaacaactactttgtgtaggaagctgtggtgatcctttctcccacaggaaaaaatgttaagaggtaaacacgaggtctagaccatgacctaaaatacaaatctggaagaaattttgagagacagtaggtttccattttaatgccttcaaagtttagtttcaagcaaatggttggaaacttccattctgaactacatcaccttcaagaatcatctgttttggaagcagccacccccacttcctttcttgattattcacttatgtgaaagttgcacacagttgataacttattattgacagtttgtttccctattttattacttgataatgatttgagaaattcaaatggaaaaaataaaactatttcatcaaaatagtaagagcagtaataattctcttggacttttagtgtccagatgataagtgataaggctttgatagatcatcttctccacagggcgtcagccacatcaataaatgaggcagtaactgtcatgaaattagaacaaaaataaaaaaaagattgatttttttagagaagatatatatcaaacaatccattatctcagtcttatatgaaaaattatgtttctgattattacttgtacattgtatatgctctgtttgccctacactggaaattagggacagaagaagagttataaattcaaaagcataatcaggttacaaagaatacacaaaatgtgactgtagattattccaggaatagtgattgacttcgcattcccaggaagaaaaacaataatatgtaatttaaatgaaaaatctaggaggtgttttgtgattatgtataatgtgaagaaggaacagctggaaaaaaactaaacaagactgcaaaggattttaattctctgggcaacaagacctgaatgaactgtctcacaatgatctttaaaacaaggatgttgctgtttttaagaaaaagtatagaaatttacctctgcatatgttcacacacacacaaaaggaaaattaattaaaatagagtattccatgaaagtcattaaaatgctagcacaaagtgatggagtactgaatttaaattttagattatcttttgggaccagtgctctttgaaacgcacttgaaggaacaatatttttacatatttccactgcttccattttattttctacttttagctcttctccctgtcgcatctcttaaggtttttcagcctcctcagcttttcttttcagcagttcccattgttactgtccttagccccttttttcttcctttctccccaaaataccaagagtggctttgtggtatttggtttgccaccgaaaccttttgcatgtggtgtgaatggggtagtttgttgctcaggttcaattcagacattgaacccaacacacagccccagctggccatgtagtcccagagccattgtgggtgttgtcacctgtacacagctgactgtgcctctgtgagtctcttgtgtcctgctcgttccagccacccttgcaattcaggcaggggaggctccaggcctgggtggggcagtagccttcccatggctccccaacttccttcccttcccttcttcagtgagcctgcgtattgctgcccagttgttctcaaggtactgttctgttattttctgtggttccttatttactaaatttaatctgggctgtcctacccagtgagcaacacccatcccaccataaagcctcagttccaaatcctcttcccaatcacccccagcccctgctccagaccctgctcttgaagctagtatgtgactccagaggcccctttgttctggcttatgaggcactcttcccacccagcgttgaagccttcccggtccttccagcccattcattatcgcagcctctgacaaggagccctccctcatcccctccactcttccccagctggactctgtagcttacctgtgacacttaaggcttctggccttatttactgtggtcaactccctgaaggaagaggcacatactcaactctaattcccctgcagagccttgttccagtaccttgagcacaaaacgtactaaataaggggctgctaattcggaggctgtggaagccaacatgagccacacatatgaacaggacagtgctggcccacgttcacggcttcgtcccttatatttagagggaacgtcaagtgtcacagggatgcttctgtatctctgatctgaacactggtcacacccctccccaatgtaagtctgagtggggatcaccccctaccttttttttttccccctcctcttccccttcttcatcctaactaggaggagtgaagagacggcccagggctctgcatgctcttggatacagccacagccccacttcccaccctcactgttggctcgtggccatcaggattgctctcactggcccaccttccccttctctctcacgccttagcccccttccaaccctgtcttctgtgtccttggaactcctggttggctaccagcagatcccacccatgcccagcctgggacatccctcccttccctcttctagacaacttcaaaactttttggcctgagatttctcacacctccgttctggtcctcagtctcccctcatcttcttggttcctttttccctgggaaaatgaagccatcaaaagagacctttcaaatgctctgctcccagaccagcgcatctgccaagagcctgtgcattgctgcgtgtgtggctttctgctgttcctctgggtgaaacatcagccctcgtggttctgcgcgctggtctcacctcccgcctctgcaagggcttccctccagcaggcagctcctttccctcccgcatcatcaacttgccctctctatggtatcattagcattcgcattcagagatgctgtcatttctcccatcttaagaaaaaaagactgtttcgtgatccctttcttcctctctggctgctccgtgcggatgctccctgtgtctgtattcgcctggacatccgcctccatgtggctgagttccatcctccttgacccgccattgtttcccttgttcacttcctaagtgtcccccggccgactcatgactgtaatcaccatcttttttatgacaacctcaaatttatcttctacacccagatctctcccctgtatatccatccaactgcctacttgctatctcttttgtatgtcaaatatctcaaacctcattggtccaaaactaaactcttggtctgcccacccacccctccaaacctgctcctcctgcagttctcgccctgtcagttagtagcagctgtgtctgtccagtgactcctgccagaaatctggttgttatcctaacacactcgacatccagttcatcggcaaaactgatggctggactgtcacagcgtgtctcaagtttgatggcatcttgccacctgcactgctaccttctcactccaagccatgagtgtcttccctgcatcttcgtaatagcctcataactgaggtccctgcctccaccgtggcccgctacagcctgcagtacacacggctgccgggatagtgttgttgaatataagccagatcaagttcctcctctgctcagaatcctcccaaggcttctcaagcagagagagtccttccagctatctaaggaggtgtccccaccctaaaattatgcttcaccttctccgcagttcaccgcactccagtcacactcagtatttcagtctcatttgcaccttttccctttttctcctccctggatgtcactctcccactccctttcctctttcaggtctctgctcgaatgttattttctcagtaattccttctccaatcccccatcctaatagctgccttgccttcaccccccagcccactccccttgatttttctctacagctagcctggccagacactgcctacaatattggtttaccttggtgtctgtcttccccacaaggatttaagttccatgaggtcagaagtttttgttttgtccatctgctcaccactgtattccttaaacagtgcttggcaagcagttagctactcaataaatgcttgttgaataaatgaagaatattgctggatttttttcctccacattcaaggtcaacctcgtactagtcaccaccgtgcaaagttctgcagctgagctgtccctgcggctcttcctaaccctgccactcccctcccgttgggaaagcttcccgttcactcggggtgaaagcagcccgtgctgtgggcagcatggtcagtagctctgggcatcactgacagccttcatggccttctgggcttgtacccttggatcttctgggaaaatttgtgcagccagttcagtagtcaaaattgggcccagacctcaagccagtggctgagtacatcgtgttctcagcctggcttgctgctgttatttaatttaatgttgaacactgggccaaagtggaattgttttctgccaagttgaaaaccagctaaatactgcattggttaatcattccatttgttttgagtttttttgtttgtttgtttgtttgttttacatactagatgttataactgaaatcttaatgcaatttgactggaataccactcttttttattttcttggccattataaaaataataaccagcgttatcactaggagtcagtagactgggcatctgtgaggattatgctctatgattttagcagtctcttaatctccctgtaatatttagcttattcaccagtgcaatgaatacgatacagtagcaggcctagataatatccactgataaatggacacatgcaagtttattctcttcaaaaggaactaaatgcacactgctgtcctaacagaatacacacaagaagagaaaatgccttttaataagcaattaaaatttatacgaaaaaaaggaaaagtttataccatgagaaacctggcaagaaaataacaagaccgagggggaaatagaatgaaaacaactcttttgccaagcagtttagaaattatactgttaaattcatagatttgggtgaggaaaaataaacaaccatcagttgcaaccatgttctgtcaaaaatatcccctgtccaaggcccgctgacaggtcataaccagaaccacatgttcccaaagcaataaaagaggagagaggagcatcctatttaaggagagcctaaagatgttcatttcaggcagggatagagggacagggcacaggcaggaaagcaggaacttcctgggcaaggggcctggagtcagtgacacccacccatcaggttatccgagggctgtttgtgtttacactgatgcttctgcagagtcctaaacccaaacacccgactcaaccggatggccactcccaggcagccctcccaccttttctgagtcactgtcccatttagcgtggttgctaccgtcatcacgttgcaactgtgtcaggccaagatagaacatttcattcccttgacctgcaatgtgaaatgagttaaaagtcagtgctaagaaatgataatactgagcttccacaggctgcatagcaatgtgcatgctgcttcctaaaggggatgaaaggctgcaggtaaccacccctccttggcccaaagcagaatagtcattcatcagttcccacagagccagaccctcctctactgagtgttcacaatgtatgcattacatgtgtgctatttttatattaaaatgtcttaaggtaaataagtttttctaaacattttttcccaagtgttgcatttagtgacataacttagttacaaaacataccttaactcatctatttaggaaatatacatggagagccagctatctataactagtgagataaatggaatggctttccagtatgtcaacatttggaagaataaaaccaatttgattttattttaaaaatttgttttaattggacacaaaatcaaaatggaaaaacagacttttttcagtttcgtgaatttcaaatgttacttctttttgtatagattgcttatttaacttaaaaaaattttgtttatccacatacacattttatctttaggtttttcttagcaatttgtttaatgtgacaatttcctcccagtcagccacctggtgatatgttccaatagaatattggagtggtgtatttcagatgtaattaccataaaggataattaacattaataccttaaagatttaactgaacaactagtttgagggatattcattgaatcaaaatagcaggacttattctcgacattgtcagaaataaaattgacctgtagaggcttcttcagaagggtttttatttcataaggtgtgttttttgcatcatggctgctgctgttgcggctctcaaatgattggaatatgctttgtcatggaaacactgacgagcttccaatttgcttcttccctgaccttgactcacttcctggggtcagtctaatgactacagccatgttcagaatgcagggcctcatgtataaaatctcaccaggaataactttggaaagaaacatcatttacatgttcccaaaggacacaaaaaaacagatggaaggtgatatctggcactccctctttctcagtgataactcattttagagtttgtcctcctggtcttgggggctcagacacagtgacaactaaggttttcgtgagtcaggtgacgtaggagtggaaaacctcatgacagagtggaaagagctggtttacaaacactccgatttaattacatttttaccaacacaaaaagaaaattctaaggaggaaaatttggacataaaattcctccattcggaatgacctgtcacctagtaagggtggtgtggctcagagcatcatcacattctgattttaaaagtacaagcccttttacaaaggagtctttttagggaattgaacattgcattcctaatatttttcatcctgaatgcacttagcagaggaaacgtatatttcatcagacatggatttgacattccattacattgtagtaaacgggacaaacatgtctcatgttttagacatgagaaaggggagctaagacagccaccaccactgtaagaccctggttatctcatttaaacagattttaaatgtgggtgccagtggtgtgatcatcagccgcttccactttgtgaataaattgcttagaaggagtcttttgcctaccagatgtgacctagatttagatttccaaaggcagggggaaaaaactctattgtgttaaaaaacaattgctggtaaaaatgcatggtaaatgagcttatctcagttttccaggtgtttggactaatatgttatggaattactgcttcgtttatgaaaaataactgaggaaaatgttccagcaaatcaaatttggataaaggcttagggatagctattgtgctgttagtaagtttttaaatggcagaaagagcaggagccaatagagataataaaataatatttttctaaaaaaaaaatgtttgagaagagtctcatagaaaagggtcaggcatgggtgtgctatccagcttgtatatggtttagtaaaatattgaagaacaatgtgaacaattacgctgctttcagtgcatatgaaagctgtttaaaaaatcaaagcttgtctgtctgctggctctgataagtcttattactctgttaaatgcagcgaaattttttaaactgtggcatctttattctctcttacctacagtctctcctttttcatttcctttcatcttcaggagctgccactccgaaaccagtcccagaacccgagaaacagacagaccatacagttaaaattgctggagtcatcgcgggcatcttgctgttcgtgattatatttcttggagttgtgttggtaatgaagaaaaggtgagctcctagctgttgccaaagatacagttatatcccattgtttgctggaatgttttgtgtgtgtgaaaattctcagttactgaactggctttgataacccagacacatctgtgactctgtgattgttaacatttttcatcatgtggcatggaaggttatgggacaaaaatttagagtaaatggctatgattctgtgtgaatacgcaaagcatatcatatcagaataaccatcctgtgtcttcccacacagtggcagataaagctctgcaaaatcttagaagccacttattcaccaggaaatgtttagtactgatttccaacatactaagacatttggtaatcacaaagatatgagaagactttactttttattatagtgaggatgatgatgatgacagattttatggggcctgtgttatatgtaggcaccgtgctagggaaggtcatcagcacaacatccatgagaaagagaacccgcaaaaacagcctgacagaaaaatgcagcgcgggagcagctcgtgttagaacaaatcacagagcaagtggtgtggctgggcaccgtggctcatgcctgtaatccccgcattttgggaggtggaggcaggtgaatcatttgatcactttatcccaggagttcgagaccagcctgggcaacatgacaaaaccctgtctctacaataaatacaaaaatttgttgggcgtggtggcacacacctgtagtctcagctactggtgaggctgagatgggaggatcactttgagctatgatcactccatggcactccagcctgggcaacagggcaaaaccctgtctccaaaaacaaacaaacaaacaaagttgtgtgttacaagagccaagggatagtctgggggagagaaaaacagatatggccataataagtgatcctcacctcccatacttgaaaactatgcagtgtcttgttttgtggaaacaagcaaaaacttgcttaataataaaatcttcgatttatgtaaaaatcaatacaaaaatatagatactaagaattgatggcataaagtttcccaaattgagggaatatgtggatcttgttcttttctctattgtttcgaaacagttgtagtcatgcattgagagtgagttcatggatgggagaaggtaaaggtggagaggttggcagagtgaagactagaaactctgatctggtcatggaaggaggttgaccttgggcctgagactgttgatggcctttgagtaggtggtaacatgatctcatttttaggaatataactctaacgttaggattggacacagtgaggaggggagagagctcaaatcaggaagaccagtagaaggaagagaaagagcaactttagaaacagttaagagttaaattttagtagccatttggagagagaagggacaatatagaaagacttagaatagttcctggtttgggcaagttagtggagatatttctgttcaccaaaatgtggaacataggaactacaaaatggggtgggggcactaaaaatggagagttcagctttgcacattttttttctttttctttattatactttaagttctgaggtacatgtgcagaatgagcagttttgttacataggtatacacgtgccatggtggtttgctttacccatcatcccatcacctatattaggtatttctcctaatgctatccctcccttaccgccctaccccctgacaggccccagggtgtgatgttcccctccctgtgtccatgcattgtcattgttcaactcccacatatgaatgagaacatgcagtgtttgcttttctgttcttgtgatagtttgctgagaatgatggtttccagcttcatccatgtccctgcagaggacatgaactcatccttttttatggctgcatagtattccatggtgcgtatgtgccacattttctttatccagtctgttttctttatcaattgatggtcatttaggttggttccaagtctttgctattgcgaatagtgccacgataaacatacctatacatgtatctttatggtagaacaatttataatcctttgggtatattcccagtaatgggattgttggatcaaatggtatttgtagttctaggtccttgaggaatcaccacaccgtcttccacaatggttgaactaatttacagttccaccaacagtgtaaaagtgttcctgtttctctgcatattctcaagcatctgttgtttcctgactttttatttctttcttttctttttttttttttttttgagatggagttgtttgctctttttgcccaggctggcatgcaatggcatgatcccagctcgctgcaacctccgcctcccaggttcaagcaattatcctgcctcagcctcctcagtagctggaattacagatgcatgccaccacgctaatttttgtatttttagtagagacagggtttctccatgttggtcaagctggtctcaaactcccaatcttgtgatccgcctgcttggcctcccaaagtgctgggattacaggcgtgagccaccgtgcccagccttcctgacttttaatgatcgctattctaactggcataatatggtatctcattgtggttttcatttgcatttctctaacgaccggtgatgataagcatttttttatatgttggttggctgcataaatgtcttcttttgagaagtgtctgttcatatcctttgcccactttttaatgggattgtttttttttttcttgtaaatttgtttaagttctttgtaggttctggatattagccctttgtcagatggatagattgcaaaaattttctcccattcttaggctgtctgttcactctgatgatagtttcttttgctgtgcagaagctctttagtttaattagatctcatttgtcaattttggcatttgttgccattgcttttggtgttttagacatgaaatctttgtccatgcctgtgctctgaatggtattgcctaggttttcttctaggatttttgtggttttaggtcttatgtttaagtctttaatccatcttgagttgatttttgtatcaggtgtaaggaaggggtccagtttcagttttctgcatatggctagctatttccaacaccatttattaaatagggaatcttttccccattgcttgtttttgtcaggtttggcaaagatcagatggttctagatgtgtggtgttatttctgaggcctatgttctgttccattggcctatatatccgttttgataccagtaccatgctgttttggttactgtagccttgtagtatagtttgaagtcaggtagcatgatgcctccagttttgttctttttacttagattgtcttggctatgtgggctcttttttggttccatatgaagttaaagtagttttttccaattctatgaagaacgtcaatggtagcttgatggagatagcattgaatttataaattactttgggcagtctggccattttcacaatcttaattcttcctatccatgagcatagaatgtttttccagttgtttgtgtcctctcttatttccttgagcagtggtttgtagttatccttgaagaggtccttcacatcccttgtaaattgtattcctagatattttattctctctatagcaattgcgaatgggagttcactcatgatttggctctctgtttgtctgttattggtgtataggaatgcttgttatttttgcgttgattttgtatcctgagactttgctgaagttacttatcagcttaaggagattaggggctgagacgatggggttttctaaatacacaatcatgtcttctgcaaagagataatttgacttcctctcttcctgtttctttctcttgcctgattgctctggccagaacttccaatactatgttaaataggagtgagtgagagaggacatccttgtcttgtgccagtttttaaagggagtgcttccaacttttgcccattcactatgatattggctgtgggtttgtcataaatagctcttattatttcggggtgtgttccaccgatacctagcttattcagtttttagcatggagggctgttgaattttgtcaaagaccttttctgcatctattgagataatcatgtggtttttgtcattggttctgtttatgtgatgggttacgtttattgatttgtgtatgttgaaccagccttgcatcccagggatgaaactgacttcattgtggtggataagctttttaatgtgttgctggattcagtttgccagtattttattgaggattttcgcatcgaagttcatcagggatattggcctgaaattttctttttttgttgttgttgtctctgccaggttttggtatcaggatgatgttggcctcataaaatgagttagggaggattctctctttttctgttgtttggaatagtttgagaaggcatggtaccagctcctctttgtacctctggtaaaattcagctgtgaatccatctggtcctggaccttttctcgttggtaggctattaattactgcctcaatttcagaacttgttatcagtctgttcagggatttgacttcttcctggtttagacttgggagggtgtatgtgtccaggaatttattcatttcttctagattttctagtttatttgcatagaggtgtttatagtattctctgatggtaatttgtatttctgtgggatcagtggtgatatcccctatatctttttttattacacatctatttgatcttctttcttttcttcgttattagtctggctcgtggtctagctattttgttgatcttttcagaaaaccagttcctggatttattgatttttttgaagggtttttcgtgtctgtatgtccttcagttctgctctgatcttagttatctcttgtcttctgctagcttttgaatttgtttgttgttgcttctctagttcttttcattttgattttagggtatcaactttcgatctttcctgctttctcttgtgggcctttagtgctataaattttccactacacattgctttaaatgtgtcccagagattctggtacgttgtgtcttcattctcattggtttcaaagaacatctttatttctgccttcatttcattatttacccagtagtcattcaggagcaggttgttcagtttccctgtagttgtgctgatttgattgagtttcttaatcctgagttctagtatgattgcactgtggtctgagagactgtttgttatgatttcctttcttttgaatttgctgaggagagttttacttcaaattttgtggtcaattttaaaataagtgtgatgaggtgaaaagaagaatgcatattctgttgatttggggtggagagttccgtggatgtctcttaggtccactttttccagagctgagttcaagtcctgaatatccttgttaattttctgtctaattgatctgtctaatattgacagtggggtgttaaagtctcccacaattattatgtgggaatctaagtctctttgtaagtctctaagaacttgctttatgaatctgggtgctcctgtgttgggggcatatatatttagcatagttagctcttcttgttgcattgatccctttaccattatgtaatgcccttctttgtctcttttgatctttgttggtttaaagtctgttttatcagagactaggattgtaactcctgatttttttcgctttccatttgcttggtaaatattctccatccatttattttgagccgtgtgcatctttgcacatgagatgggtctcctgaatacagcacactgatgggtcttgactctatccaatttgccagtctgtgtcttttaattggagcatttagcccatttacatgtaaggttaatattgttatatgtgaatttgatcctgtcatgatgatagctggttattttgcccgttagttcatataatttcttcatagtgttgatggtctttacaatttggtatgtttttgcagtggctggtaccggttgttccttttcatgtttagtgcttccttcaggagctcttgtaaggcaggcctggtggtgacaaaatctctcagcatttgcttgtctgtaatggattttatttctccttcactatgaagcttagtttggcgggatgtgaaattccgggttgaaaattcttttctttaagaatgttgaatattgggccccactctcttctgacttgtagggtttctgcagagatatttactgttagtctgaggggcttcccttgtgagtaatctgacctttctctctggctgcccttaacattttttccttcatttcaaccttggtgagtctgacgattatgtcttggggttgctgttctcaagcagtatctttgtggtgttctctgtatttcctgaaattgaatgttagcctgtcttgctagattggggaagttctcctggataatatcctcaagagtgttttccaacttggttccattctcctcgtcactttcaggtacaccaatcagacatagatttggtcttttcacatagtcccatatttcttggaggctttgttagttcctttttattctttttttctctaatcttgtcttctcactttatttcattaagttgatcttcagtctctgacatccttttttctgcttgattgattcggctattgatacttgtgtatgcttcacaaagttctcgtgctgtgcttttcagctctatgaggtcatttatgttcttctctaaactgattattctagttagcaatttgtctaaccttttctcaaggttcttagcttccttgcattgggttagaacatgctcctttagcttggaggagtttgttattaccgaccttgtgaagcctacttctgtcacttcgtcaactcattctccaatcaattttgttcccttgctggcgaggaattatgatcctttggaggagaagagacattctggttttggaattttcaggctttttgcgctggtttctccccatctttatggatttatctacctttggtctttgatgttggtgaccttcagatggggtctttgagtggatgtgctattcctttctgtttgttagttttccttctaacagtctggcccctctgctgcaggtctgctgtagttttctggaggtccgctccagaccttgtttgcctgggtatcaccagcggagacagcagaccagcaaagattgctgcctgttccttcctctggaagcttcataccagaggggcaaccacgagatgccgctcagagctctcctgtatgaggtgtctgtcggcccctactgggaggtgtctcctagtcaggatacacgggggtcagggacccacttgaggaggcactctgtcccttatcagagcttcaacactgtgctggtagatctgctgttctcttcagagctgccaggtagggacatttaagtctgctgaagctgcgcccacagctgccctttcccccaggtgcttcgtcccagggaggtggggattttatctacaagtctctgactggggctgctgcctttttttcagagatgccctgctcaggaaggagaaatctggcagtctgaccacagtggccttgctgagctgcagtggactccacccagttcgaacttcttggtggctttgtttatactatgaggggaaaaccgcctactcaagcctcagcaatggcaggcaccccaccgcccccccccgccccccaccaagctggggcatctcaggtcaatctcagactactgctgtgctggctgcaagaatttcaagccaatggatctaagtttgctgggctccatgagggtgggacccactgaggcagaccacttggttccctggtttcagcacccctttccagaggagtgaatgattctgtctcacttgcgttccaggagccactggggtatggaaaaaaaaaaaaaaaaaaaactcctggagctagttcggtgtctgcccaaacagccatcttgttttgtgcttgaaacccggggccctggtggggttaggcgccagaggggatcccctggtctgtgggttgtgaagaccatgggaaaagcgcagtatctgagctggagtgcagggttcctcaggctcagtccctcacggcttcccttgggtagggaaagaaattccccgaccccttgcacttcccgggtgagatgacaccccaccctgcttcggctcgccctccatgggctgcacccactgtccaaccagtcccaatttgatgaaccatatacctcagttggaaatgcagaaatcacccaccttctgtgttgatctcgctgggagctgcagaccggagctgttcctattcagccatcttgccagcaatcccagctttgcacattttaagttcaatactcctttaaaattaagtggagatgttcactgggaggttgaatatgctactgtggactagaaataataatttccatagtctgaaagtcatcaacatttctggagctgaagccataggtttggaagaggctcctcagagtttttgtagagtgagaagaaggaatatcaaggatgaaggtaaaaccgttggcaacagcaatatttcagggcgagttaatattccagtatagatacatgcatctactccttttctgagtctccctccatttatggttctgttctagtcaagccccaggacaaaccgttgctctgtcacagctgtgcgcatccctggtctttggtccccaccattacaactgtttttccccacttgtcatgtgccgtttatctctttttctacccatcgtgtgattcctatctttatttttcattcattatttattttcattccattcctctctacccctcttttctttacccttctttacctatttctctctttatttcctttttcctccatatttcccatatttccttttttctttctctttttcttatgcctcacctctttttttttttttttttttttttgagatagggtctcgttctgttaccaggctgaagtgcaatggcacgatctgagctcactgcaacctccgcctcctgggttcaagcagttcttctgcctcagcctcccaagtagctgggaatataggctcacaccaccaagcccagctaatttttgtatttttagtagagacagggtttcaccatgttagccaggatggtcttgatctcctgacctcgtgatccccctgcctcagcctcccaaagtgctaggattacaggcatgagccactgcgcctggcctttcctggatgttcttcgtccattccccacctcaatgtgtatgtagatagcttatttttggcaccagtagtttgtactttttaaaaacatatgacccagtgtaagtcctaaggaacaataggcccttccatgcctggacatccaaactaaacattttgaagaggtttatttttaattccgggaatatggtggatatattttgtcatctggcaagttctctgtgaggaatagcctgcaactactaatccagttgcccttgtgaccctagctaaatgtcaactaatcctccaagggtctatttctgcaatattaattcatgattctacctgggtctctctggtagtcgttgaggttatgttataaattatgcattgaagagatgcctttggtaacacgtggccttaatgcaactttagactaaatgccaacaagtcatgtcagatttacatgattatttactagataataatcttaaaagggttgtcttcacagcatgtgccactttgggatttgctttttctgaaaaatagagtatattctctgtcagatgaattagccagtataccatgctcagaaatacaaaacttgctattatctttagacttgagcagtcttgtacaaactatcatattccatagaaattcttaaaacgtctaattgtccaggactttttaccaaatttcaagtctaaatttgaaaggtagtgtttttaagcagaaaagttaaagcataacattaatcatagaaaaattgttggggtgttattgataggtaatcaccacattgtttggttagaagaacactgaacttagatgtggaattcctagatctgtattttaactgactttgtgattctgaacttctctggccctagtttcctcttttgtaagttgagaaaactcaactagatgatctctgaagaccttctcaattccaaaatgtcaggtttcctggtaggtagtagccactggtgacactactacgcatttgctattctagaagtaccgcatgtgttttgttactgtgtttccctacttaaacctctgcagcagctcttccccaggctctctcagttcagttcaagcccagaggtgatggctgatgagtggtttatcttccagctacatgttttcgaccttcacacaggaggccctcaattaaaagggaagccgtagggaaatggaaaaaggaatgagagagagggaaggaaaggaactgcctcgggtgtggatttcaatatattattagttgttactgtcagttagaagcaaatgctgtgaaactttgcactcattcctgtgtggactggttagcctatgtttcctctaccgcagcattctgagtcgtccacctcaaatatgtgctgttggtcataaagacagactgggcccaagagacagtgtgggtgaaacaaattcattcattccttctagaaataaaatgggaagtctgtcctacagaggatgagccagccgccatcgtctgtacttgtcacatgccaggccagctcgcctgctagcttgggagcaggaggacagcaaattcaaacactggaaaattgcttgacattttattgggaggcattgtcaattattagctaagattgttttgtcttctgaagaattggccctctataaaaaaatagttgtggaaggtgggcttttaacagaaaatgtaaagtctgttcagttcatactaattagtacatggaattatttaacatataggcaataatggctaaaaactgacatgaccatcagctttattttaggatgttttacaaacctatcacaaagcaacaactaattttttgttcatgtatattaattcatttggcctttacctggactaatatcatctgaaaccttcttttctttgaaacattttatgaaatgtatacacttatttttactttattatgtaagcaaagcaattttttattttccgtcccacaaattatgtgttcctttaaagatttgacattttgatgcagcaaatgttaagaaaaggtgtgagataaatgtctacaaaataaatgttttatacagaaccacggggcaatgtactctcaaaattaatataaaataacttgaataggacatattttttttaccaggtttcatccatgtataattagatatatttgtataaatgaaaatacctgtatttttaacatttttcataaggaataatgtatctcaataacatgtttgacagaacttagtatgtaagcactatcaattttaccatgattaattatatttacgattgtttctaaaatagctatagatctttcaggaatttgagaacatttgtattaattatagtaatattcctgtctcagccactgtggtacatagaaatcacagaagttgcagctattgaaaataattaaagagttaggcattctggggcaaaatagcaagtggtagctattatattacataaatacctgttataggtaaatataactattttaattctgaaacactatacctccatctcctttccataacacatttaaacagatgtacattttgcaaatgcagcatattatcaaatatttggcacccattctattatatttaaacaatgctagcactaccaagaaaaatcacaataaaaatgggaagtttttctgaagacaacatgaaacaaaaaagataagagggaaaatttgatgaaagccccattttcaaagagatgcctgcagcatgcagccggaggcaagttgacattaactatagttcccccggcctatccatttacatgtgaggtagtttctttccactgtaagtaagtgtgacttctgtgtggaaaatagcttaggtctggatgcattattcaaagttttatttcaaaatcacctttcctgagactacactgagaaagtcacacatagatgtttctttgtgacaattatttaaaatatgtggctttaatatgcagtcctataagtatgaaccagatgctgagatcttgcctagcacatactttggcatgcttggaacaggccatatgtgcacacaaacatgtatggatgttttatctcagtctatcaattagctgccgtccttcaggtttccagataattgaatagggttgaggtacaagggtaagttgaacaaattgacttttgtaaaggcctcttctgagctggactttatatgattactgtaacagttcctaaagtaacccctatttcttgactcaacctaatgggaactctttttaaagaagattttattttaaaaaaagagtgtggggaacatagctaccaatttttcatcttataggaggaaagtgtcagagaatgataagagtcatggctttagaatctgacgaacctgattttacaccacaactctttactttgtggcactgtaaatttaaatgagttacttaacacctctgaactattttgcacatgtgagatgtgacgatgatgataatgtgtactgcataggggatgcggtaaaaattagatggtatatgtacatagttggtctttgatagataatagcttaagaacccagcagttggagaacttgtcccagggcacgtaggtagtccgtgggagggcctagtctaagtcagtgcatctgacttttaactgccctgctaccctggctcaggcaagtaaaactcaaacatgcaccttgctctgtaaagctcaggtactctttataattagctgacaacaccgtgcagtcatcagcttgttgcagtttaccattgctttaagtctataaatatttgaaattctgccagcatgtcttattcttttctttgagccatcattgcagaatagctaaataaatgcttttttcgtatcctcctttgcagaagcatttttagaattcttttgaatagctgtattttgtgtcatttgttgattcctgagtttacttctgataactctcaatggtgaggatgctgtatcctcttgtctggtttactgaacaagagaatcttgttaagttttagaggaagccataaagcaggggagcattagctgcacctttcctcctcagagacaaatgctggggtcttccgtggtgaaagtggagaccctggggacagctgccttatgcccacaccttggttccgtggcttactggctgtgtgaccttagacaagccacctagctcggtgtccctcagtttccccagctattccaagggcataataatagttcttacatcataaaatgttatgacaagaaaacaagttgatacctttaaagtgctggccccagtaaatattaactctattgataatatgcattatacaccagtatacaagctgtagctgcctctctggtttcaatgctcatggcttgcgtgcctcgaagtctttgtgtccggacatgggagaagaccaaggaacggagctgtctccccttgagagggggtcctctctccttttcccatggagagcatcatttctttgtacccaaagaaacacacgggatgggtctttaattatgaagctagctaggaacacagctagctggaatgagacagctcattttctccttaccttaaggccatgccttggtgaaggtgccagagctgatagcacaaagtaaaatcattcttcagccatgctcagccactagtattccttatgcccaggctcctactcagtcaagtggagagccggattataggaaaaattgttctctgcagataagtaaaccaaaggtcctggggcatcaatactaccatgcttggggaacgtcctctaaaccccaaatgcttctgagtgggcatggcattggcattaaatgcaaatactttgggtattaaaaccttccagacccagacgcagcaaggtgccaagtggtctgccacctggggtgggaacagaaggacagcatcactgtcttcggtgtgcataaaggccttgtcatgtatctgtgtggactccctgagcctctcctcagtgctgcttgttcaccttccacagttgcaggaggtcgaaggccctgtggccaggcaccagccctgaacttgcaccacattcagcagggctgaattctcaccagccatctcagggcacaattttcctactgattcctcatttgaatgcctggtaactccactcatttttaacctctatctattagcatagcttattaaaactggttctatctgtgtctcttaattcctaaactcaagccctagacttcttaaaagggtattgagagagggctgcataattactactaaaattgatcattcttcacagttgatgtctcaagatggagtgtgttgacattcccagtcccacccaagtgcttcatgatctttactgggtgtgtgttttgattcatgttgatgtgacttcactttctagttcataagagcgttaaaaactgagcatatttttcttgggatgatcgtttaaacttgtatcttggttatcgaatccaggaattcaaacctaataataccacttttccaactctttccagttttgttttatattaataagtaaaacaatgaagagtatgaggaaagaaatatatgcattaagaaaaaaatagtccaatttctaacctgacttatttgggcaatgtattagtccatttttgtgttactataaacgaatacctgagagtgggtaatttataaagaaaagaggtttaactggcttatggttctgcaggctttacaagcatggtgccagcatctgttcagcttctggtgaggcctcaggaagcttccaatcatggaggaaggcaaagcacaagcaggcgtgtcccatggcaagagcaggagcacgagagcgagcgggagggtgtctcagactttgaaacaaccaaatttcatgtgaactgagtaggaactcactcaccaccaaagggatggtgttaaaccattcaaaagggatccatccctaccattcagacacctcccacccagcccacctccactgttggaaatcacattgcaacatgagatgtgggggacaaagatcctgcaaaccatgtcaagcaagattcatgacacctcttcttctaacataaatctaaatttctttttaacagggaaatggtttacctctggaatctttaatttagattcatttatagaaaattacataaaattaatttttaagaaggatacagaggcgccactgtgttgattgagaaaggaatattttggatggatctcagcattataagatgtagtattatattaagtactatattttcttgaatagtaatataaattttgcctggtatccttacagagtgtgctttttaaagtaaataaagcttcactggatcccctggaagatgttcttatcattgttatattcatatgtgccgtttgcttatggcactgctgtggtggaactaaagtgaaactgtttttatgagttttactgcaagtaaaaatggattcatttattaaatcccaacatactatttctttgtaaaaacaaaacaaaatttgacaaaactatagtccatgttatcgtgtctaaagatggcccagtgttcattccggtgtttattatgtttctgtgatgacttaggcagcacctgcctgagtaccagaattccaatttggacacctgggatttagtgctttgcttactgtgtccctcccgacagtgccgacagtacgctctcctgcattcacagtcctgaatgatctgggtaccatatgtcttttctattagatcctttttaatcatcttcaacatcctattcttacatctagtctagtgttttccatagaagacatggagtataccgtcagtaaagaaaaatactcttctttcatgcaagccctttagtgcagcactggactttgaacagctttgctttttaaaaaaaaaatttcagggatgtaagtttcataatattataagatgttttaatttttctgtagtgtagatattataatggacagactccctacgtgtagtagtatgaatttgttaaagtttgaataataattatttgaattaaaaatttaatatattaaaatagttgaaatgaataggagtacctttaaattcagatacagcttaattcaaaagaaaaatgggctcatcactatcatttatttaaacgatcatttatttttaagccacctttgaaatattttttataaatcgtgtattccattgcatttttataaccaacatcaattgagattaacaagtcctttgttcaaaaaaacgaataaacctccttaagatgaaatttttttaagggaagtcagggagaactttattctttttatgtattttctatttatttatttattggagatagggacttgctctgttaaccaggctggagcacagtgacacaagctcgctgcagcctcaaactcctgggctcaagtgatcccccgtctcaacctcccaagtagctaggactgcagacatgcgccaccacgcccagaaaattttggggttttgttgttgttgttgttgtagagacagggtgttgccatgctgcccaggctgatcttgaactcagggcctcaagtgatcctcctgcgtaagcctcccaaagttctgggattacaggcactgaaccactatgcctagccaggatgaattcttcttatactgtgggcatcttaagttaaaatatctagtttttcaagtcttctattcagtggttttataacagaaatatctagacttccgtcttcagtggctaggctgcagcctagtaatttattcaggacttagcatttccaggcagctcttctcgctgttagctgtctcactgcatcattgtatggtattattcctccaagggtgtttgataagcatctgtgataaacattgattcattgttcccattgccagaaagaaagcattaattaataagaacaaattcaggaaaaggccgcttagtgtaagtgcctagttattgggagctatcaaaatgttctttgttctttatccttttacctgatttctataaaagcctgagttgtgggtttggagtcagtggtcagaatttgaagaaattggccactctctaaagatatgttcagctatcaatgactaattcttaggtttaacttttattaaaaaggaaaggaagaaaatctcagaaatatattaagatcttcaaaatgaagaggtgacatagcattcactgaaaatattaacttggaagctgtcatgcaggagtggtgttggctccttgggggacacttggggatgcctgagggtgtctttgctgagaattaccttattgtaattgcatctgttggttgcagttttgtagtcacaattgtcaagatttttctttaataatttgtcaggctaaggttgactctgagttcagatcctaaaggtcatagaagggttaaaatcataactgcctaggggggccagtagagttgacctgtgtatggatgagctcctggtgcagagagtgtggtgagaaggcacccactgtccagcttcaggcaagtatattacagtgtcacaaatcttcccatctcccctgagggaagggagaaatcttgatttctttactaagtgttctaactttttggttggcaatgaatcactttttaaagtatgtgttggccaaataaaatagatatccagtcacccgcatgtgattcttaattgtatttttaagataaaccaagcaggagacatttaaaaatcttctgtcacttacatgtctctggctacacatgttgtcttataccaaccaggaaaggacaacggatcatttcctggtcgtgctacccctttacccacgtgctcattcataccctgtgatgcatgccaatggcaccactggcctgcatcctacttcgtgatagctggttcttgctcagaaatccaagagaacttaggcatcagttatcttgtaggtgatatggccagatggtttggaataagtgtgcctcccatttctaattagagctcatccctgtgttctgcactgggattgctgttgactcctgttatttcttgctaatccaagctggaattcctctggactcttgttgagcctcagatagcaatatctgttagaatactttttctcataagactacagttaaattttgtggggtttttttcttttttttttttttcctacggagtttcactcttgttgcccaagctggagtgcaatggcgccatctcggctcactacaacctctgcctcctgggttcaagcaattctcctgcctcagcctcctgagtatctaggattacaggcacatgccaccacgcccagctaattttttacatttttagtacaaacagggtttcaccatgttagccaggctggccttgaactcctgacctcaggtgatccgcccaccttggcttcccaaagtgctgggattatgggcatgagctaccgcgcctggcctaaattaaattttgtaaattctgtttacatgaatggtctttctggactttgaaaacaactccgccagtgtaggaaagaggaatgggtggccctggctgtgcccacttctgcagatggttcccaggagggaagccagcccaccccagcatggctcctcaccctgagcactgagtgctggggaccacccgctacctcctcaacacaggtgaccaaggccggagacccagagatcatctaagaacaaggctgttgctaacacgtggctgatgatttctttatgtacccttttatgccgggtttgaggagtaagatttatctgagaataagtacatagcatatttccctatgtatccattcctctctccaccccatacacacatctttacgtgtgtttcaggaggtggggagggaataaaaatttaaacagtctccagggccctgaagtttctaaactgctaagtgtccaatccacagcctggcgagctgatgtggtcttggcatcaggctgcagttgtaaaaatgctctgctgcttctccaaacaaacactggagccctcagggcacatctaacagagccagccgtcagccacacacctgccctcagccagctctagcgccttcctgcaaccagtgtccacacgccccacgacagctagctcccaaggactgagccaatccactttcactccttggcaggcaattgctcaagtgcctgagctgaacaggcttagcttcaggatcagtttaattttctgctgtcctaattgctgtgctggtgcctggacttaaacaacctattcatttgaatctccaaacaacttcctattcatttgaatctccaaacaacttctaactcatgttccaaaacttcctaacttctaaagttgtgattttttttttaacctggaactttcaggatgctagcctgattttctaaattttgcctgactctagattaagtctagcttgtcgaatgttcttcaagaaacacactcaccattcctcagcttgccagtggtgaggtccagtctctttcaccgtataattagcgggaagtgtcccctgccctccttagccaatacccaggctgttagccatgtctctcaagggaagtctgccaagcacagaggacaatattttaccaaaggaacacagcataaataaatgttcttatcctgtgtacctttttcacttttatgatcaacactgatataaagaacaacaatagcattaaaattaactgaagttatgagtacctaagtagaatgataattcattatgtgaagagggtggttgattaatgagcaccattaacaagttcatagtttcagtggtcaaaattacagatctgattatgtgcagtgtaacatgctccattgattttcaagtactttttcctaacaccaacaattatttaaataccatgtgttctatgacttacacaattttgagttctcaaaaacatctttaattactatcctgaccactgtgttagctttagcactttttagttaaatcgaggacactagcaatcatttctctttcagatgttatactgctaattttagtgataatacgtgaagaacttgcaaccattaaaccagagctgtgtgcaagtaacaatctagttaagccagggtaaatgaaatagccattatgaaagatccataagttaagagagcaactaagaagaatagaagaaaagaaatcgagttttagattctaaaatgttgtttagtatcataagttgacctcactggatgagactgtgttagccaagaagtctcttgcttagttaattttgtgatttggcaaatacagtctgtaaaacatttttctttaacagcatgcagtccctttttaagtgtgcattcagtgaaaaaggttctatgctgggacccaaaaatgcagccctaccgccattatttacaaaaatatatttctaggtatatgtccaaaagaaatgaaaacagggactcaaacaaatatttgtatacctctgttcatgcagtattattcatgatagctgaaagttagaagcaaccaagtgtcctttgacagaagagtggataaacaaaaatgtggtctatccatacaatggagtactattcagtcttaaaaaggaaggaaatcctgacacatgctacaacatggatcagccttgaggacatcatgctacatgaaataagccagtcacaggaagacaaatactgtatcattccacttatataagtacctagagtagtcaaattcatagagacagaaagtagtatggtagctgccaggggcttggggaagaaggcaatgaggaattgatgtttaatggctagagagtttcagtttgagatgaaaaattagcgagacagacagtggtgatagttgcacaactatgtgcatgactcaatgccactgaattatacacttaaaaatagttaaaatggtaaattttaagttatatattttattacaataaatatcttctaaggccaggcgcagtggcacatgcctgtaatcccagcactttgggaggccaaggtgggcggatcactaggtcaaaagaccgaaaccatcctggccatcctggttgagtggaaaccccgtctccactaaaaatacaaaaattagctgagtacggtggcacacacctgtaatcccagctactcgggaggctgaggcaggagaattgcttgaacccaggaggcagaggttgcagtaagcggagatcacgccactgcactcctgcgtggtgacagagcaagactccatctcaaaaaaaaaaaaaaaagaaagaaagaaagaaatgttctaatactggtagagtgatttagacaggttttgaattcttggcaccgctcatcattctaatcaatggtcagcctctgagcattggagcactcagtggtacttgtacacttggcttgtcatcaagtgtttcccttttagactgttaggccaaggatggctaagaaagttactgtccagccgatagcaagagaatatttatgttgttggtacatgtctaccagagaccacagaaatgcacaaagctacatttgaagcatgtcaccggcagtattccagcattattactgacagtggtgacagtgagaaaaccaaactgccttgaaaaaacacctcctgaattgttaccacaataccccagagttaggcagcgtgtaccgccaaaacactggtgatgcccagattcttgcagtctcaagtgaagaaagcaatatgttctgctgcattatttttaggcaccagagagtgaaatatgggtagtgtcaggccagtcgcttccatggctatcaatttttgatcttctttactagtaacagtgagggtggcacaaattatccatggacagaataggaatgtgcccagcattctggaagcttatagtgcttcaaatcaaatccacacagctccccacgtgcagaattgtgcagttccccccttatgggcttgatttttttaaaatgtaagaaaagatattcagcatttgctacctaacacttagggctcgggtccctctcagttgaatgaagctctaattatgcatcttgacttattctgtagtttctaagtagcctttccattcagggtattcttgtggctgtctgtgaactagaaactcacagagggcaggagccatggcttgatcatgtttgtctctcccattcctaaagcagactaagcacatgataaatgtttattgatccactgcagaaatgagtgaataaacgcagatcctatctatgggagtgccttggtgccttgcctactgtgtggtttctcctcccagctctgagaagtggcttggcggactccaacctatgcgctttacgtcattactgaggcaaggaacaagtcatactcttgcttcccacttctccctgcaacccgctttccctgggctgcagcctcttttctgtaattgaagtcaccttgaagaagaccatgcccagagcatagaattttgcctctctccccatgtgaggaccatatatgtttatatttattatgtgtgacatctgtaaggaacctattacagagcccttccttccttcaaacaagtttattaaccagcagagataataatgaccaaatgaaaaataaaagccagatttaccttgcataatctaaattaataataacacatccatgaacaaatgtcttgccacttgtattatttattacttatttggtgatgatgatgacagctaatatatattaagtgttaagcatctgcctcttactaagccctgctgtaagctttttacgagtattatcactgtttcgctttgtaatgactctgtagcacatattctgttgtcctgttttacactcaaggaaaccaagactgagcaaactaagttgcttaaagttgcatggtcagtaagcaactgaaccaaggggtaaagccaggctgctggtctccagagcttccactctgagccattatgatactttggttgaaataaaatagacctaggcaaagatagacacaagatctacctgttgagctggaaagaaagcagctgaaaattctgtgacttgaattattatgatactcatatctctcccttcacccagttaataaaagaagcaccctgcaaagccaagtgtgcaggctctaagctactcttggacacaggctctgctcacttaaggtcaggaagcagagaggagacctgggtgcctctggctcctttggaagctcctttagcatatgaagcatctaagtaggcttgaaatatgccacaaatgaatggtcatcttcacgcaccaatagttttcaagcctccatggtatgtgtgcatgttgtaaaatccacattggtgcagcagcctgtcttacccacatgcggtgactctttccctcctcctatctggtaccacatggcattaggccagagactcccacaaacaaagcctgttgttgctttgtgtacacttcattgtcacaggggaccaggctccacacttctcagcatcactcttagtggtttggctcaccttggtgactcaggagtcacagttaacatcatttccaacccacagcaaagactgggacttgaaatttcttctgtgttcttattacttcttccattgtcacttgttagattctgagagaagcaaataaggctgcccgtctgtggatggagcaggctccagcgcccttttcattgtagttgtacctctgaggactaatgaggagtcacttgcttgtgttcttggaagcatctgtggtccaaaggcaggaattctcaactctggactgaaaagatgccatgcagcaggaggaattgcactttagcaagtgaaatattgtgggcttgtgaacccttccttcagaaacagacacggttagtatgtggctctgatatgggagcagttggtgaagatgaatgtgatacagcagttcctgttctttgcccctgatgatgcagtgtggcacctgatgctgagataagtattatcttccagcgatgtcgcgaagtggcatgttaagcctttatggtgatttgttgcaccttgccattttggctggcattagagctctaaactcattttcttcccagctttctgcccttgcttgtgtattcccagtggtatttctcattagcattatcttctgttaagcaggaaatggtctctgcttctcaaccctggacaatgctgagtatgtttctagcgctcagttaaaaatatttactggcattagtatgccttttttcatgtatttcaatattattttactttacgacagtattagtattagtctgaaaagtagttcctgaaagttgttaagtatttttacataaatttgacaaggacgtattttcatttttaatcacagctaatcttagttttataccaaaccatttggttttcacattaaaccttgcagctccagaccactttatagccaaaccaagtaataggaaactggcagggccttataacatcgtttgtaattgttacaaaatatgctttgaaatatcatcataaatatgtaaaattaaagttagcaaaaataagtgtatagactacatttggagcctgtgatacccctgattttaatttttttctctctctcactagcaaatttgctaaatttgttaatttgtagactgtttcttcttaatttgtgagaaaaataagttagttccatattcacttttcttaaaataactgttttctaaagttctgtttataagtggaatcaacactaaattatttgtgttactagaggagaaaagagatccaactaaaacaatagataatcacaaattgtttagatactaaaaaagtgctgaattttgtggaacaaagctgatttatggaccatctactcctttcttactataaattgtatggagcaggatttaaccatctcaaacctacatagtgacaagtatctttgcaatggaatgcccctcactgggccttatcatggtgtgttcacacctttacttatagcacagactccatgccatggtagatagtttatgaagacgagtttttgctcacccataatccagattcactataatattatgcatgtaagttctgcctagactcaatggaagaagttaaattaaatatattgccttcctgtttgactttggaattaaatttctctataaatatcttatcacgctcctaggagatagtttccttagataaagaaatcttgtgagtgaaaggaaggaaaatgaaggtggaaaaggataaatgtcatcgatatagcacaatgagaaacaccacacctagcaagaagagacccgagtcctattttctccaaccattgtatattcattttctttctcttccgctcgaaaagtgaatttaaaaggtcctatagcagtatatcacagacacatgttaacaaatggctgcccaaaaagttacatcttcaaaaataccatgttgatttgggcaaaaaaaaaaaaaatgcttatcaaattagtaagacaaaaccttttgctttttgtggcagcagttgtgggggtgaaggaaaataaaaataataagtctaaaagtaataggtctacttcccctgttgccgagtacactctctgaacacttcataaagtgtacctccatgtagccttttcagatagcagtgatttagacatagaaacaacattatcagtaacaaggaagaaaaaaaccttaattgtctaattgatggctattatgagattccgtataattcatggaattggtaagaatttcacccaaggcaagaatttagcatggtgtatgcgtgtacttttatttagtcttcaggaatcacatggattgattgctgatgagactattttttaactaccaagcatatatattcatatatgctcaatggatacaaattttccaagatgttatttttttcttaatgttgggtccattttttcttctgtaagtactcatttctgaaacaacagtgtaagtaatttggaaacatgatttagtatgcaagtattcactttacactcctgtcttttggaatgcatttgatgcacatatttgttcaaactaaataaggcaaagaatttaaagagctagaaagagtcttggagttcatctcttgctaacctctcattttatagatgaaaaaacagaaacccagataggttcgatgcttctgttgggtgaggggaaaacccacagctgtgaatcctaatttacagtttctgcacacatttctttaatgtgacttttttgatgactgcttaacagagtgatgtcagctatgctaaagtcctgacatgtcagtgacaatacaaggaccacacgatgaatttgaggatatctgtatttttctggtacagctaggtgggctcttttaagacagaagtcttaatctgtgagagcctcccgaaatctagagaaagttctcagccaagaaaaggtcccggtgtgattgatggctgtgctggccgcacagttatagtcagttacagtccttgctccttcaaactatcaagcagtaaatttgtaaatgagctgagcgtttgttgttattaaagcttcattttaccattctctctgtgcaacaagcacttaacattgtacttgctcaagggttaaaaaaaaaaaaaaaagcatccctaaattatatataggtagtcttgggcctataggtaatctctttggggcttttaaaagaaatatacaaagattttcctacctttctgtgtattcttacaaataaatgttaagactcatggcctggggaaggaggagaaactcattaagggagcaaattgcagggagattcctgaagaatcagtctctgagccagtccaggcactttaattttgtctggccctggcattattattgtaactgagtagaaggccatgagatcatagcctctccatagctcccgatagccatcaaaggtgactggcttctattacttttgaagtgacaaccacatttgaagatggtatagactgaccactgattgtcaaaactagtccaaaataaaaccattcatccatacttacttctgccacataacttgcagatgccctgcagcaaaaataaattagctctaaattttctgttgagcacagtcttccgatggggcctctgtgtgaatgttcttcagtcattttgctgagggctaagagatgagggtaagacccttgggctataggagtagctaaaaactgaaatattcccaaggaaagattctacattagattcatggataattaaggcaaaacacaaatctcattcattctggacctaaataaccttttcctgctagagaactttttttaaaaagttgcagtgtttactgtctgaggaaggcttataaaggttatgcttcttgcatccagaatgtgcagaaattctacagctataaatgtctcagcagcaaatgggctgtgtggcatgctacagccacagcctgctaggtaatttacgttgctcagggactgtagtttttcaatagattgaactgttagttttcaggaggatttaatgaaatattgaaccagatgccactggtctgccatagatgtgggactatgagaaatgaggaaatgtcactctgtaaacagcttggacctctgtgagtaggggaaaaaattgtgtccttagtgaaagagaatcacaaccaagagaaaacatggcagtttgggggtaaatgtgtttgtttctatgtccatgtcctgtgttcatttaaaatgggaggctgggtctaggacggagatccagaaaaattgtctgaatctggagaaagctaaatagaggctgagatttttccgagtctttcttgttgtccagtggtaatcctctgaatggccctatacagatgctcctggacttttgataggattatggtccagtcaacccatcataagtaagaaatgcagttattgcacctaccctacccaacttcataggttagcctagcctcccttaaatgtgctcagaacacttaggttagcctaagtgttggggaaaatcatctaacacaaaacctattttataataaagtgtggaatatctcatttaacttattgaatactgtgccgaaagtgaaaaacagaatggttgtatggatactcgaagtacagtttctactgaatgcggatagctttagcaccattgtaaagtcggaaaatcataagtcagggaccgtctacaattgcttttgctgtattctcgttttcagcaatataaagacatacccgatactgagcagtttacaaaagaaagaggtttaatggactcacagttctacgtggctggggaggcctcacaattatggcggaaggtgagaaaggtggcaaagatacagataaagcactgttcctgaataacatttcaagtcttgaccttttttttttttttttttataactttacagacttacctattccctgcaactcattcagggtatggatgatcttgttttatggtcttgctgcaattcatagcctgttagtagctgtgtcttcaatgtactgggaaatttatctttgtacaggaaggcactgtttcaagacccagagctgtgttcctcaatagtccaaggaacctgtctcagaatcatccgggtacttacaacagtgcatacttctttgtcataccccaggcatattgaatcagaatgcaggatggaggaatctatacaagttcccccagtgatagggatcctcactgatgtttaacaaccactgctccagaggggtgggccagctgccgacatttcttgtgtcctaattgtgaggaaggttcttaaccatagaatgttaatgtaaacacaagaaaaaaaaaaagaaaaaaaaaacttctgcttaacctcagcccatttgaagcagaaagaaaattgcagggaaacccaaatctgtggtcctgattctgctgttgctttaagatcatctcaccagcaaacaccatggtttggtctcgaaagggtcccagatgaactaactcacctggcactgtaattaattgtaccagagtatgatgatgcatgaaacaatgttcactgtgtgtatgtatgtatatctacttacatatacacacaaacacatatgtttttcttgtgcttatttaagttttcatctttcttaataaggaactgtactcagttcagggattaggagtggtagagagacatattgattcattcaaagaatacttgagatgactacttactcaaagccctaagctaggtgccgagtattatagtctaagtggaaccattaaccatgtacctagacaattttagattgaaaatgataaaacaccataggatgtgtgggtaaaggcttcacaagctcagagggaaaactggctttcagttggaagaatttggcaagaaggtggtggcaattatgttgaaattttcagatataatggtaatgatatatatgctgttggaacaagtattagcatatgaatgattattattttcacaatatttcttaacacctggtaaaaccagcagagcatctattttgctgtgttagaatcgggccagggtcagacaaataatatgagtcaatttataaaacaaataaaagattaaatatgactttggaagtaaactcgtaactgcccagtgggttcttgctgcctgctgcacagataaaaccaattcactgagactgtggcattgcaataaagaaagagcacaattgacacgaggtcggctatgccatgtaggagacagagttattattcaaatcaatctctccaaacatttagaggctggggtgtttcaagaatagcttggcaggccagagagtctgcttctgggtagggccacaggatctgttggtgggtctgtgtggggcatgggttgccagcaatgcaaaaacttcaaaagacatctcaaaaggccaatcttaggatggatgtggtggctcacccctgtaatcccagcactctgggaggccgaggtgggtggatcacttgaggtcaggagttcaagaccagcctggccaacatggcaaaaccccatctctattaaaaatacagaagttagcctgtgtggtggtgtcgcccataatcccagctactctggaagctgaggcaggagaatctcttgacctgggaagcagaggttgcagtgagctgagatcacgccactgcactccagtctgagcaacagagcgagactctgtctcaaaaaaaaaaaaaaggccaatcttagattttacaatagtggtgttatccacaggagtaaagggaagttgcaaatcttgtcacctccagaataatggctggtaaccattttcctttacactttagcagaattctggctcttcatccccctaacctggtggtctttcattagctttacaaaggtggtttagttttggggaagggttattatcatttaaactataaaagaaatgtctcccaaagttagcttggcctaagtctaggaataattaaggacagtttacagcttaaaggcaatatgggggttggttagctaagatctctttcactgtcatagtttcctcactgttataatttttgcaaaggcagtttaaaaccaaaagatcagagcaaagacatatgggtttgaggttttacaatgtaagaattgtaatatattatagttgatttgatgaaagaattatcaaccaagcagtataagcacaatactgaccaagtgtggaggattattgagctcagaaatagtcatgcagtaagaggcgagggaaatctatagggaaagtgcaatttgctgtatcttattaaaataaaaatatgccttgctacctgagtaagaatgcacatactttttttaaaaaaaatctttgtcatatgactgcctattactgtttgaatcataacctccattgctgctttcattcaaaagaagccattaaattcacagacttcctgcatgtgcccagtgtgtgaaagctttaattaaatctacaagtagagccttaaaagaacaagaatcaaattaattgcaacatggtccacgcatttgtctctctgacagtccctgtgctttggagaaaaggcaatctgtgcactcttatctgaattagtaaactcaatatcactttccattagcatggccagttgctgccatgtgtcttctggctgacactgtttacatgctaatgccctcacaaatagagtctgttccaactggtttgctataggattctggagcactaaatccaggaggtggaatatgctgtcttctgctttctgcatcactggcttttgtgagttctctagattgagcttcgtaattagactgcagactaattaaggaaaattcaccacatgcaaatagagcaaaaggatttgctgctaattatggttcttatgccatagtcaagacaaattaatttgtaatattattattcaactttttggtggcctgcaatagtgtaaaataaggaagtgatgtttgtgcttaaggaagacttctacaactggagtgaataaatattcaccccatgaggaaattagaggtaaaatctgtatatttgaggttttagacaaaaaagactccacaattcctatataagcttcagtgtataattactttgtttttatttttgttttatatccagaaggtactgtttcttaatatgtcaatgctataatataatcacactggcaatctagaaatacctacttcccaactttcagcatttaaatgggagtttaattcaacagtgtatgattttcttgtttttaaaggcttcacctatgaatcccttaggccaaatgtttaaagctaatgaactgtagctcgttatattctgcttatatgagggaaatagcctgaagcagggtggcctggcttagtgtgctgagtccagtaggcatcttgaaggtaatttcgttggttgcacatagtttagaattataacaaggatttctgccttgaaacattacgtattttagcgtgagaattgtctcaccggcagagaattaggttttcttgctgaaaatgtaaagcagatttatttatgaactgtctgccccatgctgctgttttctgacttgcttctcattccttagacgctgaagcctaaagaacaagcatgtgctcttcttatgactaaaaagtggttcagaaagcagcattttaagagttaaaggctttgcattgctaactgagagaagcagtattcacaaagtattaaaaattaaagatttagtccatctaatgtcaaattgggaaatttaaaaatttatgagcttatattgttaatagtttcctgagggaaaattcatccagtatttggagcgattaatgaattgcttgttgtatggcagtataatagagagagagagagagagagagtacagttagacataatatcgaagttatttttggaaacaagctaacaaagaaggctgtgtaatctctatctactgcaatctcaaaaaataggccgaatagccatctattgccagtgatttcagagggatgtgcctgaaggcagggagttggatctggtgacttcttaagtcctttccacatctctcattcccttaattattcatcaaatataaacacagacaatgtgattttctttattcacaatgtccctgtgtgaaaaaatatatgtatacatatgtaggattcagtactccttttatagaacattgctgtcaactattaagcttaacccaaaagaaagttctctgttaataagagaaccaaagtgcacatcatccccaacaggatggcaatttatgatgtattttgatcgtccacatgacttgcaggagagtctggaagaaaggtcatgggaagattaactgcaggcgcacccggttggtactgaagcaggattttgctctgattagcaaagcactgaaggccagtcagggaaaaagatcaaggtcagtgaccttccagaagggaagtcaacctcggcaataataaaggctgccactctgtcaggactccagtctcatgcagagttggtgactaacatccttcactctagcttgaaagccctgttgacagtttagttctaattatttgtggatcagattgagcagaaatacatctgcttcttttctatcttgtcttttgaccctccttttttctgcccttttaaaaaatgtgcactgatttctcaattatgtttttacttttttcatatttcttctgtcaaccccattttctcctgcctttctgaggggatgtgttttcttattacttgttcaaatactgatgccttttggaaaaagctaaatgacttaagtattttttaacctttataaaagtatgagaagcatattcttagaatcacagtgtacactttctcagccaaccattcaaccaataaagtaagtagtttctttagtaattctttgcagtttccacacctctttgtttattcattcaacacattttttgagaacctactgttaaaataaaaactttagacaaattaaatttagcagagtttaattgagcaaagaatgattcacaaatctggcagccctcagaaccagaagaggttcacagagttccccttcacaatgcgagacagaaggcaggtacagaaaggctgggctggttacagcagtgtttcccttatttgaaagtgatctgattagttggttcctgtgattgacggaagctcagctgctgtgattggctaaggcttgttatacttgttacaaaagtatactcctcttagcagcagcaaatcagtaagtgttgggagcaacctcaattcttgcctcctcagaagaaagaattcaacccaggggcataaggctgagtgagagaatgaggcaagttttagagcaggaatgaaagtttattgaaaagctttggagcagggaggaaagtaaatagagtacatttggaaaagggccaagtaggcaacttgagagggtcaagtgcacggtttgaccttagatctggggttgtacatattggcatgcttccagggtcttgtgtctcttctcccctgattcttcccttgggatgagctgtttgtatgcacagtggcctaccagcactggggaggggctgtattcacagtgtgtttactggagttgtgcacatgctcacttaagacatttttcccttagcagttgaacaattctagaaggtcatataccagttaaactctgccactttgcctcttagtgtgcatgcttgagcccacttgccccactcctgagatcttattgggaagctgctgatcaccagtttcagatgttgggtgcatggagttgctagccgattctagtatgtgcctagaattagaatattaatccaaatttttacattacccaccctctcgtttcttctgagctatagccagagatcattggtttgttcacaggaataagcaaggttagtctaaattgcagacaaaaactcaaaaagaactgatgagactagaatcttttaacaggtttgccatcattcttgaaacacaatttttctccctccaatctccattttcattaaaaacaaatcatgataggactgatttgtttgcaaaataagctttagtcttgttatacttggcctgattatttgcataaatcacagcaagaataattatttgccacataggctccttttaaaattggctttgatgggctgggcacggtggctcatgcctgtagtctcagcactttgggaggccgaggcaggtggatgaactgaggtcaggagtttgagaccagcctggccaacatggtgaaacctcgtctctactaaaaatacaaaaaaaactagctgggcatggtggtatgtgcctgtaatcccagctactcgggaagctaagacaggagaatcactagaacctgggaggtggaggttgcagtgagccaagatcgcatcactgccctccagcctgggcaacagatcaagactccgtctcaaaaataataataataataaaataaaaaataaaaaataaatttggctttgatggaactttgttccattaggatctcagataaaatgttttaaagccataagcctagctgtgggtttgtaccatcaaatacctgtatgagttgggtacattcctcacctcttaaggtcccaagataacttggtgctcctaggcctgtgagaaagtgatattctttacttaccacaggtcaggaacactgtacagggactgcgtacagaaggtatgaggccagctttcccaagggacttttattatctctataagtcagatttgattccttaaaggaaagcatgccattccattcaaagccttggtaaaacaaccagtttctccaattgtgtcctgctgcgaaagaaggcagattattactgcacttatgcaaataatgtaagttaactttttcttgccacaagttaagaatacacaaaaatagtttccaaattctggagaaatcaggtacagagaaacaaatatgctccaaattttgtttgtaggaatatactttactcaattgttaaaagctctaaatggaaggattatttcagtcttctattagttcagtccatacatttaactcctgttctacttgatattcatgacacaccattcttggactttctgacttgtcctaaatatccctcttttttttttttcttttcttttttttttttagatggcgccttgctctgtcaccagactggagtgtagtggtgcaatctcagctcactgcaacctccgcctcccaggttcaagcaattctcctgcctcagtctcccaggtagctgggactacaggcatgagccaccacacccagctaatttttgtaattttagtagagaacaggtttcaccatgttggccaggatggtcttgatctcttgacctcgtgatcttcccacctcagcttcctaaagtgctgggattacaggcatgagccactgtgcccggcctaaatatccctctttttaaacaaccagtcattttactttaggacaacaatttaccatacaagatcctttctcatataaaatctattttctttataaccttccttaccaaaaatacctctttacctttataacctttgaattagacaacagtcattttccttctattaggaagtgatggtttgtactacatgttgctgtgtgagtcctgtgtagggaaagcaaatgtggaggttatctacgtactgtgactgctaatgtgagccacccgttggggtgacctgaaaaatcagcttggaagagcagaaccacagtggccaagaggaattgttctaggggttgattagtaagcaggagagtgaaagggaggggaaaaaaaacatgtatggaggttgaacacctgcagccaaagaaggcaaggtgtagaggtgtcttaccactggggaatgtatcagagtcatgtggcatcaaagtatattaccactagagaatatatccaagtcatgcagcaccaaagtttgttagaagtagcaaatctgtaaggatctgcagcaacctcagttcttgcctcctcagaagaaagaatttgaccaaggagcataagacagagggagtgactgtggcaacttttagagcaccagtgaaagtttattaaaaagctttagagcagaaacaaaaggaaatagagtacacttggaaaagggtcaagcgggcaacttgagagagtcaagtgcatgttttgacctttgacttggggttttatacattggcatgcttccaggtcttgcattacttctccctgattcttcccttggggtgggctgttcgaatgcgcagtggcctgccggcacttgggaggggctgcatgtacactgtgtttatgggagttgtatgcatgctcacctgagctttcttcccttaccagttcattattcctagaggaaggtcatataccagttaaactccaccattttgcctcttagtgcacatgcttgagcccacttgcccaaatcctgagatcttattaggaagctgctgatcaccagtttcaggttttttctgtctactgggagactgccattcccatgtgccacctatgaccaattattattttagtgagacatttaactacttcctgaccatcacctgatggtcgactgatgttcttagtttgatggcgggtgggggggccctctcctgccctacttgtgtctgactagctacctactgtgacactcctgagttaggctttcagttaatttactgctaagttcagttgcagttggttaggaaaggactcaagtatggaggcatactcaagccaaatttagtttagttaactacatgtccgacactgttctagacattgcagatatagccatgaacaaaacaaacagaaatctttgcccttctggagatttgaaagctatgtcagatgttttactctgagcgatcatcaaggaggaaaaagtgagaattgagagtgattccatctttctccaagtgtaccccgtcttttttattttgggtaatgttggttaaattaacacagtctgctaaaaccaggccatagaaagcgtggcaattgctggaggcaacttctgaggagcccacttcggtgggcagagtggcttctgctgagcctatcacagaaggcggcgacctctgcggatcacgcacatcagagcctcactggaagcctgtgttcctctggaagtagacgagctatccatcctgagactgaggggcgaaaaaggaaatgagcctgaaccagactccacggaccaaacaaatgaccaagtgccagaaagccttctgtcttgggcaactgtacttctgccggagttaatagcattttctgctgcttgtgcatcttagaagagtaaaatcgttttgtgaactatttccacccatgacttctcatgacactcagttgaatcagacaagctgagggtctctgagggaagatgaatccgcatcaggctttccccagcttaacagttcagaacccacttttccttcatcagtgctggcagtgttgcaaagataattctcagctcttgagccctttaaaatatttagctttttaatacgtgaaaaaaagaaaataccttaaaaaagaaaaagtggaactcaaaggaaaccccttcttttaaatataatggttcaattttaagatgaagatgagtagcatttgttgggggtctttaattacgctggtctgtggcttaccttaagagctagctgcctttgatgctttcagttcttattctaatttaactatttttttcctatgccattattgtaccatgaaaggaaactccctcataaacccatcatattgttcactgtagagaagcagcgtgtgaatatgtttatagttgctgaatatattcaaaaatgtcttttttatatgattatggtcctgaatgtttatttttatttattttattttattttttactttagcttcagagggtacgtgtgcaggtttgttacttgggtatattgcatgatgctgaggtttgggcttctagtaatcccatcatccaagtggcaaacatagtatccaataggtggtttttcagcccttgctccacaccctccctcctcaagactctcgtatatctcatgtattttgaaataatggagacattacgcaagctaaacttgagttcattttaaatattttaagctaaagtgacctgtcatgaatgtcacactagtgatagtacccttttctcttgcacttatttgttgctaagctgacttccaaatcggaattacctaaaggacttttcagatatatagatgtctagcccacactttgaattgcccaaatagagaataaccaggaatctttatttttagaaagcatcatagttcctacttggggaccactattgtactctactcaaaaatacatactgcagctgtaaaatcactatgattaaattataactttgatcgctttcttgtctttggaaaactaatacatgtttattataaaatcttgactcatagcagaaaagtgccaagaaaaaagtaaaataatctatcatctttccctgcccccaagtgctgtgactgctctgatgaccctcttttcgtatagcactgtgagtgtgcacgggtatgcatctgtcagtctgtctccctgttggagggagaacagtgctctatgtgcgtttcatagcccattgtttttcgcgcagtgtgtcacaaatcttgccacaccaagagttgtatttaacgatgtactgttaataatccccccagactcagctacagttaaggttgtagtcacacagcacttataattagataagtttacttttgtttcaaaactttctttgttttcattgtaagtcatggacttcctcgtttccaaaacctaaacaaaataaaccatagcttctaaatggatttagacattaaaagccttctcaagtatgtcacttttttttcttgattaaaaatatttaactcttacaagttgtttaaatatggctaaattctgttatggctaaaatcctaattttttattttatttccaaagatttgatgctgtgactttcttatcagaatcaccattgttgctcataatataatcaatcgggagagacaaaaaagaggcaggaaagcggtgaacttgtgatgcgatgacataaaggaagagaagctaatgctgtgttgtttgtcctgcaatatctgcttcattttgctttcagcagaggtttcctggctgctttttcctcctttctttgcccttctcctccttcgttcattctccaggagcctcgtacggaatctcattcatcctcagcaggaatatatgtattgagtcacattccaggcaccgtgttaaccaatgggaggaataaaatagttaaccaatgggaggaataaaataaagtaggaggaataaaatggaataatcaatgggaggaatgaaatagtcaaagttgccaccctcatgaagctgtcagttttggggagactaaaaataaacaggtagacaaagggtattatgtggtgtttacatcctcaacctcagaggtgatttgtcccaagtctaggtggaaccggcctgccacttgggccccaggctgtctccagctcaggaaatctgacatggggcacaggtggccaattctggcccatgagtagaagtccactctgggtctgtgaaggatgacttagacttctgtgttctatccctgtctttatgctgatctcccaagatactggaatgaccaggcaaccactttgaacttgaatttccctgtactgcatcctcttcctcatcccaaagttcctgcccaggtccacacccacactgccaccctaaccagaagatcttctgtcccacctgctccctccgtttctttgcacagacacagtattcaagcaggcaagttcatggcctgccctgctgaagtggacaatctttggtcttgagctccagcattttgccattctggagcacgaataaatctgtttcaagtttatttcatcttctctgtttcactgattggtttgatgtgttttatcctgctgcaactaatgtaaaaggaaagggatgtgctgtttttgaaagtcagagggtaaagtcccactgactttaatgataagtccattaaaaagatctgtcctgagagtcttggataccctgtcctctgtgccttcagaggagacgagtgagatgagtgaggttgcacagaccccactggactgttgggtggagaagagaaggggagcctcggcccgagcccatatcataggctgaaacatagatgtaatgctaagaacaagtgacgaaggtttaatgacttattttactttaatatataccaagaagctaaggaagacaatttgccctaatctataacactggcctaaagctgaacaaatgcctatgctgaacaaatatcatttttaggaaaaagttatatgaggatttgccctatgtatttaggatttatttttgatgtttaaccttttttagatttttttcagttcttaaatttttaaaagttgtcacctaccacatgagtgttagtaaagagtgctgagtgagagcgtccctttgtcctagtcctctggtcctaggtccaggctagcctcacagatagcagttgcccaggtaagacacctgaaagggtcttgccacgggccttgaattctaatgcagactttcaaaggataccactttctttcaccaagtataatctaactatcttgttggttttctttttttaagagtaataagttagatgctgtagttttgagatatattaacagcaaatgtactttgccaatgagtagacaatggtatattttacatgcaaagatagaattaaacccactaatttcatctgattactaattgttaaaaaaaataaaaaaaaagatagtttctatccttctatccatgccaaatactttcaaaatttgtacatgaccatccagacatccatctctcctgtagggctcagctctctgtcctctagggtaaggctggctgggtattcttgcaccctgtgctgtgcaggccacacttcaccaggccccccaggagccccaccaggaggcaccgcatgatctccatattctacacgcgtaaactgagacacagaagctgatcaccttgctcggggtcctgtgactagtaggagtggggctggggtcgcgagccaggcagtgtggtgtttgggcctctgccctgaccagcctgcctcctggtagttgtctccctattcaggtttgtcactagacattaccgtctggcacagggcctggcaggtcagtggcctcaggtggctctgggtctgtggccaccgtacagagcgatttgaactgttcatctctatgacccgtctttgtgtgtcttgttaatagatgtttcccagggagtatatgagttgcataaaaacatacgttccttttgtgaaaagtttctctaggcaggcatatggaatagagtgtgaaaatcatgtgaccactggaggcctagtgccttcacctgaagaggcaaaattcctgggtaacaagaatctacagaggaaaaacaaaataaaatacataggtactatgttaacgtataaatgaaatgtgtctcccaatgttgccccttacctcctccatacacagtcctgttccccagggggaaatctggtttctaaatctggaaaaggaagtatatttacttctatttgttatttgttggacattttgtgaagagataggaaagaaatattatgcagaatatctcatttgtaaaaagagagatacacagaaggtttttaagaataaaaagtattggaggctgaggcaggcagatcacgaggtcaagagatcaagaccatcctggccaacatggtgaaaccccgtctctaataaaaatacaaaaactagctgggcgtggtggcaggcacctgtagtcccagctactagggagcctgaggcaggagaatcactagaacctggaaggcgaaggttgcagtgagcggagatcgtgccactgcactccagcctgggcaacagagcgatactccatctcaaaaaaaaaaaaaaaaaaagaatgaaaagtattttgtttctttgtaagctgaatcaccccatcttgatggtctgtgactttttatttagcttaatatgtttgagggctctttccatgttaaccaggatatattgatctacctcaactttagctgtagcttcgtattttaacattccttttttgacagaaatgtgggcaactgccaggattttcttctgctttgtttctgctttcagagcaacagttgccctgcactcttgtgcatggccctcaaagctgttctttcttgccagctctcacctcattttccacatagcactaagatttgaaccaaggctgagagactccaccatgtctgtccagccactgtgttgcactcatgtgtcaggcacagcgcaaggtgacatgggggaaactgaggcagaggcattcctgcccttctaggccttacatttgaggttcaaagacatctagatactaataaaataatcacaaatttaaatgtacaaatgcactgtgacacaggtaacagaggagtgacgtgcatggttctgtctgcaagctcataatagagagattgacttagagtgggcaaggagggcctcccttgggaagattttttttttttttttgagacagagtctcgctctgttgtgcaggctggagtgcagtggcttgatcttggcgcactgcaacctccacctcccagatacagcaattctcgtctgtcagcctcccgagtagttgggattacaggcgcatgccaccacgctgggcaaatttttgtatttttagcagagaagggttttcaccatgttggccaggcaggtctcgaactcctggctgcaagtgacccaccctcctcggcctttcaaagtcctaggattacaggtgtgagccaccatgcccaaccaaaggatttgtgtgatagctacaagcgaaaaggagttaatgagatgaactgggaggtggagcattctgtgctgtggaagcaacatctgtcttgggtctgtggtgggagggaatatggtgcatctaggggctggagaaaggccagcaagagagcagccactggtagagcgggcaaagcctggtgggcaaggcggtggcagacgtgggctgggcctgaactgcctggtgcctttaggtcaggtggaagagtttccatgccatcttaagtagcgtagaaacctctattgtgttttaagtaagggcatgatgtgatcaaatttgtgttcaaagtgctctctggtaacagtgtggacagcacggaggccagtatggcttcagagagatcagcagaaaaacgttagcaagagtaggtgagagcctagactaagttggcaacagaagagatggagatttaagaggtgaagttaacgggacttggatagagccagctgtacaggaggaatagcagtgacggcaaccatggggtctggaaccttggcccaccatagagtgtacaggctttgagttggtttcatgagattaccacatgttttttaggaattgctttaaccttgaagagcagttccactgggcacatcaaataatacatcttgctcattccattcgccttttggagattggtatgcagatggcaactgcaaatgcttatattaaacatcgtatttttttctgtttctttccagtcattcttaaaagcatacaagcttctcattccatgagctaaaaacatatttcattccataaacagaagaaactatgtcagaaattgtaggctcctaaatctcacaaatgaggtaaacatacattaattgtttctcagatatttatggagaggcagaaaggaaatgttcagtagtatctcacttttaaaaggtaaaacaaaacaaaaatccagaagcacatagttcagcgtaaagctaatcacagttgtgcataaaatttgaataccatgtagtcagaggaaaggctcctcccatactgtggacaaaggatgtacacagctgaaacctttagtccttccctgtggcagcagccaacattttgctgcattctgcagtactgaaccaactcatcattttgaagcaagctccctgggaaatatgtaagtgaataatgctgctctgtgatgaatcacggactgaacacttcctgtatgtaacaggtggtgcgttaccatgatgtccgagaaaatgtccagctgaaatactagccccacaccgtgacgaaacgcacatagagctcaggctcagacctattgcctgtgcccagccctggaaagacagtgaccaagtaatgccctggtcatttaaatttgctaagcagcaaatgacttattggtgaagaccatcaagttgatggttttattgtaaaatttttgttagtttcactgtaactagattaaagagcaaaatataattttcttaaaatgaggggctgtgcttcagaagaacctaaagaggcttttgtgtgtgtgttgggggtgggggagttatgtttaatacagagatccagactccaccccagacctaagacctacctgacatcaccagagatgatgtaaaagcatgttatttgaaattttatggcataaatataagtcataagccactggattattaagataacagtggccacattcaaccagtttttcagaaaatacttttccaaagatggctgagtataaattatttttgtatgtttttcattcatagatctcagggttgaggctgggcgtggtggctcacacctgtaatcctagcactttgggaggccgtggcaggaggatcacctgagcccagaattcatagcctgggcaatatgacaagaccccatctctacaaaaaataaattagccaggcatggtggtgtgcacctgtggtcccagctactcaggaggctgaggcaggatcacttaagtctgaggctgaggcttcagtgagccatgctggcaccactgtactccaatctgggtaagagcaagactcgtctcaaaaaaaaaaaaaaaaggtctcagggttgaaaggtaaatgaagaaaacatcccctgtttttggagagatcagctcacggggggttctgctacttctgagtggtaaggggaagggcatactgatgtccttctctgtccactctgcatctccatggacaggtgctttgtcaccctgttccaccttataaaagcaaaaatgttcccactgagaattaagcctattttgttttatcctcagcccaaagcgaaataaagccatagaaagtttttgggatgatttatcaatgcctgaattggcatccttcagagctgatatgtgggctctttattcgtttattccctgggggtggagtataggggaaggtggcttacctgagtgaggagcctggggttggcactgcccacaggtctccctcctcagctggcctggcatatccagggaagacttccatctggaatacctgagtgactgctgggttacccatcactggagactttaaagagccctcttttaaaatccaacaagatagtgttcgtcagtttattttattgacgtataatttgtttgcatttaaaattcttagaaatacatcagtctttctctgcagtcacttttttactttacttacttaaaaattaaaataatgctatatgttaaacatatattcaataccaactctctaagaccgagttatcttttttacttgtagagtactttttaaattgtttaaatgacttataacaactatatatatttatggtgtacaatataatgttttgatatatgtatgcattgtgaaactgctcaatcaagctaattatgcttattttttgtggtgagaacacttaaaatctaccctcagcaattttcaaatgtacaatgtagtgttattaactaaagtcaccatgatgtacagtaaatctcttgaaattattcttcttgtctaactgaaattttgtgtcctttgaccaacatcattccagcctccctccccacacagcctctggtaaccacctatcttctccctgcttctatgagcttgagtttttacacattccacatatatgtgaggtcatgaggcatttgtctttctgtgcctgtcttcacttagcgtgatgtcctctaagttcacccatattgtcacaaatgacagaatttcctttaatttatcccatttttgtaaatgatagcacagttatagctgctcacgtcactttttgagtagttgttctagtcttccttccctttcagaaagacagagataatacaatctgttcaagaatcagtgactaaattaattttatttaaatattgtatgttttatttcaccctgtttggaaataataaatctatgttctgtttatctgtagtaatttcatataaaatacagttaatttaatagataagttagatttcaaatacatagataaattagatttcaaatacataaatgttaaaagtaatatacaagatgatggttttattgagtgaagatagttgtaattcagagaatatatgtggggaaatacaaaaaacaacattgtcatggccaatttttttcctgatattattactagaatgactttcctcttaataaaaaaaattgtgtgttggggaggagtgaatgttggtgggataggtcataccttagcagttacagacttgcataggaaagattaattaatatcttatcagctggaagcctgctgcctgctaaggacacagctgggaaattgggtgagcctctggagaagtctgtctaaaaaggagttaccaggaagaaggggttggaggaatggggatgggcacagagtaggaaagggaaccttaagttggcagggttggtgagaaaagctgcagtcacacagagcctgttttatgggcttgcccagccagccaaggatactcaccctgagccacctatggcctcagccttggtaatgtgccctgcaaactcttaatatgggccatatcatttgatacttagtttaaggcagagattggcggaacacagacacgtctgaggggcctagggagcacatacttgagtactgcacggctacagaggaggtgggaaaggacttctctgaacaggagtggggtgatttccagagacggtgacacgcaggagaagcatctcttcttcatagaaagatgccagctaataaatgtggaagaggcaagggaataggaaaccaccatgctgaaaaggcctgagaaatacaaggtgcaaatgactgtacatggagccaagccttctgtgtaacgaaaaagggggtatgagtaagtgtatgtgtatgtctgtcacctgtgtcacacaaatgcatgtgcacacacatccccccaacacacacacacccaagaaggataaacccaaagcaatggaaaatggctgcctatggggatgagtgagcaggggaatggggaggagggaataaaggtgagagctgcacaggagactcctctgactacattttttaatacagttttgactttagaaccaaatgtttttcatatcccagaaataaatagaatatatgaaacaagctcaccctgagattgtatatagatggaagcagatgaatctgactatgtagcaaattgacagtattaccaacctacagggaaaaaaagatttcaagtaacttctgaacacatatcattttctatatattcttgtaggatgtagtctaaggacaaaaaactgaaatgaaatcttaagctttatttagatttattttattattaataatattgatattattattctaaacttattttacatatagtaggactaagtaaataagccaatatattaatgtaattaagaatctaagttatcactgtaagaaagatgcagatactttgtttaaaagtaaggaaaatctctgtaatattaaatttgaattggaaatagtacaaaatcatatcaatattcgcacacatattctaggctttattcatgggaatgagctagaagctatgaaacttcagtagcagtgagcatgtattacaactagatcttgctttctaaataccactccccaataaaagaaaccaggacttcctggagaaattgctaatgaattttagatcttggtcagggataaaccagttgaacctatagcattttatgccaaaatcaaggttgtactcaaagactaatgagattatgtcaaaagaacacaagagcctgcatgaaagggctcccacaggccaaatttgggacaatttgatcacccaaagaatattgacaggaattgattataacacattgaattttttaataaatatatgcatctatggtaaacttaaaaaaatcaaaaatactgaaaataaatagaaaggatgggggatgtttttccttacagcatactgtaatgccaggaaataaatgtagaaatgataagattagagaatgactattttgcaaaggccaatataagatctaataataagaattgtcagtgtttgccaaaatgaccaggtaagagatattctgggagtcacaatattcacatgaccttcaagtgtcacctatagattacttaatttcttttttatgatggaaaactgagccttaacaacaaatagaagaatctagtagtcaacaccttgctcaaatttagcaaagccagtagtgatacagcttcacattatgtccttgagcttggatgtaggaaagaaaaagcagctacagaaagcatgtgggggacagttggatatattgaatgtaggcttcccattaagtgatattgtaaaatcatttttcttagttgtgataacattattgtggttatataggagatccatgctgaagtcatatttagggatagaaataatatctaaaactaagttgcaaatggttaggggaaattctatgtaagatatagatagagagatattgagaaacagcaagagaaagccaatgttaacaactgctggaaccaggcaaagggtattcaggtgtgtgttatactgctcctttgcctttactgtggaggggaggatgttcaaaatgagaagctgtggtgaagaaagctatcaaggggcagtaatacagcttcattttctcttccaggtgcttacaaattgattatgtgtaattttaattcttctttccaattttatactttccagtataaaagtcaacaaaatgtctgtaactcccaaagccctttaaaaaatatgattaaatgacagcataagggttttcttccccagtgagctatggtcagctgtaatgaacatcaactgtcctgtagcctgtggccagatgccctccccacaggggcctctcgcgcagactcagggagctttggtcacctgggcccaacaagtgtggagcagagagcagaacacagtagtgagtgcacagctggcagccttctgctttgattaagatgcagaaagtgttgagggacccagggcttcctgagttagagagactgtgggccacaggccaaggcttaaagagaaagagctgcccctgtctctactccaggcacagtggctgtagggacagcacccaggccactctgctatgtgtcgctgaaccttggcctgtcttcttaaagtactgtgtgttttccaaattgtttcagacacactgggtcttcaatttccagttctcatggatgctgtattaagaaacgcaccagaccatattaatctgacatggctgatttgggttgacattgactgttttatcttcgtgacactctgtaatgtcacactcctacaaagatcctccttgtcagacagggggccttgagaggccatcgtgaaaccaaattttctctccagacatctgtcctttaatcttttcccccttattttatgtgtctaaacaccacagttcaaaatatgtttagaatctttaatttggttctaaaactttaatgccatctcctcttcttatcatttctgtcttcatccccttcatctcccttggtagcttgactatttcaaaagctggttgtatccataatggttttgtagtaaatgtggtagcttatggtagctgagaacactggttattttagccaattgagttttgagttggtgggaaagaaatcatggccgaggtgttcaaaaccaagagctgatatgtggaaaacaagcattaaaacagtgtcactagaaagtgacggcggtggaaagttgtccatagagtaactctgctttcagggctccgtgtgaggactgagggggcaccctgaaatccacactggaaacaggcaggcccctttatgaataggagctccagctccatccatggtagctgtgcgtgctcattcattaggccttactggtttgttgtgagtgcagtatcagcatgatttatggcataggcagcctggaaataacatgagcagcacatagcacagccgtggctgtattcatccaacatatcctgtctgttcaaaggaaatgtagaaatctacttcttaatgacattttgtgctgctttttaatttttcttgcttttgaaatactgcattgttcagtactcctgtttgggagtcacttagagtgacgcagtgtcagtcagcccaagacttggtggttatctctgttttgtcagatctgagctgcactcgcctcttttattcttgtaaggattgggcatacaaacgtttcttctcaggaatcaaagaaggctctcatgagaaactgcctccccagcacctgagggccccaccatcccaaggcaggactctacatgcaaacagcatccaccctgaggacaacattctgcacagaaacctctcaaaactacagaattgtcatccacactttggccaggagtactgggaagtagctagaatggagttgagtcaattctcagctcttagaagttctttttttttttttttttttttttaaataatgttctgggaaagctagttacagaggcctttcacaaggacttcattggctacctgtaacctctggcctaagtatgtatttgcttcgtggttccatctcacatgaaattagtataaggtgaacccagtgatggctgcctttaacaagggttagcaactgttaggatggatgtgtggattgactcagccagcaccaccattttgaatgggttagtgaacagtaaaaaagaaatataaaatcctattactagttatctacccaaaggaaaagaaagcgctattcacaatagcaaagatgtggaatcaacctcgtatgcatcagtggatgattgtataaagaaagtatggtatctgtacactatgggatactatttagccattaaagactgaaagaagtcatgtctttgcagcagcatgaaggaactagaggccattattttaagtgaaacaccttagacacaaaaagtcaaataccacctgttctcacttacaagtgggagctaaataatgtgtacatttgggcatagagggtggaataatagacattggagactccagttagtggaagagtgagcgtcgggtgaagaagaaattccttaatgggtacagtgtacactgttcaggtgatggttacactgaaagcccagactccaccgctatgcagtatacccatgtaacaaaaatacacttgtaccattaaatgttatacaaataaaaaataaagacaaaaaaatcaatcctcacatcatatgagaaaaaatgaaaagaacacagctgactccttatctaaacttaggtaaaattatcgttactagttagttggtattcctttccactcaagcactctgaccagctggctagaggtaacaatctttcagaaaggtcttaaagaactaaaatgactgagcacctgcttctatccaatgagccatcccctagagtgtgaaccgtaatttggcttggatatagctggcagtgaggaagttttgtaggattatcttgcctcagcatttcttaagaactcggggagtggggcctgtcaccttaatccctttcagaagttccaaggtaagcctgccttaggctgccttagatcaggaaaaggtcatcactacagatgtaacaagagctgtcagatgcttgcttttattttcaggtgaagtcctatacctctgttccttagtgctattactgttagagagatgggaacaggagagagtggaatgagcagtgtttacctccttgaaggaaagtgctatgccaatacaaggaggtgctgcgcaggtcagcagtgcgccagcatactggtttcgtacaactcagaaactatcctgtttgcacatagcatttgccgaaaatattcagctgtctaggactagtgcccagtagagagattggcagaaaaacactcattttagctggctttcaaattatttttcaaattcaacacgaagtcagttaaggaagaccattagattatgtcaaaaagcagtttggaaaacatttatcatttgtagggagcccagcactgacgtttctaaattgtgtgtgacgttgacatgttcccatatgtcacgatatgttccttacttcccttgttatgagcttgggttagaagtcactgttcttttgaaccttgatgtcacctcagggcagtttgctagcactcagaaattcaaaattgcctaaagtgcgtggtgggatgtctatctgtatcataccgtgggcaaacgtctgacttgaaggcatcaaacaggcaaacggaagaaccatgaaggatgctaagttttgactgtgtctgggtagccaattgggagtgtattatgtagaaagccaaataaatgcttatttcaagcacttcaaggtaaaggacaatatttaactctggtttgttttgagagattagagtagtttatgcccataagaaatattcagaaatagttgttgagtgtgtgagtgaacagcagggcattaaataacattatagtcatggtctttatgagcgttaggccaatgttctatgtaatgaggtaaattatttaaggttcttataatgtgttattttaggtaaggatgttgctatttactcagtgttttttcacggaagatagtgtgctctacagattccgtgtcactaagctaagcatctatgaagcattattgataatcactcagttgactattacatacaaatttcaatgtggtcatcaactcttaaatttctttatagttaaaggataggaaaactgacaaaaaatgttactttttatcacttagtagaatttcatgagtcactagtttagaactttcatttccattcacaggacaaggttaaaagaaacagaattaagaagttgcttaggagtaggcttttctgtttattgggagtcggtattggacattcataaatttataatctgcattatgtttcagcgatacgttaatgctgagttcataggattaatcaggccacatgctgtcctgtggcttcactaatatactcctcagtcacatcagcactttctctttcacaccacacacaaaaagccttacggagcagtgggtaagcagtcctaacaggcaaatgttcacacatagtgaaagagaagtttagtttttctgtcatggttgctgaacaagataatattctctaattctttgataggaaaatagagccaaggcatttgactgccgacacactctcattggaactccatgcaggacttcaccagtcattagaagctcattccaggaatcccagcctcgaagggatcatggagaaggtgggatggagtgacctgagtctgatgggtagaaacagccacccttgctctctcccaccttcttctgtgtggacactctgcctctggaatttttagtaactgggtacctgttggaagattagttccttttgctaggctatgaactagagggagggtgtgcattcatttcactaaagtaaaattttgccttttctttgttgttagacaggatcttactcccatcatcctggctggagtgttgtggcacaaacatggctcactgcagcctcgacttcccaggcccaggtgatcctcccacctcagcctcccaagtagctgggacctacagacgtgtaccactatacctggctaacttttgtgtttttttgtagagacagggttttgccatgttgcccaggctggtctcaaactcctaggctaaagcgatctgcctaccttggcctgccaaagtgctgtgattacaggcatgaaccatcacacccggccaaaattttgccgctgatttttagaaattgaattattattttagactgaagttgtatctttttaaaatgaaagccatacctccgtatttctaagaaatcagatgggatcatcatcccatcaggtattcactgagctcctgcttgtgctccactgtctgctcagtgctggttctgtattgcggagaggatctaaacagaaagtaatccaaagggctacatctgtctttcttaatgacgaaccgacggctttccaccttacccttttggctacaaccagtgggattgactgctgtcttattgactctgtttatctagatatggtggacatattgcccagttagatgggctaagataccgatagccccccaaaatgccagattccagaataaatgaaatcactcagtcattaaggtgatatatttaactgggctggctgggctaatttgtccatgttaccaattattattgagcagacaaactcaggtaatgatggcagcaaaagcccatctggggcctgagactagaggaggaggaggctggccagaccctcctcagatgcgcagaggacagcttcaggataaggagagatcagatcatgcctgctccatctcggcgggctcatcttctctcgcccccatctgcatggtcctcttgattttcttcataataataacactgaaatcctttgagtgctaacattactgtaagtgtcagctgtttatgctgttatatgccttaagttatttcagccttaccacatgcagtgaaggagacactagtattatccttatgttgcagctgaggaaactgaagtgtggagtttaagtaactggcccaaggtaacagatgcagtgatcagaggagcagggacccacagccaggcactgtgacgcagagcctgcgctcctcactcatatcctgcttcaggcttcacaggtcttgggaagaaaaagagaacgtttacaccctgaataacattgcaaaaggatagtgcgctgtgtctgccggtcagcagagctctttgatgatataagtaggagacacctaagcaaagtaaagttgaggtcagtgtagctccataacaaaagatagggaatgctctaggtctcctcaagaaaaatctacaccatggttttctgttttcacctacagcttagttgcccaggaagattcatttattatttatttaagtaatacatcacagggacaagattcattgaagtgaaggtatttcacttccaactgtcctacagggaaacaatgagcctaaataaatcctacaaattctccctggagagggagcagtgattgattcatttttgcatctgtcaaatgcctctatagtccaaagagtgcgttttgttccctcccttaacaagattctcttacctttgttttgttcaggctttattggcgctgtgtgtataaataagattacaatgaatagaaattaacactgtatcccagttttctgagtcaaagccccaattccaaacagaaaaaaaaaatcttgttgttaaataatatatgggtattatttgtcacatatgataaatattgctactcatgcccaaaaagagactttacaactgtccttgtgctagacgaatgactggtctacaggctacagactattcacagagctttggggaagccctgaaactcacctgatagcagtgtccttgggactgaatataaacttctacagttacaaggccttaagaggttacaaagtagagcaagtttggggacttcaaaagcagtgcctgggatggcagacatcattgccgtggtgcaggggcctctctatgatcccatcgctgtgcccccaccgagacccaggtggacagtttggaggtggggagggagctgggatgtgactcagcagtcatgtggggcaaaaccagggtgggggcacgaccctgctagattagcctgaaggtggggcaaatgactggcaccttgtcacaagacattgttgtttttacgcatttgacttgatttcacccttcaggctcagggctggccctgtgaggcctttccactgcattcagttgttctttcttgaatgttagagggaggaagttggagtctctgttctggggaactgaacacaccgcacgcagcccatctggcctgtgccgtgacccacgcagcacaaatcactagttccagcggcgacaacactaacatttatacatcatgcaagttgtagtcttttattttaacttaaactttttattttcaaataatttcaaactcacaaaaagttataaaaatagtacaaaaaattgccatataccttttacccagattccccaattattaaaatttcacatttgtgtgtttctgtatatgtgtgagaaagtaaaaaacacgaagcctttttactcctaaatacctgggagtaattcctaaaagataaaacatatattcctttacataactgcaatacataaattataatgttcaataatttaataaagtatatttgtgttactctaaatggtaaaataagttttttctcctattaattaatatgattaataatactatgacatggagattagaaaaattaagatttaaggccaggcacgatggctcccgcctgtaatcccagcactttgggaagctgaggcagacagatcacctgagatcaggagttcaagaccagactggccaacatagcaaaaccctgtctctactaaaaatacaaaaattagccaggcatggtggtgcgcacctgtagccccagctactcgggaagctgaggcaggagaattgcttaaacctgggaggcggaggttgcagtgagccaacatcgtgccactgcaccccagcctgggcaacagagcaagactccgtctccaaaaacaaaaaagaaaagatttaaaaactaaaatataatcttcggttttacatatatattaatgattgtttctttttcaggtgataatttttttaaatatgtgaatggctcattagtacttgtgtccttttaaaaacacttatgaataccacagcaaaattaggttgtggtgctattactatatctatttattagtctgctcaggcttccataacaaaatacgatagactgggtggcttaaacaatgcacatgaatttttcacggttctggaggccagaagtctaagatcacggtgctgaccaattcgtttcctgctgagggctctctccctggtgtgtggatgaccaccttcttgctgtgccctctcgtagaagagagttctcttcctcttctaataaggacaccaatcctatcagattaggacccaccctaaagacctcatttaattctaattacctcctagataccccatctctaactataatcacattgaggatagggattcgacatatgaattttggaggggcacaattcagtccatagtgcacagtccgtcatttcatttcaacatcattggagaacaccttcaagcacatgatacctcctttgatgtgttttgctgtttaaaggcgtggtgaacccttgacagaaacattatcatggattcttctccacatgtttactgacttcattgtgcttttcaagttttcttcctccttaaacaacataaaacattttggaaaaagtactggaatattaaatgtgttgttcaaatttgatgctgatgcttgaatttcaaggcaaggcacatcatgggcttgaccttcatgtcttcagactcacagagcttccagtttctcagactggattattataagatctcatacgagttattttgagggaagggaatggaaaataaagattaaccagaaatcaaattccattttcccagccctcccttggcaatgcctagtggtcacatttcaaaatattatacaaacctattttacagtaaatagacatgttttgaagtggtgctagaaagaagaggggcgtctctgccatattctagttatcatatttctgttcattctctgctcagtgtgggcccagaggactgaaaaacagtcagtaagcacctctactttttgcctatggcatgcagaaatttctccatatgcaaaaaagtggggagaggggagaaagattaagatgtttctgtctggtttcagtcacatttttagttctttcccactttcatttgttctctgattttttttttttaatggtaagaaattggcaggtttctcacggaactgcctgtgtttaccatactactgataattcttgtaaactgtctaccatctcagttccttacctcatcgcagctttttatttctttacagatcaagaccatcatccttttaagcatttttctccttgactctgtctcgattgtcctgttctctctcacctcctaggcaattaccttatcttaataaaatataattgggccggtagacgtttctttctatttgaaaagcctcccagcctagcctgtggactgatctccctgccagccagtgtataggtctccacaggcctcctcttcttccatgaagggactgctaaactcagctcaggcagcatagggctatgattgctttcccattcatcaccccgaaaaatgagtttgcactttaatttataaatataaaatatattttcttggttacggcgaatcaaactgaattatatttgtgcaattactgagttacatgaccgaatgtatatctacgtagttgagattattcttgggaaatgcaaggagggactcccatctgattcagttatatggagcagctctagggtagcaccattctgggctttgagggtaacacgatgtaactggtattgtatacattaacattagtagagttccttggctgtttaaaatagctagaaatcagagaagtatgatacaaactactacggactgaatttctgggtatgtgttgtattaaaagaaaacaacaacacaaatttcggaagtttttgtagaacaactggctttcattctttaaaaaggttggtgtcattaaaggaagaaatgctggggattgttttaggttaaagaaacatgatgacttaatgtggtgcttgatccttgattcttgagcaaaatgaaaagtttaaaagacattgggaaaatttggaagatgtagatatgcatatatattagataatatttttgtatcaatgttgtatttcttgagagtagtaatactgcagttatatggaagaattccttgttcttaggtgatacatgctaaagtattgggggaaattgtcataatgtcttcaactttcaaacggtttggcaaaataagtgtatatatgtatgtatgtctatagtgtgtgtgtgagaaagtaaacacacacacacatgcatagtgaaaaatagaagttgcaaagattcatttttgtcattccttatttcttctaatcgagtaaaagttttctaaattagctttcctactaataaataaaatatttttcttatgctcggtcaggaaagctaaatgggagaggcaagcccacctaagtccttccctgtcaaggagggggtagaaaatacatcgtaacagtacacccagcgacctccagagtcactggttccatatgtgcaggattcacctaagccacatgccaaccacaagatggttttctctgagacttcttggaaaaataaacccaagaaattcaaatcacttgatgtcaaaggatctaaacagagattgcagactttagctgtgtagctctctggtttgtgagcagaatgagattgggggtggggaattgcactcattattgaacacctcttctgcttgcagtttcagcagcagcagcctagcttccccctaaatgtgacacttcttacttgtcatcacttaccatactttgggaggtattttatcctcttctttatgtgtgtgtgttcagttgtgtggggaagtgaattgagtcttaacattttgaagtaaaataggcttgttttctttttaaatccctctagtcatttagtgaaatactctgataaggttttattaatgaaatataaatagaaggaagattcgttttgaaagcacagtgccatcttagaaaacaccaaaagaggaaagaaaaaaaaaatgaagactgtaccttgatgtcagagctttgggggagaaactgattccaccttgaagggagatgacccaagcttgacagctgcctccacaaggagtcctattagcaaaagaaggggagccatgtgctaggagggccattttctctgttcttcgcatcactgaggagtgttcagcaatcacacttggacttgatacagaaaatgactgcattgagagcccttcttcataagtaagccatatatggtaactaaaaaaacaaaaacaaaaaaaaaacaaaaacaaaaaccctaacacttcccatcacaaaaccaatttttttgaggattaccaggctcgtgttttctctctagtatgtcagggtttgtgatacttctggtcagagtgtggaaagagtttgggctatcagcacaggccatattctgtttgcttcatatgcatttggagacatgaaatgatattttactggttaagtttccgctaagtgcttagattttctttattgcgtttctcttacactgttaaacaaaatattgtgtggctaaatgatttcagcctatctaatttgcttgacaattagacagtcgttctagccttaggaacaaaatatgttcatcataaaaaaattaagaatgtgatctaaagttcaaagctgaaatattaaaacattaataaatagaaagctttaagaactattcactcagtatgcaaagaaacagtcatttctcgctgctctaaattctattcctgcacataaaaggaaaatatatcaagtttaacaattcaatacaaaaaaaaaccctgcaatgtgagttctccaaacaaacatccctattatccctacatacaggtatagccttaggttatatttttatgatttcatttttgaggtatatacaaaacatgcatatggttttcatcactagaaataaactacactgagtcctttgggtttgctttctttatttctttattatatgtttaattgatcacgtactttataactttcagtattttgacattttagagtacagcaatgtgctgtattgctgtaatccacatatagttatatttggaatgatacgttatgcttgagttagaaaaataatttgacacatccactacccataacacatgttcagtggatatcatgcctgccagaaatatttccatttacacactgctagctctcatacataattacttacttgttcatctcaggacatagtgtcagattgtactatgtaatataaaataatcttatctagttgcataatgaattttattatctgagagttgtttatatttgatggcattttccctcttagagaaaatgaattttaatgagagaaaaattgctaacgtttttaaagccagcactcacattttggcattacagcatatttggagtgcccggtgattaggatcactgttctttggtggcagcgtgtgaggtctgtgaaatgtgggaaatggtctgtaacctaatggatctcataagaactatacatattgaaaggtgattaatttaaaataagggatgagttgaggataatgattgctttggagttgagcgaaaagagaggttactatgaaccaaaagagaagatgcatgaagatgaacaaaatgtgaagatgcaccaagaaatggctattgtagtagtagaagcagagagaaatgcagagtgagatgagggggagagagaagactggaggcacaaaaagactttatcaaggctgaatttttattttattttattttattttgagacggagtcttgcactgtcgcccaggctggagtgcagtcgcgccatctcggctcactgcaagctccgcttcctgggttcacaccattctcctgcctcagcctcccgagtagctacaggcgcccgccaccacatccagctaattttttgtacttttagtagagacggggtttcaccatgttagccagaatggtctcgatctcctgacctcatcatctgcccgcctcagcctcccaaagtgctgggattacagtcgtgaaccaccgcgcctggccctgaatgttttaataagcaacaaatgactgatgttcctaaagtaatccattcaaattcacatactttaatagaaaaataggcaaaggacatgaaccatcagtttataaaagaggagatgcagatgatcaatatatgtattaaaggctgcacaacttcattaataagcaacaaaatggaaattttcaaagtaaaatgctaggtatcacatcatattgacaacttttgaaatcccattagggtacagtgaaaagggcatccttgtgtgtggtgacagagagagactctgcttcaaaaaaaaggggttggcggggtggaaattgagacacagggagagaatgtgaagagacacggggagaaggctgcgggaggacagaggcagagattggaggggtcctgccacaacccagggaacatctgggccaccagaagctgaaagaacaaggaagggtccttcctctacaggtttcagagggggcatggctctaccagcatctggatttgggatttctgggctctggaactgtgagataataaatttctctggttctgatccgcccaatttagggtactttttacagcagccctaggaaattagcacagaatccaagtgggacagccgaggtcatgggtggatatgaaactgtagagttcaaaggagagatctggactagagaaataaaatttggagttttcaccggatgatatttcaccagaatagaaattggtacagttttgtggggaagcaatttatagcttgcaccactactcaaacatgagtctcaggtaaattaatatacttagaatttcttctaagggaattttccaatgcagtgatttatagataggattgatggtcacgggattatatatgacagtgaaatatttgggcactacctacatttccaataatggtgacataaataaatgatggtgcacatttcattaagtgcggttagtcattaaatcctgtgttttcaggaaaagaattcatgacatagagaaatgatgaaataagtggtacagtaaaatccaaatgtcatttaaaataaaaatgtataaaaaagactggataggaatactctgaagtgttagcaattctgaatagtgaaataatgatttgtattttcttagatcttctctatatgttttagattttatgcaatgaaaatgaattatttttagagaaattatattacatgttcttgtattttaacaatttattgagacagaaaaaataaaataggtagagtggagtcccaaagagagggactgattttatgaatcagtaaatgccagtgttatccctggaccagcaatgaggttgctgaataaaaaagtgtatgtttgtgtgtgttggtgtgttgtaaagctaggaaaaatgtttggcagtttgaaagaaatatatctgccaacaaatattcagaaattacgtgccatattttttaaaaaagaaaactttaagcattctttatagtaggagaaacagggactaccgaggtcagaggaaatgagcagagtctagaacctcagggagcaacaaaggatgggcatggtcagcaaccataaccgtaagctgagctctttcagactcctgcaggccttggcctgatgcgtgccctcctgtgcagccacgccacttgtacacagttcattttagtgcaggcgagttatctaaatcccacagtaaacaccctcagtatgactagtgcacaggtacatgctgaatatgtgtctcttcattcatttaacaaattccacatgagcagctgtgataagccaggcaaggttctaagctttggagaacaaaattaacaaaatctctcctcttgtggggcttgctttctgatgggaggagatagaatgtaatgaaaataagtagcttatttgtactatggagaaaaataaagctgggaaggtagataaggagtggggtaagtgagacttgtaagtagagtgggcaggcaaggcctattttttttttttaaacacggtctcaccctgtcacctaggcttaagtgcagtggcaccatcatagttcactgcagtcttgaactcctgggctcaagtgatcctcccatctcagcctcctgagttgggaccacaggtgtgagccaccaccctgagctaattttttaaaaaaattttgtagagacagaatctcactatgttgcccaggctggtctagaactcctggccgcaggcaatcctcccaccttggccccccaaagtgctgggattacaggtgtgaatcactgcatcctgccaaggccttacttttgagcacatgattcataaagaggaaggaagccatgaagacatcaggggaaagaaattcgaggcagagggagcagacagcagtgcatgcaggagagcataagcatgcgtgctctgggaggggacagcaaagagtccttgtggccggagcaggataagcagaggaaggagtgttggcagtttaggtctgtgctggtggggaagccagtgaagtcagatagggcataggggctgctgtaaaaggcttcagcttttattctgaatgcaatggagtcccgttggaaggttttgaaaaaaggcgtgacattgtctgctttctactgtagaacagaagagttttctgtgcttgtctccagttccttttggaggactaagtgtggctgctgtgttaagcatagaccaagagatggcaagggaggaggcaaggacacaagcgaagagactgcaccgacagcacaggccagaggcagtgatggctggtcccgagtggtagcaggagagagatgggtgggtttcagacgtattttcaaggtaggaccaacagggtttgctgatagattgaagtgtcaagaaaaaaatcaaggatgtctctgaggttttcagcttgagcaactacaaagatggatttgccattttctgagaaggaaactacaggaaaatgaggtccgggtgggagatgaggagaaattaagaagtcgggatttgtttggggactgagaaatttgaaatgtctctgacatctgtgatggatttaattgtgtccccccaaaaagatgttgaagtcctaacccccagtacctccgagggtgaccttatttggaaacagagtctttagggagataatcaatttaaaatgagacaattagggtagaccctaatccaatattttataaggacaagaacagaaaaccagacaccgcaggttctcactcataagtgggagtcgaacaatgagaacacatggacacagggaggcgaacaacacacaccagggcctgtcagggtgaggggtaaggggagggagagcattaggacaaataactgatacatgtggggcttaaaacctagatgatgggttgataggtgcagcaaaccaccatggcacaggtatacctgtgtaacaaacctgcactttctgcacatgtatcccggaacttgaagtaaaattaaaaaaaaaaaaaaaaaaaaaaaaaaaaggtgctcgggcaaggtggctcatgcctcatgcctataatcccaacactttgggaggctgaggtggcagatcgcttgaggccaggagttcaagaccagcctggccaacatggcgaaatcctgtctccactaaaaatgtgaaaattagctgggcatggtggcaagggcctgtaatcccagcttctcaggaggctgaggcacgagaatctattgaacccgggaggcggagtttgccatgagcagagattgcaccactgcattccagccaaggcgacagagagagactctgcctcaaaaaaaggggttgggggcggggtggaaattgagacacagggagagaatgtgaagagacacagggagaaggctgcgggaggacagaggcagagattggaggggtcctgccacaacccaaggaacatctgggccaccagaagctgaaagaacaaggaattgtccttcccctacaggtttcagagagggcatggctctacctgcatctggattttgggtttctgggctctagaactgtgagataaatttctcttgttctgatccgcccaatttagggtactttttacagcagccctaggaaattagcacagaatccaagtgggaaagccgaggtcatgggtgaatatgaaactgtagagttcaaaggagagatctggactagagaaataaaatttggagttttcaccagatgatatttaaaacaacgagactgtatgacgttctgaaggtgtatagacagtgagccctgggggaactgttgctttaaagggtttgggagttgaggaggaactagcaaagcaaactgaaggcattgccagtgctgtagaggcaaaccaggaaggatagttccgaagtaaataaagtgttctaaggagaaaggaacattcatcttgaccaaatgctactggcaggaaggaatgttcatcttgactaaatgctactggcacatcatgtaaggtgaggactaaaaagtgaccattggatttagcaacatggaggtcacaagaaatccacactcatcgattcagataggatcaaaatcctcactggaacgagttccagagaaacttggagaggaattagagatggagaataagtagctctttagaagacttgggctatcgaaagcatcagagcaatgggataccaactggaggaataactggaggagagttgcacaggcgggaatagagagaattgctagggcggcctcctgcacaacaggaaggggtgaaatgtggggcatgggggagagcccgtctcagtggcacagtcatctcagcatcagaacagggtggaaggtggagaaccttggggaattggggaagcttgtgtaggtctcttcttctttttttttttttttttttttttttgtttgtttctaagacagagtctcgccctgtcgcccaggctggagtgtgtggagtgcagtggtgtgatctcggctcactgcaacctccaccttccggtttcaagtgattctcctacctcagcctcccgagtagctgggattgcaggacccgccaccacccctggctatttttttgtatctttagtagagacagggtttcaccatgttagccaggctggtctcaaactcctgacctcgtgatccgcctgcctcgccctcccaaagtgctgggattacaggcgtgagccaccgtgcccagccaggtctcttctgattgactcattttcctcaatgaaacaggaagcaaggtcatcagctgagagtgaagatgtggagtgggagatgtgaagacagagggggaggcatgaaattgttctgttgtggaaacgaagggtgaatggactgggaagggcagcacaactcccaggcagcatggagggctcgctggaggctgtggccatgcactcgtcagcatggctatgccagccagaggggagtggactctgtgcagggctgtgaccaggtgtcaggggtaagctggggagttgagggttttgtgagggaatgatgggcatgactggctgtagggtgagctgggtgagaagagagaccaggacagaagatgtcaagacctttgttgaatgaatgggcaaagataaaaaaaaagaaactgtcatctcaaacagttcaagtcaggactgcaaaagaggaccaggtgcctgtgcctggtaggaaggaggaccaagatggcttccaagaggaaaagtcttaaagcatgaacggaaatttggacagacagatgagcaggtgaggaatgggcaggtccaaggagagaatgttgtgtgccagtgccaccccaaaggcggcaatacaggtgtggcctgcaggtaatgcacttaccaacaggcctagaaactgccttcttcattactgaggattagtaatagtaattattatttcttaattataaatttaatgcttctttgtcactccccagtgtgtgtgtatacacacacacacgagaattatgtatgtaacaatgacatatttacatatgtaagaaattataaaattatctatggctggacacagttgttcatgcctgtaatctcagtgctttgtggggggccaaggcaggaggatagcttgaagccaaaagtcagagaccaacctgggtgccatagcgagaccctgtctctgcaaaaaaattttttaaattagctgagtgtgatggtgcatgcctgtagtcccagctactcaggagcctgaggcagaaggatcacttgagcctaggatttcaaggcttcagtgagctatgactgacctctgcgctctagcctgggtgacagagtgagacctggtttctaaaaatttaactaatgtgtacattgtataaatataaaacaaaagcatattgtctgtctcctccccctacccaccacccgtctccattccaatttccttcttcagatcttatgaacattcttcctagccacctttaggccaactcctcatctgctgggtttcatgcagtattccagaagaccagcctgaaaatagagaactcaagctcttgtatgtttagtctgggttcctgccaaataacgtgcagcactgtcgagaatgatgtgacggacagagcttgatgcacagcatgatggggcaccctgtccacttgcctgtgagtcatgaacatttcatcatagggtttacagttttttgttatagatgtttaatcacaaaaataacagaggccacttatgctaagtatattctgtgaggatcattcttgcacacgaagggtaacagcatgaccttgatatggtaaggccttggcattgcagaggagaacaggctgcagaaggtaatgtgcgatctcataaactggactccttgtcagcattcttttgatatttcacaaatgacaaaagtcatcaagagaagattccaatggttcagatatttaacggtcacccgtgtttatactacttttgaatgggtgaaactttaggatggggattagttaaatcatgctataaattcaggcccagaaaataatggagaaagaattcccaaagctactagaattctcccacaattgagatgtcagttcacacccacagagggcttctggtggtgacagttggtggaatgagagccaggatcctacagcagcagcccttcatgaagggcacatgaaagctctgaagagtgcagaaagtctcactgtggtcactggatgaaattatgacctccagtttctcagaaaactaaaagtgtatctaccattcgatccagcagtcccactactgggtatgtaaccaaaggaaaataaatcattatatcaaaaagacacctgcatgcatgcgcttgtcactgcactgttcacaattgcaaagatacggaatcagcccaaatgcccatcatccgatgagtggataaataatatttatagaaatatttatataccatggactactactcagtcatagaaaagaatgaaataatgtcttttgctttaacttggatggagctggaagccattattctaaatgaagtaactcaggaatggaaaaccaaataccacatgttctcacttataagtgggagctaagctatgggtacgcaaaagcagacagaatggtataatggacactggagactcggaggggggcaggtaggggagtgagacatgaaaaactacctattggtgtacagtgtacactgttttggtggcaggtgcactaatatcccagacttcattgctatccatgtaaccaaaaaccacttgttcccctaaagctattataaaaacttgttttgcaagaaatcgaaacttaaattttagaaaacttttaaaaaattatgactctggattcctataaatgtctgcttctgtttggtgttgtatctatagcaacatagtgacaatattaggtagcaatttctgaaccacagctttgaaaatttgagcaatggtgtttccaatttcatttattaaattcttttaaaaagtttagttattaccgatgatggcaaagaacatttaggtttcattaagtgatagttttttatgttatagtattctatgttttctttatctattaatgggtttttcttcttatctgcagtgaccctgtctctttgaagttttaaatccagcctaagttttcaatagttggtttgtatttctaatacgaaattcagaacatccttgatcatgattttatttatttattttgagatggagcctctctctgtcaccccggctggagtgcaatggcgcaatctcggtccactgcaacttcagcctcccaggttcaagcgattctcctacctcagcctcctgagtagcgggattacaggcacctgccaccgtgcctggctaatctttgtatttttagtagagatggggtttcaccatgttggccaggctggtctcaaactcctgacctcaagtgatctgcccccttggcctcccaaattacaggcgtgagccactgcgcctggccatccttgataatgatttaaatccacttttccataggactaagcttgactatctttgacaccattttgaccacattattaactctagcaaataggataaaatataacagtcatacttttaaaaaataccttccctacatccagaactgggtttctgaaaaataataaataggaaaattcatggttgagggacaacattgggaagcaatagcaataggtgacctgtgagaacccgaaaatagttatttcttcattccacataatacaataaaggtgaagcaccacataaacagtccgccaattgtataaacatattttaaaatagtaataacaaatattattcagtagttcttatttaccatctcctgcttggcagaaacttttcaagaatctgccatttccaaaatttcatgaagatacttataaaagcatctcccttatttctggaaatatgcctattttcccatgtgtctgttgtgatagacaattgttcagagtcattctggttttaagactcagttattctttctctccttgccttaattctttccttaagtcctacctagtgcttttttttctttctttctttcttttctttttttttttttttttttttgagacaagatctgtcgcccaggccggagtgcagtggtatgatctcagctcactgcagcccatacccgccgggctcaagtgatcctctcatctcagtctcctgagtagctgagactacaggctcatgccactaggctcagctactttttttcgttcattttttgtagagaccaggtctccctatttttcccaggctggtcttgaactcctggactcaagggatcctcctgccttgacctcccaaagtgctgcaattacaggatcaccacaccaggcagctattgcttcttatctggttccttgagatgcagagtaaccgggctgctttgaatgaaagaaggcttggaataaccatcatttaacctatttcacttaacccagccccctgtctgtcaataaccaggtttccctagcctaagctctatctgtgattccttcctgctaaagcacaggcctaagggcctctcacaggagagtgcagttctctttctgtcttcctcctttcccttcatattaattggttttgttgcaaaaacccgtatttctttaattttttttattttttcccttcttttcatggaagtcataaaaacctggtcattctatttctaaccccggttctctctctctcttttttctttttctttaacgtttttccaacaagattgtctgtttatgcatatcctctgtatctggaattgtcccaatgacttcaaatatgtgggggtatacatctttgtgcactaaaattttgaataacaagaatttttatttgaaagggatcatggcatcctattttaattaatctcaataacaaataacttgttcaattctagaaccacagtctgtcatatctacatataacagtaatagcagttcagatatgtaaaacttgttattgctcatcctgtaaggcaaagaaaacacattctgctgatgtctttgttttcaatactttttctctcattcattgtgatcagggtggtaatatacctgttttaatttatttttgatcatttttcctattttgttttgtttttctgaaagaccaaacctttcatttggttacccctttcaaaaattttgttttttgtttttctttcaactgttgacatactctctctgagacatatggtaacatattatttccatggggcatgcctaggcattttgtgggaaattacatgtatttcacagaagtagatgctctttttgaccaatatttttattttaaatgctattaaccaatatgctgttaatattcagcaagagtaatcaagtaactcgtccagtgaagctgatgggattcttgagagagtgcaaggtttccctctctggagaatctgttgaaggagggtttttgcatatatgctggtttaaaggaaatggaggtgttgaactttagaaccatgttgcttatggaaatagcttcgcgtagagtaactcttagtccattttgaaaccctcttccctagaaatttctatctctttcatttaatactgtggcaaggttaataatatttacacatactttcttctgtgttgtgagatgttagtttaagttggaacatgctggcttgtcattttctaaagtgaatcagtttatctttggtttagcctgaaattgcagcagagagtacgcatcctcctgggatctgaatgtaaaataactgaaacagattgaagttggcagtgactaatgaagtcttgcgcataagtcggcaagtcagtaggtttctgcgtatcaagaaggaagagcagaggaacccgagcccctggggtctaggcatttcttccttcttccccctgtgcccagctctgatggaggaggggaatttaaccacagatattccacctacattctttctaaagacatcaaattcctagtatacaaattcgttacattactggtaattcccagctagcttccttgtttaacgagccgttttagctgcctaaaggtattctacatagcaattttaatcagtcatataaaattgatgaagctgagataccagggaaaattagaatggttatattgtttctttgataactccttccgcaggctggctacactgttccacctttagtgccctggaaatgactccatgtcaccaatttacatagtaaagaccactttgctcatagctgagtctcagtatgcccagtgaggctttgtgttgttttgttttgtttgtggtcagcattcatatatttccgtacatcactacacatatacacctttacttcagaaaatgccagattaatttctttgtttctttcttgaaatgttttctttttgcacttttttttaaccattaacatggtatcagggatccatagtatcgcgttgtatttacaagattacagaaatacaatctgcttggcacatttagaaatatgttttgaaagaaattggtgtgctgttacccttcggttcagttctcccagcccgttcccacatagagagcaacaagatttgtgttttccagctcattaaactgacagcagaaattagattgtggtattaaaaactaaaaagttaaattacagctacacatgtcctttatgcagtggggcgtgtggaagatgtttgattttaatgtttgctataatggagaatttaaattacaatgtttgtcaaatctctaatctttgttacagagtggaatattaattacgcttttaactatgagaggtaaataaaatgagcatccactgcacgcccaggggtaaattgcagattaccaacaacgtgacataatgcactaaatgtcagttttgtcaaacaaatttagaagaacggttaaactattagcttcctgttgttctagggcctttcttgcagcaagcaactattgggagcagcagggacactgtgccttgtggaagactaagggagttaaattgaataagcaagatgaatggggagacagcaccacagaggcactcaattagtttataactgtctattaacttctgtaggtggttttgaataaacagcagattatctgttgcactcttgggggacaaggggagccatgggagagggtcagtgtagcgctcaaaggaaagagattttttgattctcaattgccctctgtcttctcctttcctacttttgtgcatgaagcatgggtaatggttgtcaaaaccttctacatgtttaaaacttacacgcatacaaaggagcagtgcccgccttgacatttctcttggcagttcttgcatggaacactggtgtgatgcccccaaagaataagttgaatttaggttctttggctactttttcagaacatgttcttgggaaaagagtagtaactcttggttcttagaactcaggaagataaaacctctccatgaatgatcatagccaggatttctttccagagagggctgagagtgtggagggaaactgatggagctctctgcatcatgcagtacatcctggagacttgcagggcgtgggaagtccccttgcttccagtgaaggcattgtttctagcttcagtgtttatgcaagttctaatctcctgatgcttaccttagagtacatttaggaaccagtgctctgttaatggaaaaactaaattctaaaagatttttaagaggcttattctggccaagcccggtggcttacgcctgtaatcccagcactttgggaggccgagacgggtggatcatgaggtcaggcgatcgagaccatcctggctaacatggtgaaaccccgtctctacttaaaatacaaaaaattagccgggcgtggtggaggacgcctgtagtcccagctactcgggaggctgaggcaggagaatggcgtgaacccaggaggcagaggttgcagtgagccgagatcaggccactgcactccagcctgggtgacagagcaagagtccatctcaaaaaaaaaaaaacttattctgagtcaatatgagtaaccgtggcccaaggaaaaacagtcttaagagatcctgacaaagtcaagagagtcagattacagttttctacattttggagaggaaggagttacaggcaaagacataaatcaatacatggaagatattgattagtttagcccataaaggtgagatatcttgaggtggaggcttacaagtcaatagatggattcagagattctttaatttgcaattggttaaaggaacaaaacttggtctaaaaacttggagttagcagaaaggaatgttttaagttaagataagcatgctatgtcagagtcagccacaatatgacctgcttaacaaaagcagtggcttgcaggcatgacttaacccttgccttaggtattgtttataatttgatatatcattaccacaaagagtatgtttagtcaatcttatgatctctattttaacattaatgctggtcaattattgtgcctaaactccaaaagggggcgctataacgaggtgtgtctgacctccccatcacatccaggaactcaggaaaatttttaagatttttctgagttcctcttggctacaagtcagtggggagcttaggattttcttttaccgcatggtacaatcactagatcattataaagaattgcaaattttaatgaaattgctgaagaaacatggtgagaattaaaggggaaggagataaaagattagagatgaaggaaaaaacaagaccaagaagatgtggaaactgtgagtgatgacttccgaactttaaagtatttttagtgcttctgaatttatgtccttcaaactgtgtaccaacttgcttttttgagcatgcagacattacataatgcaagccatttatcagagttcttttacatagcacagaacagtcataagatactcttacttttcaacacacatacacacacatatatcccacaaagggattcattttccttttgctattttgaaaaggctgagaaatgtatgcctccaccagcaggattggggcattctttatgtgaacctgtcccacttaaaaccagttgtcaaggagagaatcaagataaaacacagtgtgtggtgggtggatccactaagtgaggaaagcttattaggaaagagttaggaaagctgtagttcctcctgaataagactcctttgagaaaaagagccaagacttaatctaactcttgggtatctgttttgacacctgtgtctgtaattgctggtttgctttgtaataggggtgttttctttggtcatccattgaattacctttaattcaattaccattgaattacattgaatcgatgctcttaatacctaagttttctttgagctaaatgtaagcatttatgtgctgatggatgttattaaaccctacatctcctttataatcattcatgagatccatcagcatgagggcagtttcttcatcaacagactgtacaaaacccttatgaggtaagatctcagtgaacaaaatgagaataatcagatgaaataatagtcaagtgattgcccttgaaaaatagaggcacttgatacaacttagacttgaagtctctttttttttctgtttttcctcccactaaactattgcagatttgacagggtgtttattttgcaaatatgattggagggatttgtcaaggaagactaggatagcaatggtcatgaagaaaagcattatccaaattataacccaaagtttactcacccattttccctgtgttccctggcactttgtggagcctgtattgttgtcgctgtgggggttggtttcacatgccgtctatcccagtacctgtgagtttctcagaggccagggctgtcattgtcaccctgcatcccaagtacctagcccagtgctgagctcacaggggatgcttatgcaatgttgaatggattgttaaaagaaaaatgttagacaaattaaatttaacagagtttaattgagcaaggaaaaatgattagtgaatcaggcagccctcagaataagagcagattcagagagagccaatgctgccatgaggttggagaaaatttatagatagaaaaacgaaagtgacacacagaagacaaaagtgaggtacaacagctccattggttacagcctggcatttgccttgtttgaacagttgtttgcctgtgagtggatgaagtctggtgctgagtttgtctggggctcggctattgttacagaagcacactcctagctcaggttttcagtccgctgatactaaatcaagtttagcctaaaccttcctccttacatattttaattttggcctacagatttccctgtgcatagtgaactgtaacctaaacagactgtaacctaccaatgattgtgattgtgccaatcaccaagtcttggccaaaggtggccaactgctcaaactgggttcaagcaaggcaaataccacactgtacccagttcattgtttctgtacctcacttcagttttctgtatgtacctcacttttctttttctgtccataaattgtctcccaccacgtagctgcactggagtctctgagcctactttggcttgggaggctgcccaattcaagaatcattctttgctcagttaaactccattacatttaatttggctaaagattttcttttaacactgacctgctaagataagttgtggtttgtccataagaactcaagtatgcaaatatggaggttttttcaggccagattttggttgatttaacagaatgaatactggaaaagacacctttcatgggtatccagatatccaagaagaaatcacagtgctgtttaaaacaaaattaagccattagggaaagtttttgtctcatttttccctcctatctgttgagtccttaccaggtataggaactgtgctttacatgtattctcatttcattttcatcaaccccctacaaagtagatgacatgctttctctgtcaagcatatgaggaaaccaagattttacaaagtttccatctctttcataaggaaagccggaactgacagagtatgggggctggggacgggatctcttccgattgccatttactcattgaaataagttttcatctgagcggggacagagagtggttaatggaggtagaaggaggtaagagaaaagggaaaatcagttttcctaaaatgtaatgtctgtcatattattctcctgctcagcaggactttccttgtctaagaattatgtacccacttctcagctttgcctccaaggcattccacagaatgacaccagggtttcactataggcagcttatgccttatttggttttctaagcattttttgaactgggcatggtggtttgcacctttaatcccagctgatcagaaggctgagacagaaggattgcaagcccaggagttcgagaccagcttgggcaatatagtgagaccccccatctcaaaaatagataaataataggctagtgtggtggctcacacctataatcccaactctttgggaggctgagacgggcagatcaccctgaggtcaggagttcgagaccagcctggtcaacattgcgaaaccccgtctctactaagagtacaaaaattagccgggcgtggtggcacatgcctgtagtctcagctactcgagaggcttaggcaggataattgcttgaacctgggaggtggagattacagtgagccacgatcgcaccactgcactccagcctgggagacagagcgggactctgtctcaaaaataaataaataagtaataaataaaaactggttgactaattataaataaactgaaatgcatagccatgtggtagtaattctaagagtcaagagttaattcttgtgtcttatcaaaatgaaatgttaaggaagcatcaagtcagtggcctaaagttggatagattaacaaaaggcttttctattttctgttcatctaagtcaacctcaaatattacagatattttttaaagaactacttatttttaaaggactaagaattattttcaaagaagtatgtcttcaagcatcatgagcagaatgaaaggccgaatgctctccttgtgacaaagtgagtggacagacccatccgcagtgcagcatgcctatcaccagccaccagcgcagtccaaagttacatgattgaaaaagaaatttgcacctgattgaagatgctttgggctcagttttgctgtcctctccccacagaagtctaagctgttcagactgctcaagataacacttcacacagtttaggaattgtggtttatgtcgaacgccaatctatatcagctttcataacatttaatatggtggggggagtgataggtgtttgagaaattaagcaaaaccataaattttctcttggtatgtatagtatatacaaggagagctttcgagtaccttcttcctagtgttctctcttaactcttgatgtgagtgaaaagcttcatccattgcatgacacagactaggtcattgtgtttgaattccttgggttggggagaagtatggtagagtctttctcctcacttcagaaatcaaaagaaagtacagtacctgcttggtaggtattccttgaaagttgccagcacttttggctagacagctcccagataagcagatggcttctttaatgatgaaaccccacttttctacaatgctaattagttagagaaagataatttgaaagtctgctgtacattgcaggaaatgtcttttgtgtctgtgtcatttgcttctaagaatcatgcaactgccacctgagtaggctccagttttctctttttatttaaatcttgtgactcttcaatcacaagaaaaggggaaagacagtcaatgaggaaaaggagaaccctctttcaggatgaaacactcaattacaagtgcagctatatttctgttttcaaaaatcagccttattgttatgttttgaactatacatttggaacagtctcttcagtggcttcatatggcgtgtgcatctcaattcatttctctacagattgccattgagacttggaaaaaccagattgcccatttgaaagctggttctgactcagcttgtcaagccagccatcctggtcagaatgtattggggaaaaaaatgaataaaagtaacagagacctggatttttattctgatcccacacttgattcatttgtgacccagggcaagtcacataaccttttatatatgattccttatttgttatgtggcataatatggttcatccctaccttacttatttgttgaataaacccttcatcctgtagaattcccccacattccaaactcactgatgcattcttatgctgtcatttaacgcgtccctcagttatctggacttgctgtgaactggggctagcactagaggattaattgattcaactttcttattttggtaagaatttttcataagtagtgttctgtacttcctcttgcattacattaggaagcatataaggctgaacttgattagcgaggttgcagttttgccaacctcatccatccattttaaagttccacatcagcccttcacttaatggttttttaagctactggtgatgattgcctgatacattattttattagggatttcaaaatggtgacatcttaattctgtcattccttctgtatttattaagtgtcattctctactcacctgctaggttactgtgaaatgcagttcatataggaaactcaagataaatgtctgaagtttattcttcttatttaccaatttcagaatgagttggtgccttaggattttgtaagatgaccagtagtgtcattatcagtgattttaacatatgtgatatgtttgaatattttagagtaattactgtttggatgttcagagtatctcacctttggccaataggagttcattcaagttgtctcttgtgttttttttttaacataaccccaaaactttggagatcttctggtacaacaggatgttcttagctcatcttctgtattgtctgccccatggctggaatcagtcatttctctaataaaccctggtttcttttactggaaaatggcatttagagaccacaatctgaccacaaggggagctcattgaagtgggtcagccgttgcttctaggctcacatcagccactttcaccatcggtagccctgctgtctgcttacctgacatgccagcagctaactcatcccctttgtctgtgttcactaagcagagaaagaccattggtaaatagtgaaatataagagaatatctttatgacctcagggtagggaacgtcctaaaatcataatagacttaattgatacatttgagtatatcaaaattataaatttctgtataccaaaagataaccataaacaaaatttcaaacaagctatagattaggagaaaacatttctaatacttatatgtcaaagtatcagtagcctaaatataatgaatttgtagacatcaacaaacaataacaacccaatagaaaaagggatataatatataaacagacaactacagaataggaatataggctgaataacatttgaaaagatgtgaaacctcacatataatcaagtatatgcaaatcaacaaattataagatgccatcttttcacccatcagattgaggaacattttctgtaacagatagcaaatgttggcaaatgtgtggttaaaaaaaaatgcatcactccgttaacataacacaactttggtgatgcttttgagacttcattttaatttttgaaaaagcaatcccttctgttccccatcattcccacctagcccccaatatcccccccacacacatacatacaaacacaaataaatagcatgtaaaggccaaatcgtttgctttctacattcttattaacaagtaagaacctttcactaccagtatactcaagttctgcaatatagctagttcatcttgagatctatatctgtgaaacaagaaattcagaatcagagctaaagatttttaaagtgtgatttttatatttttcctaggagaaaagggcattttttacaataaagtgacagttgtttaggataaattaataagaaaatgtaggcccttgttgggaagaattgttgatagatgggtgttttagaaaagccaaatggttagtcaaatgaccacagaaatgcctgtaggaaataaaatattaaaattctgaacactgtttgattatatgccttgtattagtttcctgttcctgctgtaaataaattcctacaaacctagtggcttaaagcaaaataattatcttatagttgagtaggttagaagtctgacacaggttttgcttggctaaagtcaaggtgtcagcagggctgtgttcctttctgggactctaagagagaattcatttcctggccttttttccacttctggagactacccgcattccttggcttgtggccccttcctcatctccaaaggcaggaagggtgggttgagtgctcctcacacccatcattctgacctgctgttttgcctcttaaggtgtcatgtgataacactggcccacttggataatttaggataatcttccttttttaaagttagcttattagcaacctcaattccaaccacagctttaatttcattttgccaagtaatgtaccagattggtgcaaaagtaattgcgacttttgtcgttacttttaatggcaaaaccacaattacttatgcaccaacctaataaaatatattcacaggtttcgagattagtaggtggacgccttcaggagaccattctgcccagtgaatgggatctgggccctccaaaaagagacatccttttctgggttatcattcatgcacctgaagcaacctcttttagctactgctttccatgccagttaccagggctcctgaacaaacaggaagtatttactcacacataaataatcagcatctatgtttttaacttggaatagaaaggttttttaaaaaaaattttcatcctttgtgtttatgagatgcttggatacttaattctgcacatccaagggatcacttggattttatgaagtcagtgcttaaagtgggatccagaatatgcaattttatcaggcccccattgtcctatgtgcagacatcagtggcttgccttgtttctattacatagagacattccagaattttttagcgagtttaacaaacatcatcaagaggaaagtggaggtagtgttccaatatgacatgcattaaaaattcttctctttctcacttatatttatagtctgatagaggatcaacagtataccaatttaatcttgctgcagagtgacatttttgaaaccattaaatttccagataatgtgcacatgtggaattcagcagcataagccagctgtgagtggggacccactatcactaatgtcacttgattcccatcttgcttgactatggattgtaccagtttcatatttcttgcactgtcaccggttccagcccctctggattcatactgctgtgatgtgagaaataaaactaaacaaaatattactaaggatgacagatactacatctattatttttatggctgacttatttcagtgtttaaaaatcttcggttggtttggggaatggcgttaggcgctcacgtgagctgtgggttactcccaagtggagggtgttgtttcaggagggatctatttgcaggtggatattggagggcagaatgcctcttatgtgcaggtcttgccacactgtgtgttcagaggagcccagctgaagacacggtggaactgatctgtatggggcactcctgctccaggcccagggactgatagaaaatgagagggaaaggaggaaacagagctcacaagtttttccttggtgggaacgatatctaagggacttagggaaggtgccccagccagatatataatgagagacagtgatgattaagtgcatttcaagatcgacccaaaggcttttttccagggctgttatattgtcatatgaataacattaaattcaagttataaatgaagttgttttaaaatatgtgtatatgtgtgtgtatatgtatttatattcctctttatcatttagaaaaaatcagaaataggctgggtgtggtggctcacacctgtaatcccagcactttgggaggcgaggcaggtggatcacgaggtcaggagatcgagaccatcctggccaacatggtgaaacccaaactctactaaaaaaaaaaaaaaaaatacaaaaattagccaggtgtggtggcatacgcctgtagtcccagctacttgggaggctgaggcaggagaatcgcttgaacctgggaggtggaggttgcagtgagccaagatcacaccaccgcactccagcctggcgacacagcaagactccgtctcaaaagaaaagaaaaagaaaaagaaaaattcagaaattaaaatatatatacctatgaagtggttaggtgttttcaacttccaaggtctttttctttcaacaacttgaaaagtggtagaccataggatcaagccatgaaatgtgagagtcgtcaccaagccctgagctagaaccttcaggatcattagacatgcatcagtcagtgtccgtctgtctgtctgtcatgcctctctcttatgcacaattatgtttatcatatattttttatgatcaggaagtaaggtattaagattaatcagacaagcagaataagaacaaacaaatgtttggtgagcgcctaccacatgccaggcactttctaacaggagatgttagaacagaagaggcataaagccctgtcctcacccagctggcacgtgatgtttgcccaggagcatagtaaaatacctgttggctaagaacaaaaacagtggcttccaagtacgtaaggataatgcttactaaccagagattcttttgaaattaaagagtaggaaaatgtttccttttgatccattgaacactctacagttagaaaactttaggtactcgtgccctctccagaaagcagcaggctcttttcttaattttttagttctgaaaataaaaattatttaacatataaggatattgggtgtattttttatctcacatgttggtttagcatatgattccttgaactttgttgccataaataacatcatcatgattcttttgtttattgtaatttaattatcatctcagagtcatgcaagacatttgtgtcatggttttgaggtgatcatagatacatgtaatttcaacttgttttaaaagaaagccaatcttttccaaatatttgattttcaacttgtaagtttgagaaagactaatttttattatatttgtataatatgactattatttgaacctcttcaacatgaagtacacatggttatatatatatgtgtgtatacacacatgtaccaagagatcctgacagttacttgctgaagagatccacacacctctttgcttcttttgctctggtgcaaattcatttgcagacacctttcctcaccagtgactcatcgtgtggtgttgttaccactaggtcatctgaaataaagttgtagcctaaagcgatatgtaaataaaacccatacccgtttctcaattggtgaggtaggaagatacatatccaagtccttctgtctggtttctttttagcctatcagcctttctaagagtccttcagtctgtcatttgatataaccccatggtgtaaagaggtgaactctacaacagaggcccaacaaagataaaaaccctgacttgtcttaaaaaaaactgtttttttgtgataaatgtatgtctgttaactagtgaatgaagaacagagagtggctgggtaggtagtgtgtgccatagtttgttgtctctagagtgggcttcttaagtgatgatacagttagcgatgttagaagaacactttcacctcagtcaacagctataaagtccaagctgggaactttatggacagtgtccagacataagcaaccataagtgtagctagtgatgccaatagattccagattcccaggatcattttatctcaacatgggaaaataatgccagatgtctaaagttctctagccatgtggccatggacagcttagcaccactgtgcctcagtttccttctctggaagatagggataataatggcagtttcctcattgggcttttgtaagagttaaacgaattaatgaacataaagtgcctggcatggctaatctgaagccctacataaatttttgtaattactattttcatgttgtatttctgtcaactgttgcagtgctggttcttttgaattggaataattaaatatcagaccactatgtttctttcttaaaattttacctttaaatgcaacaggatctgctaattcttacagatccatctttaatgtgacaacctcttattcattctggtttatttaagtggatcttgtaatttggtataatatatgcattgtttgactaaaccaataataatttcatcccttctttaataaaaaataaacacttattcttgttaccagctcctactgcagcccttaattaagtctaagcacacacgtaattgtagatgccaggaccaaagagccatttaccctttcattcttagtttatatgtgatttacctttccatgagttttgctatccctgtagtatttgaaaaacaccttttctgtggccaacagtgatctttggctcagtgctaataagcatttccccagtgacaatctgttgacataacctagcatggcagggtctatcacagagggtgggggtaatcaggctctggggaaccatggcctgtgaccttgaatggcaatagaccaggactgggaggagcatccatattgaatccactgatacccatggcaaacgggcccatccatcctgctcctctcccaattgccactcagtccagtttcagagcgggaaactggaggaggagtgatttcttcttccttccagccaggtggcaatttgttctcctagttggcagcaatttgtcctgcagctctcccataggacacattactgaagagttcattcttcaccatggtttctttatcggttgtgattcatacccatcataaacataataacttgccaagaggtttttcttccatttcccttatttccatttcatacttttaaacatttttactgtagaaaagaaatactcaggaaatagtagagtataataaccattcctttaatttgaattcagcgcgcatttctctcctgtcctacctttattctactttacagtttttgagctatgacagtttttctccctccaattatttttctaaacagtattgcaatgtttaataaactatttttagagcagtttttgtttcaccacataagtgagcagaaaatacggagttcccatatagttctaacacccccctgccaacacacacacacagtatcctcatttatcataatccgtgaggctctattgccacatcattatcaccaaaggctgtagttcacatcagggttcattcttcataatgcacctactatgggtttgacaactctataatgacaggcatccttcattatagtatcatataaataagatcacagcctagaacctcctctgtgctctgcctgtttatccctccctttccgttaacctttgacaatcactaatccttttactgtcttcatagtcttgcctcttccagagtgnnnnnnnnnnnnnnnnnnnnttcatagtcttgcctcttccagagtgttatgtagttggaataataaaatattaggtcagtgcaaaagcaattgcattttttgccattatgtagcctttcagattgacatctttcacttagtgacacacgtttaagtttcctccatgcctgttcatggcttcatagcttattcctttgtaacactgaacaatattccattgtctaaatgtaccacagtttagccattcacctattgaaggacagcttggtttcttccaaattgtcagttatggataaagctatatgaacatctctatggaggttttgtgtgagcataagttttcaaatcctttgggtaaatagcaaggagcataactgctggatcatatgggaagaatatgttaatgttgtaggaaactgacaaactgtttttcttttttttgagatggagtctcactctgtcacccagtgacagtgcagtggtacgatcttggctcactgcaatgtccgcctcccaggctcaagccattctcctgcctcagcctcctaagtagcaagtaccagagatggggtttcaccatgttggcaaggctggtctcaaactcctgacctcaaatgatccacccacttttgtgaagctccccacgaccctatattggactgaacaaaagaggacgaacgtgggaatagaagacaaagacaaaagagtatatttggaagaaggggtcagggggcaccttgcttctagtgaacaagggccctgagctgtacacagccttccatatttattaggcaaaagagatagcaaggaggggggtggtggttgtcaggtaattgtcagtcggccatttggttcacagcaggcttgtgagactgcattcctcgaacaatgggtactagatgtctcaggagataacttcaaggagtcccgcaccaggaagtgatggtcctcagcaaaccttttggcgacaggagcagtttgagtttgcccacatcctgcattcatgataaacagtttgctgtttgatcatatagcctccagtggaatgctgagctagtcacaatccctttgccggcacactacacaccttggcctcccagagtgctgggattacaggcgtaagccactgtgcctggcccaaactgtttttcaaagtggctatgtccttttgcattcctatcaacaatgaatgaggagtcttgttgctctatattcttaccagcagttggtgatgtcagtgttttttagattttggccttataacagatgtgtggtggtatcttgttgttctgatttgcattttccttataacatatggtgcagagcatctttttatatgctcgtttgctatgtgtacatctttggtgaggcatcaaggtctctggcccattttttaatcccattgtttgtgttcttattgttcagttttaagagttatttgaacattatggataccagttcattaccaggtatgtcttttacaaatattttctccaagtttatggcttctttcttgacagtgtctttcacagagcaggaatttttattggaaagatgtctatcttatcattttttttcatggattatccctttaatattttaactgaaaagtcattgccatatccaaggtcatctagattttctcctatgttatcttctaggagtttcatagttttgcattttacatttaggtctataatccattttgagttaatttttgtgaagggtgtaaggcctgtgtctagattcatttttctgcatgtggatgtctagttgttccaccaccatttgttgtccattgtagtacccttgcttctttgccagttgatcgtatttatgtaggtttctttctgttctctctcttctgtcctagtgatctgtttgtctcttatttcaccaataccacactgtcttgattactgtagctttatagtaagtctggaagtcaggtagtatcaatcttccaacttttttctaatcagtattgtgttggctattctgggtcttttgcctctccatatagaatcagtttgttattaaccctaaataagtttctaggattttgattaggattgcactgaatctatagatcaatttgggaagaattgacatgtggacaatattaaatctttcatttatttagttctttgatttctttcatcagaattttacagttttcctctatagtttttgtacgtatttgttagatttatgcctaattatttcacttttggagatgctaatgtaaatggtattacgtctttaatgtcaaattacagttgctcattgctggtatataggaaagtattgacttttgtatattaacctggtatcctgcaaccttgctacatttgcttattagtactaggagctaattttgttggttctttcagatttttttacacagacagtcatgtcatctgtgaacaaagagcgtttcattcattccttcttaacctgttgatattttcattttcttgtcttatggcattagctaactgagacttccaagaggatattgaaaagtattggtgagagaggacattctggccttgatcctggtatttgtgggaaagcttttatttttgcaacattaagtataatattagctatagcgttttagtagatcttttttttaatcaagttgaggggtgttcccctctattcctactttgctgaaaacatttatcaagactgggtattggattttgtcaactctttttctgcatgctattaatatgaccatctgacttttcttccatagcctgtcaatgtgatggattgcattttttgagtttcaaatgttgaaccagcctcccatacctgaaatatattctacttggccatggtgtataattatttttataaattgttggattcaatttgctatactctgttgaagatttttgcatctgttttcatgagaaattatggtttgcagttttctgtttctgtaatgtcttcagttttggtattagggaaatgctggccttttagaatgagctaggaagtattctctatttatgttctgggagacatggtagagaattggtatgattgccttaaatatttggtagaatttaacagtgaaaccatctgagcctggtacttcatgttttgaaaggttattaattattgactcaattttttaatagctataggcctagtgagattgtgtgtttcttcttgtgtgagttttggcagattacacctttcaaggaactggtctatttcaaccaggtcatcaaatttgtaggtatagagttgttcgtaatattctttattatccttttaatgtccatgggatctgtaataatgtcccctctttcatttctaatatgagtaatctgtgtcttcttttttttttttttttgtttagcctggctagaggtgtatcaattttactaatcttttcaaccagtttttagttttgttaatttttttctattgacttcttgtttctgtttcattgatttctgcactaatttttttttattttcttctaccttctttagatttaattttatcttcttattttagattccgtaggtgggagcttagattattggttttagatgtttctttttgtctaatatgtgcatccagtgctacaaatttcactctaagcacctcttttgctacataccacaaattttgataagttgtattttaattttcatttggttcaaaatattttttaaatttctcttgagattttcttttttgacctgtgttttacttaacatgcatcttttatcttccaagtattagggatttttccagccattttcatgttactgatttctaatttaattccattgtagtctaacagcagacaccgtatgatttctaatctttttaatttgttaagctgtgtttaatggctcatgatgcggtctatctggtgaatgtaccctgtgagcttgaatataatgtgtattctgctgctggtggatgaaggattcttaagatgtcagtaatatccagttgattgatggtgctcttgaattcaaccatgtccttactgattttctgcctgctgagctgtccattactgacagaggggttgaaatctccaactatagtagtggattcatctatttctccttgcagttctatcaccttttgcctcatatattttgacactatggtataggtgcatacacgttaaaaaattttatgtcttcttgaagaattgacccttttatccttatgtaatgcttttctttatccctggtaattgtttttgctctaaagtctgctctgtctgaatttaatacagcttattccagttttcctttgattagtgttagcatggtacatttttctccatctctttacttttaatctatgtgtctttatatttaaataagtttcttgtagatcatatgtagttgagttgtgtgttttaatctgataatctgccttttaattggtttattttttatttatttttttgagatggggtcttgctatgttgcccaggctggagtgaattggtgcaatcttggttcgctgcaacctctgcctcctgagttcaagcaatcctcccagctcagcctcccgagtatttgtgactatgggtgtgtgccactatgtctggttaatttttgtatttttggtagagacagggtttcaccatgttgcccagggtggtcttgaacccctgagctcaagcagtccacctgcctctgcttcccaaagtgctgagattataggtgtgagccacctagtgcatagcctaacgggtatatttagactactgacatttacatgattattgataacattggatatctttttttattactgttttctatttgttgctcttattctttctttgttcctgttcttttactgccttttttggttttaatggagcattttatattatcccattttgtcttctttattagtttaatgttttgttacttttttcagtggttgccctagagttcacatacgtttacagctagtccaagtctactttcaaataacactgtaccacttcacaggtagtgaaagttcttataatagcaaagtattccattttcctctcctgtcccttatcttattgctgttactcatttcacttgtctatagctataatcatcaaatactttgttgctgttattattttgaacaaacttctttctgctatatcaattaagaattttaaaaaatgttttattttacttttactaattccttctctcatgttcttcctttctctttgtagctccaagtttctgatctatcatttttcttctctctgaagaactttttaatattttgtagaaggcagatctgctggcaactgattccctcaatttttttttttttttttttttttttttttcctgagacagagtttcgctcttgttgcccaggctgcagtgcaatggcacgatctcagctcactgcaacctcaacctcccgggttcaagcgattctcctgcctcagccttctgagtagctgagattacaagcatgcgccaccatgcccggctaattgtatttttagtagagatggggtttcaccatgttggttaggctggtctcacactcctaacttcaagctatctgcccacctcggcctcccaaagtgctgggattacaggtgtgagccaccgcacctggcccagattccctcaatttgtatttgagaaagtctttgtttttccttcacttttgagggataaattcacaggacacagaattctaggttggtggctttttccttcaacataatgaatatttcacttcactttgttcttgtttgaatggtttctgaggagaagtgcaatgtaattcttatcctcactcctctgtaagtaacgtgttttccccccttggattttttttaagactttatctttgtctgcaatttgaatatgatattactaggtgtagattttttggcatttatcctgcttggtgttctttgagcttcctggatctgtggtttcataaaattagaaatcagtaatagaaaaataactggaaaaatccaaaatgtttggaagataaatgacatgctttaaacattagttttaggaaatagttattattgcttcaaatatttcttctgttcctttctcctccttcttgtattcccattacatgtaagttacaccttttgtagttgccccatggttttgggatatttctgacattttgtgtgtttttgtttttgtttttgtcttttttctcttttcagttttggaggtttttattgagataatcttcaagctcagagattcttttctcaaccatttccagtctgctaatgaactatcacaggcgttttcattctgttacaacgttttttgtctctagcgtttcttttttggctttcttagaatttccatctctctgcttacattacctatctgttcttgcatgctatctactttatcaattagacattagagctcatagcatactaatcgtggttgttttaaattcccactctgttaattccaacgcctctgccatatcagagtctggttttgttgtttgctctgtctcttcacactgttttgtgtgttttttttttttttttttttttttttttgcgaagctacacatggtgtattgagtaacaggaactgtggtaaataggcctttagtaacatggtgtaaggtgtggggggaggggaggcactctgtagtcatatgattaggtcttagtctatagtgaacctgtgcctctggactgtggacttcacaaatacttctcattattcctctcccccaccgttagttgggataggatggctaacgtgggatggagttgtatttcttcccccaggtcagttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggggcatcagtgtgcaggagctgagttactgttcccttccagctctccacaaccctttattgtcttacactgtcttcctccacttatattacttgcctggtcccagggagacattcatgtttatgacatctgctgaaagtaaaaaggtgtctaatgtgtagggttaatgcatgaaggcttgcagaagacattgagaactgggtttagaaggtggttcacagacatacagtatgtcctatggatatgagcttaatgttgtggtgtctgcctggacctctgtttgatttgagcatgctctcacagtctttacagggcttcttttgtgcttaaagatcagcaattaagtgatgagtgtgacatcactgaaattagtttatgcacgtggaggattagaagggagaaagaatttttccagtacaagcatagcttttattggcacatatatccctcccagccaaccacacaagaagcacagtacctgtcatttcctaacctttaggattagaggaattcaagcaagaaaaggcaaagaggaaagcctagtaaagttcacaatgcttctctttataggcagaacaaaaaagaatattgaggcaattactggcataaatcagtccaaagcaaatcaaagaaattcaagcaaaaagaaggcattttgcctgaattatggagctaatgatctcagtcctccacttcagtgttcctgaggagacatggcctgagaatgtttttccagtgatctggcagattcagaagtgaagagaaaatgtattattgtaagtgcagctatggagatggagtccagtgctgcctctgtccagaacatgtgttgagaacacccaggctcaactagcatggctagctgggaggagagaggctctagaagggatgatcatgatccccacggggcaagagaggggtggtgtcagtgcccagaggagtcatgctggctcatctttcaaaatctttgtagctttaacactgtcagagatgttataagtaattttcatttttctgtttaaaaatatgtctcttttctaacagcttttagcaataaaaaggcaacttattaatgaaacccttctgccttcaaagtatgaaattaaaatattattgtaactacaggcaagaaagcatttggattatgtgtcatttagaaatggtaataaagattatccgtatggtcttatgttgtcagtgccttacattgcattagcaatcacctaatatgagtgtgattttgattatgtggttcattttaaattctgtgtcctaggtcaatcagtgtcaagatgatttactagaaggaggtgcggttttctttcatagatgctgttaagtgcttgggcacaattagaatattttagggcatagtatatttggtattatcgtgctgtgggtgttcttaaaccttctcactgtataccttctccttaggcatctctaattctcatcttgtctgtcttgggtacacaaaacaatctctggtagcaagatctataaaaatttgtgttacctgtttatttatgttagtttccctttaggtcttctggcttttgtacaggtgtcagtcattttagatgttgagtttttgatggtcagtgagcaggatgcagaggccaggattaacctatgtctccaaaagaattagaaatctctctgcttttttttcattctcttccactgaaagagggaacaaagaagccttactcctgctgaacgttgcagggaacccagcgacatgacattttttaaccttctgctctgtaggggttgacaaaacttgatgggaactaatctgggttcatttgggatttgggacagggtcatagccttttgagaattcagtaccttccccttgatcctcctacagcctgagctctctgagctttgtaggttctgtgtcagtttctgctccctgtatgaacatactccaattatacgttcttgactcctcacctagttctgttctttagttttaacaatgtgccttttagattcatctgttatttcatttttgcttggaaaatatttactcaagggagtcttctctttgacactgtatatggtgatgttgacaataatttcgtaaaaacttagtaactctaggagtgtaacaattagattatgattgtgttgtactagaatcattggtcattttaatctagcttataataggagaaacagtgttttaggctgtggtgttttatctttctggttgtttggggttttttattttgttttgttttttgaggatagacagtacctgtttttcatctctgtgtctgcagcctggcagagtgcttgccacaaataaggcactatacatccatctctgaatgaataggattaattcagtagatgttattcctgaacatctgtcaatatacatgccaaagctctgtatcccgttcaaatgcatgcctacataattgaattctttatcctaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatgtaagtgcatatgtttcttggcttctaacacatctccttggttttgcaagattccaggtggtactaggggatttcaaaaaaaaaaaaaagcttcctgaagaaatttttatgccgtgttggtttcttcaatcattttcagtgatcctttgtgccacaggttgcttagcagagatgttctaaaggtgataggaccagatcagagagtccagaaaaccacagtgcagtttctgtaaagatttagagagcagtgacacgaggctttccttcttttaaggaagaaggcacctgcttctcatcatccttcttgttgtttagatcccatttgtaaactatccaggtgtggaattacacatgggaagcctgttataaaaacagttcactaaatggcagtaacaagttaattgtttatttgtttagatgacaggttctgcctttattatagggctgtcagtgtcaattaataaattaaactctatttcagcttcacaagtcttatgcttcataccaggtgtgtaaaccaacctcagctactgccttcccatactactacctgtgatccaggtagaaggcattattttaggaaactaacaattagattgattatatcaagcacaaaaggagtagttgctttgtccctggtaatctcggagaccagagggagatacctcgctctgtggtttagggcacactttggtgagttcaaggtcgggggtttctttactgtgtgaaatctgtgcctcaggcctgagctgcataaccaggattctggtcagcatggggatggaattaaagtgcagctattcctgttacaaaaaaataatcgtagtattttaaaggccggtgggccttgtggctgtgaggagcacagaaatggcatctggcgtggggcgactgggagcagtttggacggtgtgggctcatgtcctaatacccactgtggtcagtgtggtactgcagctcccctccactcctcctcttccagatcacagtgtggtcaatgcacgtgcctgtccctgagctttgcgtttctcgtacacgcggctgagctccgaattcagtcttacatttttctgcttgtagcggctgcagttgtcccacttcatcctcctccatcagtttgtactacacacacacatggcccagtggagcatgcacaggtgctgctttggcaccaatgggcagggcagcactgttgctttcatccttgatcttctttctttaccctttcctgtcattttcagtgcaggaaatagaagctatggggtctcagtgtacccaagctccttcccattttttcatagagttctctctgctttttttgtggcagatataatgtttttcatttaaaaatatgtatgtataatttatttaactgccataagaaagcaacctatgatgcattcgttgtgggctggaattggagaagcccttttggccacacacaggattagaatttttgtagtagcaggtattccttgaaggggaccacacagatacatcttcattttgcagtataacccattaacgttccaaatcttctatttcatggtgaaattcctcaagaatcaatttacttagaatcactcatcccaaaagcaagaatcttctttagtagttctaggtgtttgaagtttgaacaacaagaatattcacttctggacaggaagtttaatttggcagttacttttttgaaagtgaatgtatctgtggaaatccaaaaatgttcatgtacaaacggcagctgcagaggccaacggagcttccacaactgatcggctattagacgttattttttgccttccttcaataaagccaacagaaggaacacagcagtagactttccattttcctcccactctgagcaatgagttctcatcagatctcatctgataggagcgaccctagaggtagatatcataatactgtcttgatgtctttgaaataagacagcagtttctggggaggaaaccttcaggaaagatgttccttagaccacaaggctgccagcaccacacctatgacaagtgtgggtatgcatgagctctttcagggttgggagaaagtgctggaagttgtgaagtgagcagtttttagaaatgagacaaggggaaaaacgaaataggagaatttaaaaataagcatgaccacagttatgagaatggggattaatctctccagcaaagcaagtatgagttgcactatctgctttaatatgctataaaaaggggagaatagatacaggtagtgggaatgggtttagtttttatgctagaagatgaaaatatttttaaaatattttgacaggaaggtgaagataaacacagttattttatatctgctgtgcacatctttaccaaccacataaaaatgtctgcagctaataaaaaggctttattctcactgaccctggcatattttattggtactcatttttttcattcttattttcatccattgtgctctttttccaggcttcttaccataaacatgcgttgtaagtgtgatacatttctattttgtaaaaatacctgtaaatgacaggcagcctgagttctggtctttgttctgtcacgtactgattctacactttaaaaatataaacacaggtaaatgcactctcctaaacggactgctcctggagagttaaaatatattaatatgtcatcagaataattacccagtatgcacagggatttggtcatgcttcccataaatataatggtataattgtgtcttagtgtcctgatgaggaacttagcatcaaacagatcatgtaactacatcagaggagttacaatttagacttaagtttaaccaccttgagcaactttcaagtctttatactttaatgaaattaaactgttttaaaaacactaatcaattaatacatttgaagaggttttttttacttaaaaaaattattctatcaaggctctgtcatccatgaagagcgttttaaaatgtctcttaaaattaggaaatacccatttttaatgaaatcagataaattggatgggattgactatcctgcttgataaaagggaggaagagaaggtgcaataattcagtcttgagtgtttcagaggaatattttaaagaagagcatttttgtaaggatttaaaatactaaggaacacgcatggagcaccacctttgtttttcataaagcattgtggagtattctctgcatatccaaatatgagcaaggagaggatttagcaaactacgggaacattgacattgggaatcgtctccaaaagccatgtgtagacaccttcttctacttttacttgtaaaattcagcttggcctgagagcagatttctataagcaaagggcagaagtcaaaatagaagtctgatgaatttctctatccaaaatggtggctgtggttgtgggctttctctttatttgtggggtaagaaaagtctttaagtgacgaaaggttgcttgtcttctaaaggataagtaagtactcagaaacaactgggaatgatgatatttcccacatagacatcagtgagtcccggagtcaccgtgggtagcatggagtcaccatgggtggtctcagagcattgtgtgttcagagtgtattacctctctgctgcccctgaccagcctctcttttatttacagctgtgtcttcaccatcgtccttcacaatgaaaacaaatacactgagcacatcggtgcctaattcctattacccaggtaacagttttttccattgtctcctctctgctctctcctcagcagtcagaatcactccgccctctctctgctatccctggtgcttgaggggcttactgtgtttgagatgttgtaacccaatgcttttctacagctttctatgcagaaaataggggtgggcattcatcaatcatttactgttctttctctttttactttctctgcattgacctgcttacggtgtatgacagacccatttgtgccaactgcaattttaggtgagaacatttccctttaccacagtttattgcaggagtaatttagaaagtcagtgaccactctgtaggagattggagttttaattctgtataatgcagtgattataagcacgacatgtgggaggtgggtggcctgggtcatggggttaaaggaaaaagagacttttctctaaacagtcgccattaataagaggggtttgctgcatgtatcttggggatgataccaacaggttcaaatgaacaatctcagccccaatattctccctttctgtgttcagaatttaaagttaggtctgatcccaggggaaaaaaacaaggtgtcatcactcagctgtgtactttccaagagctgaattctgtctagtgtgatagtcataaaagtgaaaatagcttctcattattttcacttattgctaagcactaaaaacttcaattttaaaagtagcgtttttctaattatgccaaatgtcatgcagaaaaatgatcacaatggacttctggccctctacccatcctcggtgccactcagggcaccccacccccccaccaacattccaaagtgtctgtcacacagtggaatttcaaaggagctgatgatctgaacagcaaaatgacaagatggcacttataatcatatgctttattatgtgtcagatgtcactagaaatgaactaaggtgttagcccggtggggcagaatgcatttaaagtatgaaatattcccagcagggggttacagaaaaagtcccgtttgtccaatataagaagggtgaggagaaaaatggcattacctggctgtgataaccaaacaagcatgagctgctgttgcatttgagacgcataaataacctgagtgtatcacggctgtgttctctttctactactaacctttccgaaaaggagcacaacaaaaacgacttcaaggtatataacaattcattgtagcaagagttccaccctcagttgttcgacttctccttcctaattcacttgacaagggtttatatctttccaacatgatttttcccccctctgcttctcttttctctaagttgttacgatttttgtatagaaggtaatttttattttcctaatggtgttctgtgggcttaagcaagtttgttgcctaaggaaaaaatgaattaagatagaactttaagaatggatataaaacagagtttttaaattttgcatcattctgagggctaacaaagcccactaaaccctccctgcccacacacttttaataccaattaaaaggggaagaaaattgcattttattcttttcataagtgaggggcacaggctaatcttaggcaccagaacaatgtaatctacatacaaatgacatttgcagaatcttttgataggcgaagatttgcgatttcttcatgtgctgtggcattcattctgaggttcctctagtagattttctgaccttgggggagccgtgagtggggagggctaaaacgtgccttgtcagaaggaagaaaatgttcagatttcacagcagggttaagacaagcttattaaacaaatatcattctttaaagtcgctgctttgttattatgaacattaatgacatcttttaaagttgattagttttctttactgaaagggaatcacttggacagacaattcaagtagcaaaaatgatgcacattgtaaaaaataagtcacccagatagaccaataactgttatcatgtatggcttatataggtaccaaatggtagtacttgggaactgcattccttacacgttacttggtgcaaatgtgaatctatgtattgagtaacaaggattggtgaggttagcacttgaaaccacggaagaatttaagatatatatatctactctggcagttttgggggatagtagcagttataatttacacaaagacaacaagaaatgtcttgctgtgagtcagagctcagcacaattaaattctctggcaccttcagctccacctctctcatgctaagatgcccagccctaatgtatagagctggagtatatctttacttcatttgcttgcaaaaatgtagatgattaaatggatggttggatagctggatggatggatggatggatggatcgatagatagacagacagaacctaccctacctcaaatatattgcatccatttcaacttaaggtttttcagctagtttgttaaaaattcaagataattcataaagaatataagtagaactaattttcagttcttagaaaaccatcaaaactattagtgagaagctttgtttctttatttctaatgtgctcttctgcattatttttaattaaaaaaaatgttgaggccaggcactatatagtgcaagcatgtaatcccagcactttgggaggccaaggcaggaagatcgcttgaggccaggagttcaagaccagcctccgcaacataaggagacccccatctcttcaaataataataataataataaattagccaggcatggtggaacacacctgtattcccagctactcaagaggctgaggcaggaggattgctggagcccaggagtttggggctgcagtgagctatgatagagccactgccctccagcctggatgatggagaaagaccctgtctccaaaaaaaaaaaaagtagaaaaaaaaattgttgatgggtaatttttaaacacataaaggaaattaatgacaagtaatatattttatcaataataattcttttttaagttagagaagattaatcactaattttagtggaatcaagaatgtctagtagtataagtgacccaatttcatagcagcacacaagaagccttctattccctcttccatatgcatgtactagataatagggctcttctttcatggacttggtggtgtttaaatgcttgaagacgtgttccacactagtaatgagggcaagatggcataatgcagcacaggatgattacatacaacagtgacagttgatgtagctctatggatttaaaacttccaagaatacctagccctgggatcagagcattgctaggttgctggtgtatccacgtgaaggacccagatcacttctgggaagtttagaaggtcagcccaccatggagggcatgttaattatgttcatcccataagatacaaaactgagagaacgagagaggcacagaggggaaactaattaatgttccatttattttagtataaagaacagaacttcctgctggagtggctcaaagctcaagggattcggtacttcagcagggttcctgtatcccagtttataaagcttggcagttgccagcaagcaaatctgatgtgaaaatttccaggtttatttgtgactgttaaaatgggaacatgtgacttgctaaatttcaaagcaaatccaaatgaaacaaaaatcataaaatcaacttaccacccttttttattttgtctttgtgtctttagccacgttgtagtgatccaggtgccatttcagcaacagcaacatagctacacacttgtgtaccacctttcataccatgcatccccaggtgctttgcgatgcagatagaagtgaggttcccaaaccaggccctgctcatcaagcacccttggactaaattttcttcagagctgaacttctccgtaaaaaataaataacatatgaataactatagctgaattccctattgatatacaatctggtaatttttaaaacttgaatatatcttttatatgttttatataacattctcattttaagtgactttagcattatattttgacaacacccatcctcaatcataaaactgctaaagggattcagcattataatgagttaacctgtagaatgtggaattcttaatctaatagcatttccctgcataagacatttttaataggtaccatttctgcagttcattaacctaattttctagtaggcctccattaaaatagagcctctttaggcttctttgaccaaattttgacattaattttatagtacaatttggttgacttgttcaagaaatttaaatgagaaaatgtgttgaatacaaataagacttatttagacattacttggttcatgggggatgaaaagcaattatgatgctaattttaacctcctttttgttatggagtacttaaattcaatgcctccatcctaacgtgatggaagaattgaggcttcgccctctgaccacctctgaatagaaaacttaactggaaagttaaagcataaaataaaaactacctgtaattatgcacgcagtactattgcttatgccctgtttcctttttctcctccttttttctcctgatatgtatcttcttaaaagtgccaataaatggtaagttccccgattcgccccatggaagagttgtggagggagtgggagtgtgtgtcttactggtagattctgacaaagccagctggtgctgctctgtgctggcctgcatgtttgcctttgtagaacattccatgtgtgatgtgttggtccacaacattttgtcaagctttctgataccagagcatgcaaagtgattcatcaaaatgttatccccaaaccaggttcccttttatttttccattcttctttgatttcatgtattaagtccccatttccattgctagctttataagccacaccattttgtgcacttttattttgctcacagaacatttgtgcagagtttatttatgtcatcatacgaactactgaactaatgtttcaaagaatacaagactggttttgcaccaggtcttgatgaagtttcaggttgaaactttcacaaactttagcactggaaggctaaagggctcttctcaattagctttgtgaaagcaatatatcgtttggactgctttgtaaaagaaagatttctgcgcattcttatcagtattgccaaccccatttaaatttctaaacatttaacttttcttttttgctgagccatcgtagggaattttgcacccctaggtgaggggatgccaggagccagcttcttagcattctcagtgatgccgacctagctccctggctctccctcattttctccctggccttcttttcctagatgaaacccacacaatggccagcgataccagcagcctggtgcagtcccatacttacaagaagcgagagccggccgacgtgccctatcagactgggcagctccaccccgccatccgggtggcagacctccttcagcacatcacacagatgaagtgtgcggagggctacggcttcaaggaggaatacgaggtgagcacaagctctgtgccagggctttcccattccttcttggattccatgccaggtactgtgctcccaactcaatcagaaagccagagaaaaccccctgccccgagagatgccagaaagagatgaagtacagttgtccctcagtattctgggggattggttccaggaccccagtatatgtccaagtcccggtgtgagccctgtgaaacctgagaatccaaaaatccagtcctccagatccatgggttttgcatctcaaagatattatatatattcttttcaatcctcatttgattgaatctgcgggtgcagaatgctaggatatcaaggccgactgtattttatccgtggatccactttcatctgatagtaaaacttgttaccaagaagttcacatgcgttacatggaaaaaggaagaatgctttgccttttaccttattctgcacaaatacacaatgaaaacaaatttaccagggtctcttcccctccccatacctgttttttttcnnnnnnnnnnnnnnnnnnnnnnnnnnnnnnnnnnnnnnnnnnnnnnnnnnnnnaactgtccacttaaagcaattatagaccaaccagcaatgtcatgtggtggagatcagacagcagtacagggactggctattgtcatggcagtgacagctgttactgtccagccagcccagagagcatgccactgtcttgggctcttgtgtgggcagctgtcagggacatttctgggaataatgatattctccgaatacataaaatacagggcttacccctttcacaccctgtgccattagttaattctgtcagaaggtcattcaagaattgaagagaattaattgattgaagaaatctaattcaaagaagcatgccatcccttgagtgggtggtgtggggcccagggagcaggacaggaaagttggattgcttttttatgttattaaaatcagtccgcagtcattgatgaagttaaagtagcatgcttactcagagtaaaaataggattatgtagacatgtggtttttttaaaccttagaatgtggttctggtctcatattcacctaactagctcagagttgggaaacatcttgtctggaattagagtgtttttgaaatctgtttctaccacctggatagtctgtgagtttccaactctgtttcttctcttcctgtgggcacactcacaacacttcattttatgccccagacactgcattgtcttgggtttagctctttttccaagcttgatcatcagagattcattacagcagtcaaagcaacacatggtaccactgttggcggagcctgtgctacacttcttttaggaataaggctttggtccaaagcagacatagacacactttgctctgctaacatgtgcatcctggtgtattgccaatgacctcagttcagaagactgtgaagccaaacaatcccatccagaccgtgctccagggtttaattgaagtccagaaaatattttcagttgaagttctgccttttagcaaccctgaaattcttagatttatctttagcaattcaatgtgtaaattcagtgaaattgactgcctttgcatatttcctcatgcacttttaaagtctagcttaggaattaataggattaagagtaagacttccaaaagcttaatatcgtatgaaagacaaaattaggttattgaaaaaatataagcctaatgaatagggatgatgtctaggttctatccaatattctgaatgcagatattactgaaatgtttattaaagatgttaaagagattagttttaggctcaaataacaattcatgaaataacctgagcccaattttccatggactatttaaaaatacctacttcctataacatgctacagacaatgcatatttgaaagatgtagaaaatatttcccattcagatcttttgaataaatatgatttataagtataaactgaaatattatatactaatttgaaccatattatgactgacaactaattcagttctcaaaataaagtgttgtattcattaagtacattgcagaaaactttttctcattttagctattccgtggtcagagaggactgccaaaaagtgaatacttttaaaccctaaagccattgttcatttaaaaaaaaagaaggaaaggaaataatgaacaaaacacatatactagagatgatatcaggaacaaataggaaggagatattgggagaagtatgaaatgggcagttctgttaggaataatcccgtcactgagtaccgtgccccttgtgctgccctcctggagggatgctgatgttgtcgtctagtggggtagatgacagggaagtgaggagtggtgatggtgggcgggcatgcctgtgccatggccgcagggagaaggggacgccccctaagaagcgtgtgtcatggaatgacatgctctggtcttgatggaggcacagccaggcttctgggaactggtggtggagtgaaaggtcccagactgcaggtactcatatgtcccactttctctaaccccagggaggtgttattctcatgagaatctggcaaatccttaaacagttatttttttgaagtttatgtagtttttagacctctaataaaacagacctctttccatcatgctgtaaagtctgcatccttttcattaacacccacccagagtcaagagtgttgagtgctaactggtgtagtgggagtctctgtgctattcagtgaggccatcccacccaacagatactgagaggctgtggtttggaacacaggctctggcacccgactgcctgtattcaaactcagctctgcttcttagctgtgtgaccttcggcaagttatctaacctctctgggcctcagtttccaaatctataaatagaataattatagtctcaacctcaaaaggttgttgtgaggagtaaatcattttaatgtaggtgctagaattatatctggcatatagtaagtgttcatttgaagtgttaggtagtagaagaaaaaaaatactaatgtataataagaccaagagcagaagttgacaccatgttctttatagggaaacttcgttatactgaggtttcagtaaaactctcatctcttgcgcatagcagtctgaggatagagtgagccacatgttatggaaaggggttatacttttccttcatctccagggctggataactttcttaccatgtaccatatatcatcaaaaattcccgttaacaagtaacttacacataaataggtagacttgattctatggattaagagtttaagaactgagaaaataaattttaagaaatatatgctgtcatgttttattgctataatagtatttccatatctaagttggagagtcctaaggaatactataactctagactgcataatcctcctaaaaaattattggttgctgcattggtgtctttggcaaagtaggatttggggaagagtttaattttaccaatcatacactgtacatggcgccagggatacagagaggagaactgcttctccgctgtcccctggggaagctgacagggcaggagaaggcagccaggtaatgactgtagtttgtccagtcaaaccccacaccctctaagagagatgcgcaggcatactctgaaggccagtggggtcacctgagccagccaagagcaaggatgacttctctcttggaagatgagtgggagctgaccaagagaaggtgaaagagggtagccatccaggtagacccaaaagcaggagaatggggttctctgaggaaatggcaggagttctatatgcctgagtcccaggacgggctggtctgtgggatgagggtggtcagggctccaatcaccaaaagcacctcctgtgtcacactgagaggtttggacatcattatagaagtagtaaaagagaagaaagactcaaatagcctgagtctcattcctgtacttggatggagagctatttagtctgaacagctcaattttaaaatattatttgtatgaggcacacaggcaatgcttaaaaggtaataccccaaaaaagtaaaggagaaagggaatgtgtatttactttaaaagttcctgttgttctatctctattcaaaaatgccgtggaatgcttggcttcaagacttgttgaagcagtgaattacttcagtactgaagcatctttggggataaaatctaaagaatggctctggttgttgctgtgactctgtgtaatcatcccatcggcctttctggtcttcttcaatctgtatattatcaggaaaagccagtcatttatgttgtaaaatttttttgaagtagtgatgttctctttgctgaacaggtttcaaccaattcttctttatcgttttcaagacagcagtgtctcaaaattggcctaaacaccagaaggattcattactgatcaagtagccgacagaagtatgtccgaacaagagcataccatgtggtggggatgagatggagcagagctcagtgcaggttttttatttgattttgttctaacaaggtagtcatatggcacctctcaccagggagatgcaataatttgattcaaaagaaactcagacatgaatcacaataaagaagtaaacatgctgaattgaacagaaaatggcatgttgtcaacagagagtggtgcagggacctctccaggagaggagaaagagcagaaagggcaagtttgtttatgttgctgtgagagaagagctgcctggttcctctgacaagcaaagggcagtctgtgctaagcctctggggggaacctttgggcttcccagaaaagtagaagagagagcgcttcactcacgagggacagacaggtcagactcagccaccctgccccacgcagacttctgggcctttctcagctagagttgaacagggacatttgccatgactgcagctctgccctgaaccctcacacccagccctagacaagggtgtgttgcaccccttgtaagtggcttgataccacgtcaggtccaacgttgtggtgatcctgtgcgagtggagagtgagttcctccccttttgcagtccccaaaggaccttgttgatggctcgattattttttttatgcctcaatttttgaactgattctaagtccctttggggatccaagcagaaagacaaccttaagtaggaaaacagccaaattattctgaaagaatatgttttgctataactgtaaaattaagataaagaaaggatgtcagttgaaggctacttccagagaggatgtcctgaaaaacacagatggtactattttattagctaatagtgtcactctggggcacaaaaaaatgatttccaattactagagctgaaacgtatcaaagactgaagtaactctttgcatcctattcttcaaaaaaaaaaaagtgtgtgtgtacatgtatgtatctaaatatattaagaaaagcattatctttattccacgtactttttttgtttttgtttgttttgtttttgagacagtgtcttgctctgtcacccaggctggagtgcagttgcacaatctcagctcactgcaacctctacctctggattaaagcgatactcaagcctcagcctcctgaaagctggaactacaggcttgcacgaccatgcccggctcatttttgtatttttagtagagatggattttcgccatgttacccaggctggtctcaaactcctgacctcaagtaatctgcctgcctcagcctcccaaaatactaggattataggcatgagctgctgtgctcggccccacctacttttcttatattatgcctctctcctgggcacaaacactgttaattaattttatagttgaatgtgaagattgttttttagctcagtttaaactggggaattgaaaacattatgccagaatcttcagaattaggtacagcctataaagttttctgaggaacctgaattttctttaaacacgtctgtctccttgtagctccttttaggtcttttttaaacatatgagttgtatatccccccacctcttatccttcccccgttttctaagtaaaacagctgactttgttaaatgcaagttcagtgttttatttgctgcctttgtctatatttgacaaagctgtggcaacttaagaaaaaattattattaaaatgtctcacctgcactctaaaatcttgcttttttttttgtgacttagtctcactctgtggcccacccaggctggagtgcagtggtgccatctcagttcactgcaaccttcgcctcctgggttcaagtgattttcccaacccagcctcccaagtagctggagctacaggcacacgccaccactcctggctcatgttgtatttttagtagagtttttcaccatgttggccaggctggtctcgaactcctgacctcaggtatctgcccatcttggcctcccaaagtgttgggattacaggtgtgagccaccctgtctggccccagatctccctcttatttacttgcctcctacctcagtgaagccagctgttcttgtctgtttaatgtggctacaacagaatacctggggctcggtcatttgtaaagaaaaaaggttctgcaagctgggaaggagagaagcatggcactgccttctggtgagggccatgtgctaagtcaaaggggaagtggacacgagcagtgagagaggaccaaacagaaggagaattgcttttttcattttttttaagagacactctgttgcccaggctggagtgtagtggtgtaatcatagcttactacagccttgacctcctcagctcaagaaatcatcccactcagcctcctgagtagctgggactacaggcacgcaccaccaagcccagctaacttttttaattttttgtagagacagagtctcactatgttgctgaggctcgtcttgaactcctggactcaagtgatcctcccacctcagccccacaaagtgctggagctacaggcatgaaccacctcctggaattgctctgtaacaacctgctcttgtggtaactaagccagttttgccagagcatgactcactcattagcatgaggatggcaccaacccattcatgagggatctactcccctgatccaaacacctcccactaggccccatctcccaacactgccacaccagggaccagatttcaacatgagttttgatggggacaggcaacccatattcaaaccatagcaccagcatatcctacaaaaagcactcccagaaagccacctgctctctgcagagatcgcagttctgactccctcccttcagatgcccttccatgggaaaggccttgaactggggaggacagcccctggaattttgagaccagcccagcagcagggcgcgggaggaaggcgccccgggcatctgggctcccccttgttgggagttggttggcagagggagaattgcacacacttctagacgacttttcagaatggtgcacagcagccccttcgctggcttttgcacaaagaagcaggggcaggtggaatcaaaggcgctttgtgttactcagctgacagaacattgcctgtgcacagctggttcatagattctgtgtgcagtccagagggagaggcgccccttccctcacctccagcccacacacttttcagatgtgcttttcagttcctgcttcatatttcgagggaccagctgagtcaatcaattggcacaatcagtgcaggttgttttctgtcccataggatacaaaacaaacaaaacaaaaccaaaccattgaaggctaaggatggggagctgggggtggggaggcactggcaggcactgtaaatgcattaagaatcacacggctgtgtctccaatggctgaagcagccaagtgatttttgacgctcttttttcctttaattattatggtgctggtgagccaggtccataagaaaatgataaacacttctagaactctgaaattttgagatggcttcaagctatttgggcaagtaaggtgtatgtgtttatgggtactttcttagtgggtgaaagtttctgcgtatttttaaataatgcaatagagagttggttttgacatgaatatttggtttatttttttttctgaagtaccagtagaaaagtgtgttttatgtgttgcctgcttcactcagtccgcctgctttcggggcctctttcacatcagctaattttttatacagttttcgtttgcccttgcctctgatgacatcatatacaagctcagacttcagaaaattagattaaaaattgttatttcctacaactctccatgctcccgctgatgataattcatggcagttgatgttttcctatttgtgtgaagcacttctaggcaactgtctggtttccattttgaagctggttattagaattttctgtatctaacctgaaagaagttaagcaattttcccacttgttaacatgcttttagtgtcagatgccattagccacaagtgccttcttggaggacctggcccagaaaggatagtgaacgtgcccgtgtgccagcatctgcggaccttatgtgtgtctggtactggtcctcctgcttttgattagtttgatgctgtcaccgcccactaacatggtcaaactagatatttcacggttgccattgcccctgccgctccctcatttccacaccagcaggctcaagtcccaactgctctctctcctccccattttcagtggctgccctctctcccctcccctagggcctgccctgatcacttgtctgtgccatcggaagagtcccctgacttgtcttcctacctagtctttccccttcaaatctgttccagactctgcaaccagttttctttgtaagacatggatgttatcatgtttgactgatgctgaaaactatgccacggattctttccaaaaataagaacctcagcatagcacattcagccctctgtgtcaagacctcactctgtgtttcagactttcgttgtaatgcaggtgcttcccaccgtgcaggctgtgctctgcttctgctcatgtactcgccaccctgccatcctccaggcctccagggctcatgctgcaggttgtggcctctgcctggccgtgacttcagctcctccttcacttgccaaatccctttggacacagctcagatgtgactgccccccaagctgtccctgatcccaaccagaaacaaccattccccctacagtctcacagctctgtgtttgaataatatagtaggcaatatattaactgataatacagtaggcagtatattaactgataatatagtaggcaatatattaattgatttattcagtacgtatttgacaaacaatactgaatatgtgctgaattgatttctatgtagttacaccttgtaattcatatttgatgaattgatttctgcatatttaaacacatacacctgttcctggggaaatgatagagatggatatagaactattaaaaaatacaagctcagaatgttacaaatcatcatataggatcgggtgggctaggggtatccagtcagaaaaactgtatggaccaacttgaacctgatcaatactgatcacctaaaaatggaaagcatagatatgttccatttggtcattttacttattgaaagccaacctgtttaaaaatttgaggatagacttttttttttcaaggtggagtctcactctgctgcccaggctggaatgcagtggtacagtctgggttcactgcaacctccatctgccgggttcaagagattctcccacctcagcctcccgagtagctgggactacaggcaagcaccaccacacccggctaatttttgtatttttagtagagacagggtttcaccatgttggccaggctggtctcgaactcctgacctcaagtgatccacctgcctagggctcccaaagtgctaggataacaggtgtgagccaccactcccagctgaggatgaacatttttaatacatgtttgctttacatttcttatttaaccttgtggcaggaatgaaatatatttggtctttgtgcctggttcctgacactgagctcttaaaacccttgggattttatgagtgataagagcatcttttactaaaatctaacttgatgctaatgttgacttagagtggagcccttagctagcctcaggatggggtgggtctccagaaaaacctaatgattagagagttggaactttttcagccccacacaccaacctccagcgaagaggggtagaggcagctagagatcacactctctaaaaactcgaacaagctgtgatgagcttctgggctgctgaatatatacatggaggtgctgggtggtggcacatccacagagggcatggaagcttggcgtcctggccccatacccagtcctacgcacctgttcgtgtggttgcttgcctgtatcctttataataaaccagtaaatgtgtgttccctgagttctgtgagctgctctagtgaataaattaaacctaaggaggatgtcataggaaccttgattgatagtatagatgacagcctactactggggactggcatctgaagcggggggttgccatcttgtgggactgaggcctcagcctatgggatctgactccaggtagaaagtgtcagagtggaagcgaatgagaggaaacagagttgatgtccactggagagttgtttggtgtggaaaaatcctgcacgtctgatgacagcagtgttctgtgctgggctgaatgtgtgagaggagaaaaagcactttggcttttcctatctcttaccaaccgctaatagaagcaatgtagaattatttacatgagactgtagtgcatttcataacatgactattccaacaaagaaactctatatcatcatagacagtttcacagctcataaaggcatttcagaggcaagtgaggctttgaggggtggactttccataagtcttgcttggctgctagaactttcatgatgttgagggtacctgcccttgtactaacacctactatatcggcactgtacaaagaacacaccaggccgggcgtggtggctcactcctgtaatcccagcactttgggaggccgaggcgggcagatcatgaggtcaggagatcgagaccatcctggccaacacagcgaaacgctgtctctactaaaatacaaaaaattagctgggcgtggtggtgcgcacctgtagtcccagctactcgggaggctgaggcaggggaatcacttgaacccagcaggtggaggttgcagtgagcagagatccgagattgcaccactgcactcctgcgtggtgacagagcaagactccatctcaaaaaaaaaaaaaaaaaaagagtacacacctacacacacagcacacacagagatgtttatttctaaccacaatgctattacattactatcaaacccattttccagatgagaaaatgagtcagaatttaagtaactcgccccaggctgtcctgtctagagttgcaggcaggctggagcaacacaaagcctgtgttctttctactgaagcacatgacttctgtatgaaactccatgaagacacagacctatggaaataaccttgtgttttattgatgtgacttgtgatttcaaggcaggaatgttagttttcctctctgctgttgtgtttgctttgaacagcgatttgttctttggcagaggacccatccagcctggggccccgttgacagcgccaattctgctgtgtttcagcagctcagcagcagcagatgctgtccattaatctcactcagggtctcagctctgtgacatgaggtccctgcaacattgctcctccctgctctagtttctcattgtctgaggaatgcaggaaaatcattctgaagatatccgccatcctggctcatctgacatgaccagttctaggctaaaaccaagctacagctcttgagagccgtagattccatgtgctgctctcctgggttattgcgtggctgccaaccaaccttgcagcaggaagaagggagaagagaagaagaagacaagtttgtaagcctgagttgggcatgaaagcccaaggttttctaaaaaatcttctctggaagttgatgaatcttttttcaatggaatgatacaaaataactgacaatcttattaacctcatggcagagccaagaaaacaccttatgctttgattaaatgatacaaaaaataaccagttgaaaagtcaattttttttcaaataacagtgctgtgttatagaaaggacagtggattaggaatcagaaggcaaatgtgggtcatggttcctctctgcgaactctctaacactggaacattgaggaaatcacggaacttccatgaaggaacttccatcagttgtgacagcaactactcacaaaatgtctctgatattagcagtagtacggtctccttagagatgctggatttccagtttcatgggcgtattctcatggatggaatgtttttcagtgggcgacactaactggctgttggagatctgtgtggggacatggccatcacgtatgatccacaggcacttctctggttctctgtggctggttctgattttattccaagtttctgaatgaggtggtttctatcccgatgtgcccttcctatcttttcttcctcttgtctcccctcatttcagcctcttccgaatctcacttctaacccacaccccatctccaaaacactgggaagtctgcattgagatgataaggttatagtattagcacacttttgtatcaagttctcacagtgtctgaaatgtggttatgattccatgatgtctctaatccctactcacccagttcttaagaatcatgggcaaccccgcttgggtccccttccacgctgtggaagctttgttctttcgctcttcactgtaaaccttgctaccactcaaaaaaaaaaaaaaaaagaatcgtgaatgataaggaaataatgtggactaaatgttttgaattacttaatgtttgacattttacagtgtataaattcgtattattgtcacatgtatcattcagaacacagtaatattgaattagagcccatgtttttgaccagtcatgtcacggaaaagaaagggaatatgctgacttttccaatttctattgtctcttctgaaataaagtacttttatgtccatgattgaaatataatcaaattggctggatgccacggctcatgcctataatctcagcactttgggaggctgaggtgggcagatcacaaggtgaggagtttgagaccagcctggccaatatggtgaaaccccacctctactaaaaatagcaaaataagccaggtgtggtggcaggtacctgtagtcccagctacttgggaggctgaggcaggagaattgcttgaacccaggaggcggaggttgcagtgagccgagatcataccactgcactccagcctgggcaacagagtgaaactctgtctcaaaaacaaaaaaaaaagaattcacccatattattcattatgctatagattttaaaaacttcttcactccctttatcttctattatcgccctttagggagacatggaaaaccttttatctgtttacttcagggaaactatatgagatactgaataattgtaatgtattcagtgttaattataaatacgcagcgtatgtttttatatgtattgtatttatgtgctttaggtaattatgcatgtgagttccttgccaattttatggccaaaatattttacttggctgattactaagtatattttaagcttacttcttgaaacatgaagagaatatactataaatccaattaacataatttatctgcctaaagagaatggttgcttttattttttttctccattttaatgatgaaaaatagttgtaagagtatggagtatttaatttgtttttaaagctttccaggcccaattttgttgttttcttttaagagaaaaatataattttaaaaagaaatttggaaattttaaagaaagcattaaaaaaatcacctataactcactatcaattttcaataattttctgcctaatattttaaggcattacaatcttaacacaaagagtttcatatcttatttttacacttaatattatatcccaaatgtttcctttatcttttctatgaacactgctataaataactcttaagatttacctccattcctttctaaagatgtatttcaagagatgaaattactagttcgaagtatataaaatgcttaagattcattacatactcctgttttgacaacctgttttcatgaaggttgcataagctcacattcgcatcagcactctgtaagaatggttacttcagttcctcactaaaatggctattaaacttttaaaagatctttgccaatttgatgagtgaaaaaagattatttccttattgttccatttgaagctatacatgtcttcatatgtttactgaccaggtgaaaattttcttttgtgaattgttcgtatcctttgcatctttacccactagagtattattatttgtctcctactaatgtgtctaagctcttttattgcctacctttcctttcttctgtagaaacatgttgttaattctcagtatttgtgtttccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctagaaaacgtacaacttattcatgaagaaatagaaaattcaaatatagcaatagcaaggagattcaatcactaatcaaaaatctcccacaaagaaaagttcatgtccagatggctttactggtgaattgctaccaaacatttaaagaagaattaaggctagtatttctcagatgcttccaaaaaagttgaagatgagaaaacagttccaaactcattttacaaggccgatattaccctgatgccaaagccagataaggaccctatgagaaaaaggattaaccaatatccccagtgaatgtagatccaaaaattacccacaaaacactagcaagccaaattcaacagcacattaaaaggatcatacaccataatcaaatgggatttatccctggggtgcaaggatggttcaacatatgcaaatcaataaatatgataccccacattaagagaatgaagcatataaattatatgatcacctcaatatatgtagaaaaggcatttctcaaaattcaaagtcctttcatgataaaaactctcaacaaattgtgtatagaaggaatatacctcagcatatatgaaaggccgtatataaagtttccagctaacatactcaacaaagaaaagctgaaagcttttcttctaacaagacaaaggtgcccactctcaccagttctgttcaacatagtactagaaatccaagccagagcaattaggcaagaacaagacattaaaggcatccaaattggaaaggaagaagcaaaattgtctctgtttatatgtaacatgatcttatatatagaaatacctcagagactccaccagaaactgttataactaataaattaatcagtaaaacaaaataaacatacaaaaatcagttttacttctatacacaaactatttgaaaatgaagaggaaaaatcatatttataatagcatcaaaaagaataaaaatacttagaataaatttaaccatggatgtgaaagatctatacactggaaactagaaaacatttataaaagaaattgaagatacaaataagtggaaagaaatacccatgttcatggattggaaggcttaatattgttaaaatgcccatattacccaaactgaccaataaattcagtgcaatctccattgaaattccaatggcattttttaacaaataggaaaaaaaattctaaaatttgtatggaactacaaaggaccccaaatagccaaagcaatcttaagaaagaataaaactataggcattagactccctgatttcaaactttattgcaagctacagtaatcaaattagtatgatcctagcataaaaacagacacagagaccaatggaacagaattaggagcccagaaataaactcatgcatatatgatcaactaatattttacaagagtgccaagaatacacgatggggaaaggataatctcttcaataaatggtgttggggaaactagatatgcacatgcaaaagaatgaaattgggttgctctcttatactcacaaaacttaacttgaaattcttcaaagacttaaacatgagacccgagacagtaaaactcttagaagaaaacctagggaaataccccctgacattggtcttggcaatgtttttttctttgtttgtttgttttcttaggacccactacaaagcagtcaatgacattttcgatatgaaacaaagacataagcaacaaaaccaaaagtagcaagtaggtttatatcaaagtacaaaacttctgtacagcaaaggaaacaatcaacaaagagaaaaagcaacctacagaatgagagcatatatttgaagaccgtatatctgataagagggttaatattcaagatatataagaaattcatacaactcaatagcaaaaaaaaaaaaatccttaagaatgagcaaataacctgatacatttttccaaggaagatatacaaatggtcaataggtataataaaaggtgattaacatcactaatcatcaaggaaatgcaaatcaaaaccacaatgagatatcacctcacacctttcagaatgacaaatcaacctaagtgttggcaaggatgtggaggaaaaggaactcttctgcattgttggtgagaatgtaattttttaccaccattatggaaaacagtgtggagattccacaaaaggttaaaaatagaagcatcttaaagagacatctggactccaatgctcattacagcattattcacaataaccaagacatggaaacaacctaaatgtttatcaatagatgaatggatgaagaaattatggtgcatatatgcaatggaatattattcagccacaaaaaaagaagtctaccctgccatttgcagcaacatgaatgaaccttgaggacgttatgcaaaatgaaatacgtcagagaaagataaacactgtatggttttacttacatgtggaatctaaaaaagtcatagaaacagagtagaacgatgattgccaggggatgggggttagaggaaatggagatgttggtcaaaaggtacaaactttagttattagatgaagaagttccgggaaactaatgtacagcatggtacagcatggtgactgtagttaattatacttattacatacttgaaatttgctgagacttaagtagatcttaaatgttctcaccacacacacaaaagtaactaaattaggttataagatgtgttaactaacttgactgtggtaatcatttcacaatatatatgttacatgaaatattttaaaaacataggttgacaagtacccttaatagattgtcagttatgattaggttaaggaaattccctttaatccctggtttatttatattatttaccatggatagatactggatttgataggatcctttttagcattttttgagatacaaaataattatttgatttctcttctttggtatgttaacatagaaagttaatataacatatatgtgatttatataattaatattattattatataccaaaaagccaacccttcatccttgggataaacctaacttggtcatgatatatattaaacattgctgagtgctgttaactgatcatttttcattcatgttcataggcgagtctaatctgttagttatccttattatattttcatattgtgattttagaattaaaataatatctgctttttaaaatgagtggaatcacattctgtatttttttattctcttaaaattatttttcccttaagtgtttaaaagtcacctgtaaaactggctagatctggcaatttccccatgctaaaattttagattactaatttttttcagtagttaataggtctgttacagatttctcatttttcttgagttaattttgatagttaatattttcatatgaatttctacattttatcttttttatttagaggcatacatttcttaatatattcttatctttttaatttgtttctactcatgtttctttatccctttttcataattatatagtttatttatgccttcttttttcctttagcattcctgccagacgtttgtcagttttattaatcttttcaaagaaataacttttgttggctgagcgcagtggctcacgcctgtaatcccagcactctgggaggccgaggcaggcggatcacctgaggtcaggagattgagaccatcctggttaacatggtgaaaccccatctctactaaaaatacaaaaaattagctgggcgtggtggtgggcgcctgtaatcccagctactcgggagaggagaatcgcttgaacctgggaggtggaggttgcagtgagccaagattgtgccactgcactccaagcctgggtgacagagcaagactctgcctcaataaaaaaaaaaaaaaagaaagaaagaaagaaaaaagaaaaagaaatagcttttgtgtttgttgatctttaatattacattttttaaaaatttcttttaatactgttctttattaatttccttctactttctttgagtttattcttttcttatttttaaatgaggtgctaaacacattaacttgccctctttttttcaaatataaacattgatttgagagtattgatttttcctctaagtattgattttcctctaagtaacacttgccctgcatccagtaagtttgacagtatttctattatcattgactattaaatatttttagtttttaatatgaattatttgacccatgaattatttagaagcatgtgagtttatgagtgtatattttagttctcagtgcatggaagatttttatctttttattaatgatttccaagttgattgcattatatacaatcagaacattcattgcaatttgtgaacattagttagagccttatacataatgttttcttaaatattttatgtattcttaaaaacaatgttgagcacagtgttttatatattttttagatcaagcttttgttcacattttctgtatacttaatttttgtctatttaatctatcagttactgaaagaagtgtgttgaaagaggtaatatattttggagctaagttataaggaaaatacaagtttagaattgctatcttttaaagtgaatttaacattttatcattaagcactgatagaattatctttagtaatgtttttctttacagtttattttgtctaatttcaatataactttgccagtttccttctaattagtattttttctagaatatattttcaacccctctattttagtggtgtctcataaataacatatagctagattttagtatttcaatcaagtctcacagcttttacctttaaattctaccatgttaccacttagtacatttttagtttattgtggttcatgatagatttgaatgcatttctatcaccttattttgtaagagatgtttcttccatttgttcttaggcttctcccccaccctaccttttcttccctatataggaagttcatgtaaaatggagtgaatatctgtaatttactttgattctatagatctctctagtcttgatctttatgtgagcccctgactgctggctcattttccctctatgaattgcagtggttctgaaagatgggattatatgttccataccctctgctcagttacctctcctttgctactgccctgggctcatcattcatcttctcttttgtcactgacccaaagcctagacttcagccaggtccatgcatcttcctccacagctcctgttccttcttgttttcattgcattgctgaaccttcagagctttgtctaaaagctctaatttttaaacaagatcctcccagtaaaaacatattctcaggcatcagaggttgtggggattcagcagtatggtaggaatcattggtatatatgggtcttttataagttacatttgcaattcaagactgacagtatttagaaacaatacgacttgtcctgtaagtctgatgagcagaaaggaggagaaaatggagctcgccaaacaattcagaactgatggaaaagcagtttgctcaaaagccccatatggtttgcccattttcctctgccctttggaaattcctctaaacattagttctgactgtcagcatgcagtccagtaacatttttttttcaatcccccagctcctctgcaatggggaggcaactgacctactccagtgtgcttgaaaccattgtcactgtactcaagagcaccaggtagcactagtacttctcccaatagatggagcattaagctcaccagtgttgctcactgtcatgctgtttcgtgctttgttggtggggactaaatcttgtatagagttttcagcggtttatgctttgtttagggtcttgatatccaatttccatgttggacttcttgtttatagtttggcacagagctcattaatgttgaccccttagccattttaaagaacctcagatacgctgcagaacgtggaatttgatctatttttcactaaataaaatttttaaatttatgtgtttgagtactagctatgactactgcattggtcagataattttaatgcttttttaaaaatctgccaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatttttatcctaacagcagttgatgttattgaccatcaactgtgggctgggcactgagctaaccatttccatgtgtgatctcatttaagcatcagcacagccctcctcccagcagacatgaggaaactaattcttagagagctccatctcatatctgtgtcaccacgctcatgagaggtactgcaatctgaaccacaggacagctgactctggggctcatgccgttctacaacaaaaaaatacaatctccatcctcatcttccctatgctttgggtctgtgagacctgtgagactttgggtctgtgagacctgaagtgttggaggacaggttggagcaggtcttctatgtacatcagataccagaatgcaacctgacaactttctcctaattgtgaatgacagaaaaaaaggatgatttgtagagatttgccaaaactgtaattttttttttttttgagacagtctcactctgttgcccaggctggagttcagtgacgcagagtttcactgcaacctcccctgcctgggttcaattgattctcctgcctcagccccctgagtagctgggactacgggcacctaccaccatgcctggctaatttttctatttttagtagagatggggttttaccatgttggcaaggctggtctcgaactcctggcctcaagtgagccacccatcttggcctcccaaagtgctcctaaactgtaatcttttttatttttattttttcccaatatagaaacagtagaaatgttggaaattgaggttattgatggtgcaactatatgatgttgatgttaggattttcatcatgtaaagtggcttagttttatttgtgttgtttgtataactttgactagttgaagtcagacttacctagtgttgaaagtgagacttgagcacaaatttgcttgagttagcactggagaggcactgcaggaggcagccaaaggacagcaaagtgtatttttcttttgcgtgtaaatgttgtaatactgttttgcaataagtgaaatatgtgtgatcacataaaggagcagtggagaagagatactgaaattctttgtcaatggttgatatatagaaatagacatacttccaaaagttaatattacagttatataaacttctataatctaactgattagaaatcttacagagtagaaatgaagcttgaaaatgagcaagatttttctaaagtttgttttctgtgcctgtgtgtttccgtgtgtttcacattctcatggcatggtcaactggaaggtattccattggttatcatagctatgctactaggagagctatactttaaaaatattttctgttaactaacgcagtgaggtgcctttgaagacttgagatagccatgatttaaatggaaaagccaatatgttgtgcgtatctgtaagtacacatgagtagggagagaagtgggctagaagaaaaaaattaactatggaaaaacataagcatatccacaaagtaggattttggtttctcaatctataatattatttcatttccagattgtgaacaggtggcacacactgtttctttagctcttttgtggccaaccacacatagctatttctccatacctactcatatgtcacctaagaaactacctaaattgatctcaaatggatctaatgagaaagacatgcctggcatctttgtaaaaataatatctatacagcaggcaaagttgctttaaagtgtttatttggggagcaatgcaaagtattaaagcatctgttgtctctgcagctgaacttttctaatatttttacaacagctaatttaacctgagtgcacaattccaaagaaggaagttgtaggataaaaaggtagagctgaaatgtacataaatctttagtgtccttgtagatctgatacactgccgtactttcctaagcttatgcaaaacagaaagtgaagaggcattttgcagaaaactaaattatacatgaagtcattaaacctcacccttcacttctgattgagggattgctgcagtcgtcagtgaaagcagaggcaaaatgaaaaaataaataaatgaaagacctgatcacattatacatttcagtggaaatgtaattgcttagaagttcgtttgaagttattgggtatgtgcaaaattgcatgtagctgctgaaaataagaaacgggtcatggcacagagcatccttgtgaacccagaatctatctctcacatgtgtggggtacagagggcaagagggagggtcgccttggatgctctgctacaagtctgcgtatcccaatcagccccaaactctcctgttcattgaaatgtttacttgttgtcttgacttgtttttccacccagagatgtatttatgcacataacacacactgtttacttctttttccaaaggagttttgtaactgcctctttgaaagcatgtctcaagagggggagggatagcattaggagaaatacctaatgtaaatgacgggttaatgggtgcagcacaccaacatggcacatgtatacatatgtaacaaagctgcacgttgcgcacatgtaccctagaacttaaagtataatacaaatatatatatatataaacaaaacaaaaaaaaactctttaggaaggttgtgagatccccttttttgaagatcatatatcctcaaaaatgttctcatccatcaaggatggtctaaatatgagcattgtgaaagaataatgatgtaataatgacctctatcaaggtcatcttccatggtgaggaacgtgaaatggaaaaggcatgaaacggcatctgtgcaagacttcatagctctcaagcctgatgtagcagggctggagaaagaaggaaaggccttttccgacccttaattaaagggacttttgctggctctttgcagattgctgctggcgccccatatagttcttaattaattccgcctgtgtcattacaaagtaagccctactgaagagtgggttaacagccggagtaagctccctggactgcattttctttcacttgacgctgtgtcttgaaggctccagcagtggggtggagctgcctctaggagcaggcctgttttaatcagcatatcacaggtccgtagtcgtgagacagaacgtctccctgctcacatgaaacgtggcttgactaagaactcagtgataacaacacctctaaaaagaaataaaacattgaatgttcactatggagaggatgctcagagaagcagagattgtctgtgtgtatccagcactgactctcagcctgccgagggagagccatgcctgcagagtttgcagtctcctggccctaagatgacatccccagaaagctttctgcttcgtttactccaacccagtgctcaccacacagcctcagctcaggggtctggctttctagatagtgccactggctagggcacagcaggcacaacagacacttggaaagaaaatctccccattttaaattcatatgttggcattcagggttacacatcagagtcgcttccatttaatgtgtgtgcagccgtgactggaaatgatgcatctctaagagtgggaagtgtacgcatctgctagggctgctagactgggtggctcacacaacagaaggttactttctcacagtctggaggctggaaatgcaagatcaaggtgccggcatggttggcgtcctctcctcacatgttggcttgcaggtggtcagttctgcacgcatgccccagggtctctgtgtgccctactcaccttttctaaaaaggacaccagtcatattggattaggatccacccatatgaccttagtttaacttaagtacttctttgaaggccccatctccaaatacagtcacattctgaggtacgggagcttaggacttcaacatattgatatgaatttgtggtcgggggtggggggggggtcacaattcagcctgtgacactgagaaatcatattctttgttcaggaatgctgagaggtctcgcaatttgagacccgaccaaggttgggctgggcaaggcatcagcctcattggtgggtcccctgtgaatcaccacctgagctgcccaaaatggttgctccaaggcacatgtggctatttaaatgtaaataatttacattaaatgttaaaattcagttccttggtcatcccagcctcgttgcaagtgctcaatagccacaggtagccctaacagccatcatatcaggcagtgcagactagaatgtttctgccaacgtagaactgcccttacgttcttgttctggagggaccacgcacaatggctgtgcagtgattaaaagaatcccgcaaccagcaccctgcacctgcctgctttgtgcccagctctgtgcctgtggaagttaaaaatggggatgcaggccccctcttcaggcaacacggtctaattgtgccagtaaaaataacattaaatctcacatattagagatgtgaagaaaacttaaatggcacatattaatacccatgatagacttttgaaggataaaagaccaatcaaaactaaagtagaaaatacatggaaaagatagatttgagctgagttataatggttacaccagctttgcaaaggaagtgaaggaagggccccctgctcaatgaacatcatatcccacagcaactggaacgcagcgggcgtagaagccagatgtcgtcatgctctttatctgagacacacaatgacaccatgctgcattctctccctttcatgttttagtgtctcttgctccttctcagcctttcctgtgcatttatcgctacatccttgggttcttggacatcctggcagatccactgggatctccttcactgtactctcttcctctagaagtgttttgttcctggtctctcctcctccacctacagcaggatgcttgttgcggggattatcttagggactccaaaatcacttaagcatggcccttctacagcaacaaaaatctgtgccgtgcagtaggatggccactgctgcttgtggttctgagctctctctaagtggctgtgatgacggaggaatagggcaggagtgcttgactgcaccataaactaagaacccacagcttcttttgcctcaactctttccgcaaccctgacctttctctagtggatgcaggaaagtttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgttagtattatgttatttatttatgttttttgagacagagttcttgctctgttgcccaggctggagggcagtggtgcaatcgtaactcactgtagcctcaacctgaagagatcctcttgcctcagcctcctgagcctgagtagctgggactatgggcatgtgccactatacctagctaatttttttttttatttttagtcgaggtggggtctcgctatgttgcccaggctgttctttctcctggcctcaagcaaggcttctgccttgtcttcccaaagtgctgggattacaggtgtgagctaccacacctggccaccattgttcttattaatactactgaattggttatttattgtgattttactaaaagaatttttttgtcatcaaaatcgtttgagcctgcatttttttcttatgacatttcttggcaaaaactcagattccctttcaggaattttctttgctgaaacaacagtctagctattgtgtgaaagtccattctggtaatgtgggtcctccaagggcattagctctcggctgtttgcatttcaaaattgaccctcaagtttactttcatttactttcaactctgttgccttcttgaaaatgttttaaggcagtacatctaataagcatgaagcatcttacttttagtttaatcccaaaccttgtagttctaaataaaaaaattgaaccacgtgcccctaaggttttaatctaatatctggtttcttgaactggggccagctcttcatttttcaaagcatcaacagattctaaatacaacttctggcaacctccttttagcatctgaccttggttcacttaaactaattgttatcctttcagcagactgtgattctgaagggggaagaaacactatactgtgaaacattagaggagtttttaacatttggggtataatgccctccatgtaaaatgtctattttcagtattaccctctccctgcctctactaaaaattaaaaaaaaaattagctaggtatagtggcacatgcccatagtcccagctactcaggctcaggaggctgaggcaagaggatctcttcaggttgaggctacagtgagttacgattgcaccactgccctccagcctgggcaacagagcaagactctgactcaaaaaacataaataaataacataatactaacaataacacaggataacaagggcagctctctggtgttccaaacatgatggtaatttatttaaaactagatataagtatatactttttaaaaaacatattcaagaaccaagcctcaaaaatactaaatttgaatgcactcaggatgcatgaatcttctgatttataattatcatgtatttttcctcatacagagctcctcctatgttccaggtagatgctgggtgctgaggatgtggaagactcagccccttcccttgtggagtttatagtctggggaggacagagatgtttgtgactctaatgatatgtgcatttccatcaacattctacaagttctacacattctactaataacatgccaattcagtggcactttatatatgcaagccaacatggttttttccactgacattcacaggttttaatacagaaagcaatcctgttaaacaatttaattataaaaattctactgtaaacattaaaaagcaaattcagtaacctacctgtggtcacacagttaggaatcagtcagagctgggatttaagcccaaatcttctggtcctacatctcattcttttgcctcagcaccacttaagccaaggtgagacagtgaattcagttttccccaagtgtgagatgcaaacaactgatgatgtacaaggtgatttttaggaggcccactcatggggaataagctgtgctgaattgcaggtgagaaagtgattggctttcccgttagttgtcgttcaatacttttgattcgccagggaaccttggtttgaggcaagcgttctctctcagccaaagaagggcctggcctcaggctccgaagtagtcaagcagcactgcctggctggattggatgctattccttcatttttgttgtctcgactttttctattatctttacctgaggaaagagttcttggcttggctgggcgtggtggctcacgactgtaatcccaacactttgagaggctgaggtgggcagctcccttgagcccaggggttcgagaccagcctgggcaacatgatgaaaacccgtgtctataaaaaatacaaaaattagctgggcatggttgtgtgtacctgtagtcctagctactcaggaggctgaggcaggaggatcacttgagctcggggtcaagggctgcagtgagctgagatcacaccactgcactccagcctgggcaacagagtgagactttgtctcaaaaatgatgcgaaatttcatttgcaagtactgtaaatgtatttgcatatacacgagttaaatttacatcattcaataacagagggaagtggtgaggggatgagggaagtgctgaaggtgtacatgagtgactaaaatttggaaagacctcgtgagttgctgctgagtcctcctgactgcctttgtcacttgcctctagggattctcatttgctccttcccatctgctagttgcaacttcccaatttcaaatcacattagtgaaatgagtaacgtttcaagggagtacattcagatgactacgacattcacccaagacctactgtaagatgatgatctctctgttttgagaggtgaattggttcttccaggattcccaagggtggctggaaccacctctgactctacagatgagtgatcagcaccacgtggaaacttccgccatgctgggatttctgctccataccagtgcaggctcattgttttcacttatttagaatctcatatttactcttgtagactaaggctgactgccaaggcttcccttacaagaagtaatccatgtgatctaaagtgagagtattcacattcttcagtaagatatgacatttggctaaaagtcagtctttaaataaaaggagagcctctatgactctacagataactttgggttataaagttccatacaagtgtttgcttttaagagtaggcattgaactttctggcagagtaaattgagatgtaatcattttttgctaaactgttttaaaagatatttctaaccttattttctaaatttctaaaataattatacgttctaaattttgatctttagttaccatgacttaagtattgcaggaagagcctgggaattgtgctgatgggttttataaattaataggtgtcaaaaaaagagtcacaaatatcacattaaaattcctttttctgctatacttattcatttccaagcctgtcatctcttaaaaaaaaaaaagtatccttagattttcagtcacatttgatggagtttatgtgctctgatttccgaggtgaggacatttaaaacttcacagctctccaagaaataccaggaagggatgtttgctttaaaaaaaaaagagaaaagagggacaagaataaaacccccacccaacttccaaatactatatagagtcagtgaaggaaaaatacagacatgggaggaaaaattggaaaaaattttcttggagacaacagcaaaaactggcagtcaagtcagtaaggatgtactgtcatcaaggtctcaggttttcatattagaatgagaatagtaacaggtggcctgatggagcactggctgcatgctgggtgtgtcacacatgttgagtctcaccgcccttcatgtggccatggtgtcaggagggagacttgctcagttttcaaataggaaagtgacagctgccctggtatgtttataacagcttactctgggacaagtttataaactggagggtggcaaagagaccagtcaggaggctactgcaataatgcaggcaagagatgggttggaggctgctctccaaaggaagggagcagctgaatttccacaaaaacatccatctgctctctagatgttttcaagatgccttttccaaggaggtattcttactgctctctaaggatctgggcgcatttgcacaggctcactgtcaaagtcaggtgcagaggtggaggaaattacagctcttgagtagtgtgaacctcccaaactctggcaatatctgcatcagaggcaaaatgaaaattactgtctctctgaaatttggggtgacaatcctggagacaagacctaagcctagcatgacttatagaaacacagatactttcagctgcctctaaaacagagcagtcctctttgggggacctgtgacagattgctcactgacatcactattttgacaccccattaaattaccatggcctctttgggtttgcaagggcactgcagtgagaacaggggcagatccaagttccagaatcttcaaagattgatctcattgatatacatgggaatcaagagataggcaactcaaaaaagtcagctttgaccaagttttatgtaataaatctaaacacatagaaaccctttggtccagcttctccaggacaccatcctcattccataagaagcagcagagagtcttgcaggaagaagtaatctggaaatgcaggctttgacttccaaactgatgaaatattcttgtgatgagcccttgagagcccctgaaggggggtgccaaagaaacaaggactccctgaaatgcagctgagagcttcatcattggcaacatgacagaggcacccagcctcgagaagacattccagataagggggagccccaggcatggctgaggatgtaggtctctgttattaaactgttttttagggaacaaaagaaaagagtagtgccggccaagaaagggttgaatatcccctaacacccaccgtctgcttcttacaattaatgccctactgacactcaccccaattatatcaaaatcatctcctttttggagccaccttattctgcgtcagtctctataatcccacagaacagtggccttgtccaaggaatgttcagcagccgtgaacactccgcagttactgtttccatgactatttccccttgtcactcacttgaaggatatgtttttttgctcttgccacttgatcaatggttctcaacttatttctgctccagtgctcttgagggctgtgtcacttcattagcgggagctgactaccacagtgcttctgaaggtgggaagaaaggggacttttgaaatggagcaaatttgaagagaaagaaaggcaacttgattgaggggccctccagggtgttcatactcacatcaccaggaagcatcgctgtgcaggtggtgataggactgtgccactgaactggctcattccataaaacgtggtaaccagaaatccttggtggcttaagacccatggccagggtgacttcagagtgccacatgcacagtgcaatgcatcaggcacaaagccacaggttctgagccagttttgaggccaaatggaggcgcactaagttcagagtggaatggccttggcttgggtcccagctcttctgtttaccagctgtgtgatttcaggggagccactcaatgtctttcatactaaatttccttatctatacaacaggattaaaatgctcaccccccaatagagcttcacaaacctcataagcatgtatggatcaacaggaaatatatgacattgctgtggaaaaggcacttgtaaaatccctcatacagagtaatattcaatagaataagaaacatattctaaagctcagtcagacatcatggggactgtttataggcatgaaaacattgtgtgtgtgtatatatatatatacacatatatacgtatatatatgtatatatatgtatatatgtatatacatatatatacacacatatgtatatatatacatatatgtatatatgtgtgtgtatgtatatatatacatatatatacacatatatatatatacatatatatacacatatatatatatacatatatatacacatatatatatatacatatatatatacacatatatatatacacacatatatatatacacatatatatatacacacatatatatataggcggcaaacctcaatcccattatcaaaagagaaagagctattaggtaaaggaagataattgtacgataacaattgccgagatcatgatggctgctctgaatcctgcaaaacagaaaaattctgcacaatttcacgttggattaagttgcaataaaaagtggccagagattagcagcttctttaaaagatcaatgaatgttcacatttagatttcggtttgtttagaaacctagttcgtgtgtctagattcttgttttcacccagtcctcacctctcttagccgtgaagcatcacatgctccttttgcctgcctttgttcaggacactggagaatgacagtgaccagtgaccattgccatcactgtgcctgaacttctggggcactctgccttgtggcccatcaggcaaagttaggtgtcttcagttgctttagtgctatagcaataaatagtttatatgggatctaataaaatgcgatgcttcgaagcaccagaagagaagtctgagcagaaaacaaagaaatttcacagactttgcatgccccagtgagttcatcttccttctttcagggtgatgattttagtcattttacatgcacaattttattcatatgagaaagggaggaaaaattttatttcagaagcatctaaaaaacttgactctgcactgcctgaaaacatactgcacattatgtacggccttgacctgcatccctttctttctggcagcttttctgttgaataggatttttttctccttttttaatatctaggagttgtggcatttttaacagactgcatcgttttggagtaatgttctcttgaggtgggcaactgagatgtataattatatcctgtggaaaatggtggcggtatgaggggtggggaaggaggttattaaatcacaaaaacatgtttcctattcagaaaaaaatgacagtatgcaggatgttcaatttccttctgctctgtgcccatggagagtacagcatcttcaagtggggaagtcattggtattcactggagcttgcctggtttcatttttattgttttggagacttattactctttcagagtggttcccaggtctgctgcctcttcgcagtatatatgagctaaggtagtcagaggaaacactttaattacattttaagtagaataaaagcataagtatatttatgaaaattctaacagaaggtgcagtgagaccattaacttaaatcccaaaaatacatctagtgtttttttcataataggaagttcatagttggtgtgttaaattatacctgcatatttaaaatctgccctaaacactaaatattgcctaaatgtgcatattatattcaaaatcccacctataaaacttgtgctgggagcaggggccatcattgcctgcctcacacacctgtccttaagttgctgctctgcagatgggatgtcctcaggggctaaatgatgcttttagccttggttccctcagccatccctcctgctctctctcattgggcctcttgttcaaaattatgcctgagctttggtcgaatttgattttagcaagcctgaacataattctgacaagggaagactctgaggtgagagttagaggaggagttggaggttgtgcttaaacttgaatgtaaggatttgtctcaggcatagaaagatgcaaggtgaagataagcaaaatttcctcccagagaccagaagccagtcgttggcatatgcttcgaaaatccttattccaaagaacaaagttcttttctgtcgcactgggaggattcaaaacctgattagctttactttcaacaagtttgagaggaacccttcttttctacaatataaattatttggtgattacttcccaagaatattggttcagagtagaattcttcttaaagcattcaatattcagtttctgtaattttaaaagaacatgtgtaacttttgacctcttaaagataaaaaagatagctaaagaaccttttattcttgcccaaagaaaaatgcacgggtgaacatcttacaaaatgtgcactgactttgcttaatttattaaaagatatttaaaagtaaaaaagtatgtgaaaaggaacataatagaataattgcatagtaaagttacacataacccaatgttatttgattttccccaggcacattttactgttgtgtttattagtgattatgcccatctcatggtcttccaaaaaaaaaaaaaaaggaaggagggtggactcacagggtcgttaagagaatcctcagtctctctagggaaggaagaataaaggaagtgtatctgccacctctgcagctgcacatctgtggcagtcccggctgcaaactagacatgaagcagtattctaaggcactgacggcagtgttcctatcccagttactgtacttgccctgagaattgttagccaggaaagcaaccaggggcacacagtctgagagatcgtaccatatcatggcttctctgaatattcagtggctccagagctacagatgaagttttattttctaactaaaaatttaaacaattggtttttgtctcactttaggcataagagggagtctaaagtaaatattttctcagatatcttgaacgtatatgctagaaaaaagccataacattcaaaactggatccatcttaggaaaaaaacatttttaatctccataacaaaaggaaataaaagccaaggcaaccaatctagaaagcctttcccttttctctctgggctcccataggtttattacttattttctaagccagggataaagactcgtggtcttaataatccaaatgtatccatggggaaattggctatataattgaaggaacacttacggaaaatgcaagacaccatcaccctatctgtatggagtcaggagacagtgacatttatctatggaggcactagttatctgaccttttcctcagagcatttctaattttgttttgttttttaaaaaacacattctgccatttatagtgattcatgtaattcctggataagaagttgggaggctcattgcaagaagttgaacttttcctgcagtggctcccatgcaatgaacacatatcatgtatgagaagaaaaattcctgttttatagaagtaatcaatagttaaaatttaggtgacatttttaatattcttttgttgtaaacattctttcagagacaagcagagataatcttggcatggaaaacaattgttggccatgtgtatttaagttgacttaatagtgttttcttctcaaggtcattggggtaagagtggtagagaaaaagcagtggataaagagtcagaaaacactgacttcggatctaggttgtgttagaagatgttgaggtgtctgtcttcatctcatgtccctcagctgtaagggacagctcatgtcctctcctccagtgaggatcaggtgagaggatggactcattcatctgcacatacttttgatgctctcataataagtgctcagagatggataaaacttgggccccatctgtaggaaaacattctgggaactgtagtgctcaaatgcagtacaattggttattatttcatttgttgatttgtgtctgtttcttggtcaccaattaaatgaaaataatacaactaaaataactatttttaaatacaagggctattggcagtcctgtgataaccacaaatgctgaagaaacacagctgtgatgtgagcatcattccccacaagggagcctctgtgtgtccagagagggcagggaccctcatgtggctcgggtccccacgtgaaggctcagggaatctaggggcattttctgtatgagttgaggctgtggatttactggaagacttcaaggtctcaaagtcacttttcttcttccatcttcctacaaaaaacaaaatctgagaactttttagatgggtggaaaaggcagagggaagtgaaattggtaattaatcatgacaaactcaaagtggaattaaatttttggaagtcaaatagtagttattactcaactataaaattattgtcattcatagagtaacaaagacagtattcagaaaaagagtatctgactttaaaatccctgaagctatttttaaatgcatgttatgtagcagaatagaagctacatgtttgaataaatcccctgattatataaaggtcttgttctagatggaatcaactagcgatttttaatgatagtatttgtattgagttaatttattaataacctgaaagtgtttttatttgtatttgccctgtatcatacagggttttactttttatattagtccattctcatgctgctgtgaagaaatacccaaggctaggcacagtggctcactcctgtaatcccagcaggtgaatcccaaggcaggtgaatcacttgaggtaaggagttcgagaccagcctggccaacagggtgaaaccccatctgtactaaaaatacaaaaagtcagctgggcgtggtggtgcatgcctgtaattccagctactcgggaggctgaggtacaagaatcatttgaacccaggaagcagaggttgcagtgagctgagatcgtgccactgcactctagcctgggtcacagggtgagactctgtctcaaattaaaaaagaaaaaagaaatacccaaaaccaggtagtttataaaggaaagaggtttaattgatgcacagctccacagggctggggaagcctcaggaaactaacagtcacggcagaaggggaagcaaacacgtccttcttcacctcgtgacagcaaggaagagtgccgagtgaagggtgggaaaagccgcttataaaacgatcaaatctcatgagaactcactatcaggagaatggcatggaggtaaccacccccatgattcaattacctcccaccaggtccctcccacaacacatggggattatgggaactacaattgaagatgagatttgggtggggacacagccaaaccatatcactcttcaactagcgatgcatagtgtgagtctgttaatacagctgttcatatatagcacatctgatcctaccatgtttttgaaatgataaatataaggtaaaaactattatgataatgaagtgttacctatgatcacgactaagggaccttaagatgagcagattaaacctcttaactcttaggtttgtagtgttatttttttcagtcttctgtgttgtgttttaaaatggtgttgctcaactgttttattgggtggatgtacaggggacaagatctgaagcctgagggcagaacagacctggggctagggtcttctccagccagtctctgatgcaagctcggttgtatggtaacagcagtgtccatatccaccaggccacagaaaagacatggacttgacaaactatgtaactaattactggattccaaacataaatgatgaacacatagctcccactctcagggagtccacagcctggtggcagagacagacacagaaacaacagaggatgccaggcactgtccacttagtggtcagaatactatgcagcacacaggcaggcagagtggggcacagacatctcgtggcgtctgcgagcagtgtctcctactgcagcagtgctaagcaacagtttacctcatgggggagagttggacccacaaaaaggaataaatacattctacctagcgacagactaatctgaaaatattgtaaatggtggaaatggccaagacggctgaacaccacaggtgagatggagaccggggaggaaggaagagcttctgtttgggagagaactgagagaacttgaaagccaccctggagcacatctgaggacacgagtccctaatgccatgttctctggccccaaagcgttcccaaatggtgctctcattcatctgctcacccttcatctcttcctctttccctctctcttccttcccagtgggtgccaggaagtatgtgagtaccgtggcaaaaacaagaaatagctttactgaatcctgttcacttccatccttttcccataacctcctcacatagttgaccacataaaggtaaaatgtagtgtgaactaaagtggaaataaagacacacattttattttacttgtccactgagagtaggggacattttcattacaacttgaacaaaaaaaaattgaataacctgaagattaaagactccaggcatcatagtgccaaatccctaaataaatggacatctaaactccattaaaaatgaagagaaaactttggcagagtttattacaggattttagcctggaagtcatgaagtctcagcttacctactctcatgttttaaccaaagataacctttcttcaattagcaattagggagaaaaagacatcactgtatctcttacaagaatattgaaaaatgacaatataattaagaaattgagtgaaacattaatttctctgtattaaatattcagctgagatggggatgaacatgtgaccatttttactcggttatacagagaaattgtgggttcactcttcagcttccatccctgtgtttgtaaggtactaactaaaggaaaacaaagtttagaaaaagctaaatgaaatatttaaaatataaatgtagtgtaataatcccttgtctcatttctgtcggcattctttccttcttgacccttgttctacgttttttaagaacatcctccatcgttaagatccctctgtttactgcgccaaattgtaattctcagtctcactttccttctagagcttctttgaagggcagtctgcaccatgggactcggctaagaaagatgagaacagaatgaagaacagatacgggaatatcattgcatgtaagtgtcaacagtgtcattgtgctgttgtagaacttcctttttgcatctagtaagattgaccaccaggctcatacagaggaaatttacagtgcaattacctccttcatccttctagaacagctggtgttaacgctcgtactaaagaaaggaataactgtctacccccacttcatcattgtactgttgtcgtgggccctgttttccttttagatttaaggtttgggtaacacaggtaacgttaagatgctgagaaggaaaatgcattttggatggagtaaacattatagtcctaatggttcccagctgctacgtgagaatgaatggaaataatgatgcacagcttgccttaatgcaaagagctcagagttctcagcaaacattaactcattaatcctgtggacactgggttaggtaggtcagtaatagccccattttaaggacaggaaactgaaactcagaagttaaatgatactccccatatcacaacactcattagcaaaagaactaggattatagcttagacattcccagtgcctgtgaaactgaatgttaccaacccgtaatgccttggatggtttctaagtcgagcccagcctcattaatgttgcgtagcaatgctgagacatgcgctagattgatgaaaccccttctcccagggcccgcactatccatcccccacactaaactgctctccgtcatccatgactgcatcaaggcactgacaggcccgctgtagtcgcctaacataattaatactatttataaagatacataaattttaaaaagcaacacaacaatgcagattaggccaagagaacatctcgctcctcgtgtctcatttcttacgagagaacaaacttgggaggtttggttattccagaggagcaatctattagctttattgattgtgaaagtgctgttaaactgtctttgcctgagttcacatttcttagtgtgacagtacagattgtctaccagtgctgcccacagaatttcctgtgactgcagaaatgtttcgtgtctatgctgtcccagacggtagccatgagccacataggagtagctgcactgtgtacttggaatatggccgtacgactgagaaactgaattttactttatttcttgtttttgctgttcaagagtttgacaacatgaattttaaattgtatttaattttaactatttttaatttaaacagcccatgaggctagtggctactacatagggcagcacagatttcagtgtgttgtagaaaaagaaactggggggtagagtggagcttacatatgacacaaaacgtcccagctgagcacatgctgctttccctccggccatcaagaaagccagatcgccagtgttgccaggtataaatgctagcttcatgtgttttgtaggttggttttagagcgtgctgtatttagtagcattggagtggtcatgtcacagtcctttgtaggtaggagatgctgtcctgaggtctagggttgattactcctcagtggatcccatcaacacttgtgggatgcattcttgatactggacactgaggacgcaaaggccatggagatgagatggtgcccctgtccccaggacaaacccaaccgggcagtcagatcgctgtggcagtagtccagcgccgtgacacagggttttgttgcagcctggtacacagtgttctagaggctcagagaaggaaaacatggtttcttggtctatctagactcttccaagttccttcattttctctgggagcccactgaagctttgcgctgttagaagaattcagatttctcctgatggctatgacatcctttccaggagtcccttcagctctgcaacaaactcacagagagtcttggaagtgaagtggggaatccccttccataccaagtggaagagacattgctgagcctataacctcatcattgtggcatcactgatgtggcctcgtgctgagcatacagaatgcaatgaatgtcaaggggtgtagccttgggtatgctgagagatccagctagcctttctccaatacaacattgagtctgcttcttcccaatgtatagtttagtacctcctcatggagacactgagatatatttttgaatcatgagtgaaaaaagctagcatttgctgagcacttacatatgccagacactactctaagcactttgcacatcgaaacccgctcactaacaacaccacgaaataggtagtatttttgtatctattttacaggtgaggcaattgagggataaagagggttaaagagtttcacggttaataaggtatggaggcaggattccaacccaggagcagcttttataaccactgctggatgggtgctgggatgactggtcccactggcttggttttcaccaggtgtggtggctcatacttgtaatcttagcactttgggaggctgaggtgggaggattgcttgaggccaggagttggagaccagccttggcaacaaagcaagactctgtctctacaaaaaaattttaaaaattagttgggcgtgatggtgcgtgcctgcagtcccagctactcaggaggcggaggcaggcaaacatgaggatggccctgtattgattgtttcctttctataaaacgtctgcaggctccccaccacgttccaagcaggttttctcctttaaacctccagagatcctgcccatttgtctccacttggcccgtgtgggtatttggtgtacagctgcttgtcacaggaacactgaattctgttcctgtacccgttgctcgtcacagctggacagagagtatgtacttaaaagggtccaataatccatctcttcattcagtaaatatttattcatcactttctttttgccagactctgtgggaggcactgctataaaaagataatgaaggctgaggcgggtggattacatgaggtcaggagcttgagaccaacctggcaaacatggtgaaaccctgcctctactaaaaagacaaaaattagctgggcatggtggcatgtgcctgtaatcccagctactcgggaggctgaggcaagagaattgcttgaacctgggagatggaggttgcagtgagccgatcatgccactgcactccagcctgggcaacagagcaagactccagaggtctcaaaaaaacaaaaaaaaaggaagataataaaacacaagatactgccctcctagtagttacagtctagtgcagggggttggcaaacttttttctgtaaagggtccagtagtaaatgtgttagcctttaaaggccaatctcagtctcagttcagcttcttggctctgctgttttcatgcaaaagcagccacagacagtacagaaacagatgggtctgactatgttccagggaaactttttctgaaagccagacagtgggctacttttggcccacaaacagtagttttctgactcctggtttagtgaagaacagattccacaaggggaactttttcttaccccccagggcacatttctaccaccaggatagttttcaactctcaggaccctgaacttgggatcaattttttcagcaccccaaacagaggtatcagatgtgatttgtgtgtctggcacaatgttgtcagaggcgggatgggtttaaatctacctcctaccaccatgaatttgcagtctgtggccagatcaggataagacatgcatgaaataatagatctcaggtccataaataaatggagaatgtgttgtgaggacaccactggggacttgcaggagaagggtgagtggacgagcggcagactaatcaggaaaagacctctcaggcaaaagagaaggtcgtagggtttggagataggaggaacagtttggagtccttgtcctaccacatactggctcaatgaccttgggtgagtcatgagccttctcaatgtcagaatttcctgacaagatcacgtgttgtggaaatgaacagaaatgccacattaaaagaacattgatcgttgttacctgaaaaaaaatctcacttcttcattacttctgtgttactcatcttgagtttagcagattcattacttcattaaaaaaaaaaaaaaatcagcatgttgaagtctccgatccaagtgatgagctggtaggtaattcagggaccatcctgctccttactagtgagcacgtctatgtgcagtggcccacttctgcccaggcgggactctggcttctgtttctgggcattgcggtgggctgtcatttacccatgacctctggggctacgttttctagcccccaccgccctccatcccatcccttccagtgctcttttagtgtttctttactgggttgtgttatttttgtatctttctagggacagtgtcaaaaagagacttctctgtccagcctcctaatcttcctctcaccttccatggcgtcctgaagcccttccctgggtatccgtgttaccccttcctctagtttgctgttgcttcctgtacccacacacacataatgacccatgcatacatcatgactcacacgtacatagtggctgtttctttatgggcatagtgaatagtattaccatcccctgcctaaaaattatgtaactgtagaaaagtcagttccactgcctgtaaagtctgcttcctagagcctcggacttgggataacaccactaactagaataaggaattgggaattcagtcagcatatcttagagattcttgttagtgcttttcaaagaacacagaagtggtgtaatgatcacattcattgtttttgcagcagtgtttgcatataaaatagttttaatggtccttaaaactgtttattggcttttgctcttaagtaagttaacttttcccttatttacactataaatttgctgagctagccccttccaaatataaaccaacaccctacccaccattaccgcccctccacacacaagcatagccctcctaatactctcaacagttcctaattataattaactctaagcttaaggcacacaccaaatctccctgctaacgaggcagcccccttgcagccggctcctctttctagggactggcaattggagataatgagccagaatctgcagaagcttcccaggctcccttcctcctctcttctgatctttattcaacaagtatatattgatctgccatgtgccaggcactgtgccaaaccacagtcattctttcaacagatatttgctgagtgcctgttatacaccaggcactattctaggtgtcagcgagagagcagggaacaaagcagacaggatgctatgctggtgtcgtgctgcaccttcttgtggggaagacaggagcaattgctgagtgcagggtgtcaacacccatgttaggaggtgagcacccagcaaggaaaatgaagcagggaatggagattggtcagggtgggtgatgtttttagactgtggtcaagaaaagcctcccagaggggatgagatgccaaccaggacttgaaacaggtgagaagacggaggagtgtggccgcccaggtggccggtacagcagggaaggctgtgctgccggagcagcgggagtggggtaggggcagaggtgggagatgcagggactctggggtgaccacaggagcaagagctgacagggcacctgccctcctgaagctgatggtcctggaagatttcgtgggggagaagggggtgatgtaaatgattacaaaataaaattcaagttaagggcacagaaggagttaacatggtaccatgagaactcacaacgtggggactgagtgaggaggtatgggaaggcctccctgaggatgggacatggaaaacaactgaacaagaggggacggagcagggaggatgctgcagaattgggaggggttcatgtgaacagaccctgtcatgccggggagccccttgggtctgaagaactaaaggaaggctgggtggctggagctggaaggacaggggttgggcaagagaaggagggaggtggaagccagacctacagagccttctggggcaggttgaggacttttgtctttattataagaataacggaaacttcattaaaggggttgggggggtgttaataaaatgtcattggaaaatttagatctgactgcagagaaagtaggttcgaaagggacagctgttgaggaatttccagtagcccgagtgtgacacgatgatgatgttggctagaaagaaaataagtagatgaattcagaagaagtaatggacccaaccgaaagatggatgggagacagggtgaggaagacagaagagccagagatgactcctgcgtttccgacttactggaggatgaatggttagatggatgatgggcagttgaacaggtagacacatggaaggatggatgggccattcccttccagtattatccaggatggataatactggaagggaaccagctgtggagaggagctcaggttggcatgagatcaacagcagcttatgagtttgatttggggacatattgagatgcttttgaaacatgcaaatgcgatgccaagcagacagttctgtagactgctgtgaaatctgaaagagagggatctgggctggattataaatcagtgacccatttcatgggtcatatgggtggtggtagaagccattggcaggaggaggtgatctgtggagggagcaaggagggcatagagagcccaagacccagctaaaggggctttaataatgggcggtcctgagacagaactgctcagcggtgcagggagcactctcatggagagaaggggtgctgctagtgtcctgttggtagatctagtagatctagtacagcagagactctgatgtagtgctgaggacacgaggtcccttctgaggtgggttaccatgccctcctactccatttcctaacaacgaggtgtgactaatcagtgactggagctttggacctaccccagattcttctagccagtgagccaatcttggttgctcacattgaaggcttcacttttctaacattttgttttatagcagtgtgcttctctctgctaattgagtgactccaacagcgtctttgaacgaagggaaccagagtttatagttaggtaagaatggcctggcagagcgagcttttggcattaaattcaggtgggcacgagcaagagagaagcagatggacacaatatgtttaggaaggcatagggtagaataaataaatccctgccaggattctgaagaataaagagagagctctgacacagggattagtcagtcagaaaaagagttagaaaacaaggcaagacccacatgaaaccaacaggaagaggaaaattcatatggagccaccatcatcgaactcaaacttcctgctcagaacctgcatggcagagctgggaaccgggtggaaacaagcagggagactgcactggaggtggcatctccaccgggtaaggcgccaagcacttcctgagttgcaggcacactgggtctcctgtagaccctaccttgaaacaagcacaacagcaatcctcagcccaaatgcagccacgggaggagcaaatccattatttgcagaaatcaattgtaattaaaattaatttccagccttctctcagaggctaaatattaccttgataattgtgattccaatttaccttatatatgtcaccagtatgtagcagagagaaagaattggttagaggtgaaagattatcagtgatacactctatttctgccgctgtgggaatatctaatcacacacaagttaaaactgcatgactattgtcaatatccgtcatgtttaatatggaagtgttaaaatatttgaagttacttagagatatttttaaacgtaatgttacctgatggaaagggcagaaataccatgttctacagacttagggtggggcatagacctgccctaaatctcgcatcaccccagtccaatgcatgcctatgtacacggggggaaaacctcagcggattataattcttcaacgctaagcactggtttgttgtgacaaggtctttatgtgcctgtttcttacccaaaaatatctgcttttctctgtttcatctagtaaaggctttttttgagagatatgagacaaatagcaagtcgtttttatgcagatggagtttctcaaagtggcagagtttgttacatttcttgatggggtaacattgagttgtgattatgatataaacatgagtttaattttgatcatattcaagtcatgcatggcaaatagatttctttttctccaattcatacacattaaagaaactttgtacactgtggaaaacttggggaacatatcccagaatctcaccatccagattcaaaccctgctaacattttttttatgtttcattccagtcttcttatttttctatctcttgaagctgttgactttatttttttttttttttgctctttgtttttcaatgagaatagatgtgttattctctttctaattacaaagataatataaaccttgtggaccattaaagtagtacgtaaaatcataaagatgataataaaaatcactccagattttatcccctgcagaaacctcattcttccagttgtcccactgtgcatacctacacgtacaccaatgcgtttgattatttcatgtaaatagactcttattagacatgctgccttgtagcctgctcttcttcactctgtaatatgtcccagagatctttccaggtaaataaattaaaggcctggtaatccttttgaatgattttatcagattttttgcttgtttgcccaccattcttcagtctcctgtttatatcattgaatggttaccaaggtggtgttaggaaaaaaacgtctgttttagaaaaagcagtccttggcatggattcactagtgagggaagcaactagaggcaaaaatgaaatagtgcagatgaaaatgatcaggtcttgaattaagtcattggcactaataagacaagtgatagctaactttcccttacttcttattgtataccagctacttactaatgattacttatattaattcacttaatcctcacaaaactctataatataggcagtattgttattcccattttacagttggggaaactgaggcacagagcggtcaaataacttctccaaggccacacaactagaaagcagcataactgagattcatacagggattctggctcgggagcccgggatcctaacctccgtgctccactacacagaaatagggataggttgttgagcagataccaggagattaaaatgtagaagttattgaagagcattcagcatgtcttcaaacatttctcctgtttcctttttaaaagtatctccacctcctcttccctgaaagattggctgcttccagttttcagttctgccctgctctgctgttccccagtaagcatactggctctttgtgctttgaagattttattggtaaacttcaacaaagatgttgcttttattcacagaaaaggggtaatttttttttttttttggatggagtttcacccttgttgcccaggctagagtgcaatggtgcgatctcagctcactgcggcctctgcctcctgggttcaagtgattctcctgcctcagcctcccaagtagctgggattacaggcgcgcatcaccacacctggctaattttgtatttttggtagagacggagtttcttcatgttggtcaggctggtctcgaactcccgacctgaggtgatccgcccacctcggcctcccaaagtgctgggattacaggcgtgagccactgcgcctggcagcgtaattttttttaaggggaactaactgtactgtgttccaggcacctgataatactatgcattatcttatttggtcctcccagaactcctaggaaagtagccccttgtcacccctttttacagatgaagctcagcaggactccaaatttgtgcagatgcatgtgagttgtagagccagcatcaaatcatggtcttggacaccaaagcccctgttagtttcatttcctgcaaaatgtgaatgtgaaatggctttggaataatcaaggaaaagcacccatgctggcagagaaatacagatggtaattaaaaactacagctcaggtcttctcaaacttagcaggctgtgtgccccagaaataccaagtcctcatagtcttgaccccgtggttttcatggttagtaattgacctgttgttaaccacaaaactgattgaattctacagatcttatgcctaggcagttgagttttccaaactttttcctcccttcaaccccaatggctagaccctggccctgagagagggcccctcccagctggtaagccttcaaaacaaacctgcagaacagggcttatcattggacaattggcatttctttggattctttgtctgagtgtctcccacatttgccagatgccagaaatgtctgtgaggcatttcctcataaaaatttgatatgatttagcctcaagagtaccccaaggaataactgagttttcctgaaagaatggttgatacatatttgtctttgtaattggcatctgattcaaggtgaatgatatttcaagaacatatggtgaggggcatccatatactgatttatttgccccaacagtctatatctgttgttttcatagtcatctgagagctttgtttgagagaggacgcgtaagaatctgcagtttctgtgccaagtcattcttagacgtccaagcagcagagcatgggggagctggaagagccaatcatttcacttctttagcttttacattcaccgacttaatgtgagtgatggtgatacttacctatttcttgtattctggaagacatagggattaacttgagaagtgctgacctgtttcagccaggaagtgcaatcatgtgatgatcagcctgctgctctccatggcagaacacatgtcccgcgttctccaccccaactggaccctttcttgagacttaccccacgctcactgctaacacaggtatctcctgggcttgaggtggattcacttatcagtgttcaccttattttatcactaaaacaaaaatacttcataaactacataatgtatgactgttatcctctattagaaagctatagaggccaggcgcggtggctcacacctgtaatcttagcactttgggaggccaaggcaggcagatcacctgaggaaaggagtttcagaccagcctggccaacatggtgaaaccccgtctctactgaaaatacagaaattagctgggcatggtggcagctgcctgtaatcccagctactcaaaaggctgagagaggagaattgcttgaacccaggaggcagagctttcagggagccaagatcgcgccattgcactccagcctgggcaacaagagtgaaactctgtctcaaaaaaaaaaaataaaaataaaaaaaagaaagctatagagtcaccgtcactcctgccttgatttcatcagggaaagggaactcaccatctcaggaaaatgtgcctagcaaaagaattcacagggctctaggctgcaagtccatgaatgccctttcctaggatatcagggaccagagtggaacatgagctattattacaagggagggatggaaaaattagactttttttatttttggaaaaatacacataaaatttaccatcttaaccatttttaaggtcagtgccattaagtactgttaaaagaaaaactttagacaaattaaatttagccaggtttatttgagcaaagaccaattcatgagtcaggcagccctcagaaacagaagaggttcagagagccacacctacaagtgtgagtggcaggcttttgtaggccaaacagagaagcaaagtagagaaatcacctaattggctacagctaggcatctgccttatttgagcatggtgtgatgagtttggagttggctgcctgattggttgaaacccttcctgttttatgtattccctagcacatggtccaatagaaagaaactatgaaatataaatgcaagccacatgtataatattaaattgtccttaaatctaatagccacactaagtaacagaaaaagaaataaattacttaagtttagtaatatattttattaaatctaatatgtcctaaatgtcaacttttcaacatgcagtcagtataaaaaatataaatgaggtattttacattctttttatcgtgctaaatattccaaatttgatgtgtattttacacttacagcacaattaggattagcctcatgtggctaacagataccctattagacagtacagatctagacaatatagttacattttgcctggcttttaactttacataagtaaaagtatgtaacatatatctctgttatccagtattgtacctactaactacacataattgtttaagttcattaaaattaaattaaaatttcagttcctttgttactccagccacatttcatgtgctcagtaactagtgtggcctttgtactggtgagcacagatatagaatgtttccatcagcacagaaagttctactggacagcgttggtatatactcttctgtgtattgctttttttgttgttcaactatgtttgtatgatttgttcaagttgtatgtaaatgtagcttgttcattttcattactaaatagcattccactttattaatatagtacaatttatgtctcccttctgttgatggacatttggattgtttatagttttgtcaattgtaaacagtattgcttcagtacgtttcaagatgcacacagtatccatttcctcatggctgggtcataggtcgtggatgtcttcagctttactaactagcaaattgtttcccaaagtgattgtactaattttcatttccaccagcagaatctgtgagtttatattattccacatcctcacctgaacttggtgttcagacttaaatgttttgcctttctagtgggtatgtgatggtatctcattgtaagctgggctttttttcacttactgataaaaataaatgtttattgattatatatttatcaatatatatttatactattattttcatagaagtgtgcacacaggaggtgaagatgaatataagacacagctcctcttaaatagtttttgtttttatagagacagggtcttgctctgttgcccaggcaagtgcagtggtgtaatcatagttcactgcagccccaaaccactatgctcaagggatcctcctgcctcagcctccctaggactacaggtgtgctccaccatgctaggctaattcttttttcaatttttattttttatagagacaaggtctctaaaaataataataaaaatgtcatgttgcccaggctggtcttgaactcctgagctcaagctatcctcctgcctcggcctcccaagtagcttggtctgcaggcatatgccatcacatccagctaaggtatttttgatctgtaggagaaataagtcatgtctatagataaccatatataagagcaccaaaaagtgaaatcaaaggactattgacatttaaggaaggagaatttatacccaacaacctactccatatctctattcagatggtaaacacctcagattaaatatatccaacactgcgtgcctcatttccatcacccaccccaagctggcttttctccatggttcacatcttagtcaatggcaccatcttctgccctttttctcagatcagaatcctagaagtcaacatgatacctcttctcatccacaataagtgaactgatcattgtggtcagtcctaccacctaaatacccctcagattcagccctgtccactagccctctctatgctaaactgccattgatcccctaggactcttgcagtagcctccccattgtctccccactcccacagcccttccagttcgtcctcaacaatagcgggcatctgatgaaatgaagcacgcccctgcctgtggcttcccacggtgctcaggatgaaggtcctaatgacctggccttccctcctctctgttctcatttcccaccactctcctccctggcttctgacagcacattcaccacaccaaccttctttggtttcctgaacatactagatccttcctacctcctggcctgaatacacactatctcctggacttgaaatttaggagttctgccctctccactttccatcttcatggtttgagcttcaatgtccctttattagggaattgtttgctagctcttcagagtaggtcaggacccatgccattcactctcatagctctctgtcctttccaacttagcacttatcaaaattgtatttaagtcattatttaagcaatgactgtttaatgtgttttccattgccttaagtcccatgaactcaagcaccgtaaatctaatttgtttaacactacatatccccaacacttagcatagtgtttggcatatagcagatactcaaaaagtcactgaataaatgagaagaccttactgaggaggggacatctgagttgaatactgaaaaattggcagaatttggacagttagagatggttaggaatgattaggtaagagatttctagaagatgaaatagctcagtattctgacaatattagacaagcctgtattaaaactgaaatttaggctgggcgtggtggctcacgcctgtaatcccagcactttgggaagctgaggcaggtggatcacctgaggtcagtggttccagaacagcctggtcaacatggtgaaatcccatctctacttaaaatataaaaattagccaggcgtggaggtgtgtgcctgtaatcccagctactcaggaggctgaggcaggagaatcacttgaacccaggaggcagaggttgcaatgagccgagatcgcgccattgcactttagcctgagcaaaaagaacaaaactccgtctcaaaaaaaaaaaaaacctgaaatttaaaaaggcactgtggacccattcaaggtatcttggatgatcctggaccaccacccattcattagcatggggaagagttcaatccttgttgctcacttgctgtgtattaggcagggccccacacatgggactgcagcctgtgcctctgtgctgtgaatggagtcttttggagttaggcatgtgaccttggggaaaggtactcttagggatgttcagattatatatgacactgtctctgaccacaggacattgtaatctagtagaatcaataaaagaaaaaagatactaccatgtatataaaggcaaaacccatctcattctgttaggaagtcaactgtacatgtgtcttacaggtttctccatcctgaggggagtaagggcaattgaatctggagaagtagcagccaagttaaattttggggtgtggataaactgaactgtaggagatgatggtaaaactctacttcagaggctctgttgataggaaataggaattcagtcctggtggagattgacgtccctaaagagaaccctccagaatagcctgagcagcccatgggtggtaaatcacagggaatgagcagcactcatcctgaggagctcagagaattcaagcacaaaatagacaggaatctgacgagggggtacaacagatcttcgagacaggcctgcttagattgcaaggttctaattcggtcggttgcctgccttttgaaaacctgcccagggaaagcctgagtatccaggaaggtgaacctgacctcccttcagaggagctgacgaaagcccagtgtgtgtggagtagccgtgattcagttctagggtgcatctttcattcttgaagttcaaatggcattgccggtgcttgtggcacccttctgtgcagtagttgcatgtaggcactggctctcctaagatacacaaaagccataacaatctacacatgtccagtgcaccagctcacctcccccaaacccccaacagtggaaaacatatacagggagccactggttttaagcagcaaaatgtgtcctaggaaattggttcttaaagcagatcaccatgaggaaacattctgactgccggtgagtctgttcctggggttgctgttatctgcttggacatcatctgtaaaaacagcaggaagaaaaatgtggctgtccattacatagcccatgacaataataactgacatctatccatcgcttcctatataccaggcttttttatgatctctttatgtgtattattttgatgctcacagtaatcccacaaggtaggcactcttcatctccattttacagcgaaggaagcacagaaagattaagtaactggcccaaaaccacacgtgaaggattctaacccaccagcagcgattctcacccacacactcgaccccagaaattgctcatcccatagtctcctgtgagcagagcaggaagacatgacctcctctcagcttttctccttctctggcccagcttgtcaccacattccagataaacttattgcaccccaactaatggtaaggcactgacatgaaataatgtgactacctgtcatgaagtggaaagccccgtcaaggaaggaaagttagaaaattgacaccgatttccttctgcctgtgctgttgacaacaaacaaaacatttactcgacaggaggttaaactccagaaaccaatatgaaattttgactttcacccattagcatttcaaggaatgggtccaggtcaatagttgctccagtgactgaggataaaagggtccgtcatctgcagctcccctggcttttatctcaaaagctgtgggcttcatttctcacccactaacccaaaagaaatgttgagtaaagttagcatcagaaaaaggcagtagcagtttagaagcagggtttcccactgctctagcaacattggaagtgaagttttgcaaaatgttcttatcaggcccccctgtgctttcctttcagggcagctggcttttatctgttctgaatactgagttttagcatacactttaattggaaggaagggtccctctgctaaaaggaacagttatttaggtaaatactttttaaaggacatatattttcaaaaaacgacaatgcactttttatttcttcaaaagttattttgggggtaaatctgctatgttccaggctctaatctaaaggccagggacacagcagtgatcagtgcaggaaaattctgcccttagggtgctattagcacatcctttcttttttttttttaatttttagttttttatttcaataggttttgggggaacaagtggtgtgtttggctacatgaatgagttctttagtggtgatttctgagattttggcgcacccgtcacccaggcagtgtacacggtacccagtgtgtagtcttttctcccttacccccttctccccctttcccctgagtcctcaaagtccattgtatcattcttatgcctttgtgccctcttagcttagctcccatttatgagtgacaacatacgaagcacatccctttttaaaatatggatttggggccaggtgctgtggctgacacctataatcctagcatttgggaggttgaggcaggagaactgcttgaagccaggaatttgaaaccagcgtgggcaacatagccagaccccatttctgaaaaaaattaaggtaacaaataaaatacaatatacattttcaaggaaataattgagatacatcaatagtatttgcagataattttttttaccctggaaatacttaaatataactaattaataccataaatatgagccctctatagtacttatgtgtcaatttgtgttttcattgaatcctggacacagcccactttgaggcaggtagtgtcatccccttctccagatgaggaggctgaggcttggtgcctttatttcctggcctgtggtcacatgatggatggtgacagctttgctcttgctggctgatgcccgcagatacagataggacttagggaactcaccagtgactaaggctaggatcacatctgcacatcccagaagcctgcaccgtgagtttgtaatcatcatttgtcaaggtgggtgtcacagccttcaacatctcagggtttgtatgtgatttagtgaagttgctcaaacttccagtccaagatctacttatgtttgtggttcacaggattgtatgtaaaagtgtcaaacctttgtcaatgctttaggcccgtcaatgatcaaagaataagttaatgagatttactgtaaaatgttaaaaattacaaatccttcccaattttaatagcaaaatgggaagtagagggtgtgtactatttaattctttatctttaaagcagagtgtctgtgggtgatctctatgtaatatgcttacattctggggctcagagccacctaccagattgcttttgttaatcgttattttctgtcccttttcctttgcagacgatcattcccgagtgaggctgcagacaatagaaggagacacaaactcagactatatcaatggcaattatatcgatgtatgtattttattatttttaattgatatataattgttgtacatatttgggtgctatgtatgatattttgatacatgtatacaatgcataatgattaaatcagagtataaaactcagtaaacccaaccattctgacatgtaccagattgtgtgtctgctgaacgattgttggacatacattgggctcaatctaaaagcaaacacatgaatattaccctgcacaccacagaacttaacagtgaagacacggtcactccttttctcaaggtagcccattcgttggtgaatttctctgtaacattctatgccttctttgccatctcatgcttatgtggactaagaaaatgttatttccatttttttgtcaacaactcatattattcgacacttaaaaaatttgtttgcatattaatgggacaaaactctctaattcctaatacggcgatttgcaatcccttgtcatcactgcacttttaagttgtcttcaaagtagtctgcatctgttcaccaggacttctaatgcaagcaagacatgtcattaaatatgtaggctgtttaattattgaagactgcctctttgttcattctgcatcatgttaacttaatgttttacattagaataaattctttaggagacagcatgttttcagttgaaagaatgaatgaaatcaaaagtagactgaaaaatcaagggaaagttgctgttacctccaaggcccgagtttatattaaacagatttctgctcccttgtggttccgaaggcatactctgtgcttggccttcacactattgcttagtctatcagtacttccatagacaggattgatccatatatatggattgttttgcttcttgattgaatattactgagatgctactaaaagtaaatagcatcacaatctctaagaaagttatctaaaaataactatgagaatgttatctttagtgctaattagacagatttggcattttcagttatagatttttgggtagggactggggtatgattatttcaagaatagttcatctctcattcatcaaacgaagacccctgcactattttgataacaaccaaaaccataccctctccaggttccatttattttttattaaagcaagctttcttcataaggtgcattgcacttactcttttaatcagcacatgtttagtgagaacctcatgggagtactcagatgttccagaccagttatctcctcctcacagtctcccaactcagaagctgagaagctgaaatatgagtgtcttatccagtccacttacctccaggccaactgtagcacaccttcccttgagaggctccaggggacaccgttcacactccagtcccagctcctgcagtctctactgggtccttgagtacagggacagtgtcctaggcatcttacttcccctgcacctggcacatgcctgaatatagagagcccttagtaagtgtttcatgaaacacccactgaaggagtcattgtgatcagattaggcatcatagaggatgtaatttgaataagctttaaccggtgagtaagtggaaatgcaggagagaagatattccagctcaaggaggtcacatacatgagcaaggctataaagtaatgaaaagactggattactgagtttgaattgtattttaagagagaagagccaatactgagggcctctttattctcttagtcaatagatcttattgagtacttgtgcgttatttacctttctaggtgctagcagaaaaactgtgaaccgttcaaaccaaaaccaaaaaaacctctgacccagtggagctgctgttctaattaggagaaatgggcaataaattaaaaagttaattctgtatggtcaattagaaagttgtatgtactgcagagaaaactaaagccgtaaagggggactcggagcgccagacctggaggccctgatggcaattttgaatcgagtggctcagtcccactgagaaggtagcaagtgagcaaggaagacaaggggttgagctatatagatacctggaagaagagcattctgggctgagaaacggcccaagcaaaggccttgttgtggaatttgtgcctggcgattttgaagaaaagcaagcaggcaatcattggcatggtgtatgggggcctgcggagttccatgatatggggagaggtcatgggccaggtcaggtccacagttgtaaggactttggcttttactgtgagtgagatgggcagtcgttagaggtatctgagtaaagccgtgatctggctgctgggagggaagtgaactgcacttggccaggagaggaagcagagaagcctgctatgtggctgtgggaatcatcagagaggtggcagtggaggtgagaaatggcgagacccttgagctgcattgaaggtagagccagtaggatttgctggcagattggctacggggttcaggagggagagaggggtcaaggatgctgaggagaagatggtgtgtggaacagattcaggtaggggttagggaggaaatgaggagttcagtcttaggtgtgtgaagctttaaatatatattagacctcccagtggaggtgttgagcaggcagtgggtatgcatcaaaattcccaggaaaaggtctaggctggaaacaagaatataggattcatcagtgtacagacgagcttgaaggccatggggctggaggagctcactcagagaatgagagcagatggaggaaaatgtccaacaaccaggccttccacatcaagttgaaaagggagaaccagccaatgaaattgagaacaagcggccagggaggtaggtaggaagaaaaccaggagagtcacatcatggaaccagggaagaaagcattttaaggggattgattatactcatgctgccgatggccaagtagataaggactgagaaatgatggtgatgttcagcaatacaggccactgtggactctctgggtgacttcaccatcagatgagtccctcctaactactgggcaccttgttaggccctcggacatatagtatggataagtcaagcaaggttgttgcccttgtgggacttagcagccagtgagaaatgagtgatggtctaaagagttctatttaatattggtcatggctctataatttgagacctacagcaagtcaattgtataaaagaatgtgtttgcttttgttgttcattgttttcaacttgtttttaagggcaaaatgatctaacatgtgcatttaagttatctgagaaatctgagttttctcttcaagtttcttttttctgttttccaaccagttttgggcatggtattttgggcaatcttgggggacagaaatagaaaatattaagatccatggtgatatgttagctggctgtaattttctctgagtggatattttctttcccagatacttatcctacaatttttttgtttccttctttttttttttttttttttttttttttgagacagggtctcactttgtcacccaggctgaagtacagtggtgcaatcttggctcactgcagcctggaacccctgggcttatgcaatcctcctgcctcagtccccaaagtaggtgggactacaggtgcatgccaccacacctggctaatttttgtattttttgtagagatggctttttgccatgttgtgcaggctggtctcaaactcctaagctcaagcagtctgcctgcctcagcctccccaaagtgctgggatcacaggcatcaaccaccacacctggccctttttctttggcctcaatttttatctgtcttgtttcttatagggtcatgataaaaggaaggaatctttcagaacttctgcctctttaaattcctggcccttgctacagtagcatgtcatggtattagcagtgtttaagaatggttttgaggatcactattgatataactgtctataccagtataacagaatgtgtgttaaacccttggcatattgccaatgacatcccaaacacaaatgaaattctgttgcaaattctcagcttgtttgcactttgtaagagtaatgctcatgttatttcagagaatccataagttgttagtgtttcttgctcatccatcatctcatagccagttatgattaagttacccacacctttggtgcaagcatcagaactgttgtatttgatgcgccttcactaattaagagaaactcagtggtgctgggttggccatttaactttcaggtgatgcagctattggcgtttgtgtgcacattcctttcagcaaagttagcatgcgacttatctgctgtttatcgattttatgtttatcaaatattctcttttatttatttttagggttatcatcgacccaatcattacattgctacccaaggtaagtttatttctactttgttgtctttctttgtttcttttgcccacttcctatcattttgtacccacttcaccctccttcaggaagatattgcacatttattgcggttctagccatcggcaggtacactcttgccttcccatcagacattctggtcatgtaaatcatttagttagaacttcatgttgagatcattaggagaaatgtgtccatcaattccttattgaattcaatatgtctaccttaggagtaagttggacatttgcaaaagtagatgtatagatagccattccatcaatatacaccagctgctctctacacagggaactgtgctggttgctgctggagagctaggctgaatccagcaagcacccccttctcacagtggttgtgtttagtggggaagatgtgcagtcacctgtatgtactttagtaggtacagtggcaggtgacatctgtgagaggaacagatacagataaaacattagggatatttggagcaggaaggggttgctttccggtgggatgactcaaaaactgttttgtggcagaggtgagattgggaagagcccttgtgaatggagaaacatcatgagcaaagatgtggaagcagaaagttagttctcccaggtggaaagcagctggtgggtcaccttggctaaaggaaacagaagagctagaggacatgttgaggaagctcatggcagtggtttttgggtgattttcccagcgtatgaagtgggtcatctgcagatggtgggggtcatgagggagcgaggttttagagaatgaggcatcctaaaggatgagtcagtgagtcaatatgggatgaactgaagaaggagtaagaagcagagaagacccagctaaggctgaacagcacatgttctccccattttattattttatcattgttttcagcaataggctacatcccaggaacagtagcagggaagtgaaaaggatgtgatctgccaaaggttaggcatgggggcagggtgtacacagacagtcagtgacaagggaatcaacgatgccaagataattggggttggaaagtccaggcttggacgaagggcaatcagaggtgtccactggaccgtgaggagagggaaggagttaacagattgaggctgggtcccattgatgagtcatagcttaggaaaagaggcagttgtagccagagagcagaattccaatgcttggatctgcctgtgcagtagaactttctgcagtggtgggaatgctctctatctgcactgtccgatatcatagctacaaatcacatgtggctcctgcatacttgaaatacagctactacaaatgaggaactgaattttaaattttaatattgatagaaatagctacatttggttattccctgtggtggcattggacagcaaagctttggggtggaaaagctccagctatggctgaaatggagccactgtggaaactgatcctgccccatgcccacagccaccccaagaacctgggtgacaccacacagagtccacagtctcacatcaccactaggttactctgcactcaggtctagatgacctgctggagctcccactgtctttcatcatctatgacttgaagttggtaatggctccttccaaggtcactttgctagctagatgcaaagttgtctgtagagtttccagtatgaacctggcacaaagcaggccctactacatagaggttgctgaggtcttcaggaagcaaggctcagcttgagctcttacatatgggatagaacaaggatgcatgtcagagtctggtcctagacatctcctaaccctgctgcttccaaacggaattcatcaatgccgttagaggaacctgttgttaggggtttgaaattcattctgatggctttcagaatgttctgaattaagcctcacaacatcagatttaatacattctatgataatttgaaattaacagtttttgtaaattcgtgtgaaaatttgattgtaaaatacccaaaatactcccgagcttcatttctctccaataacttgattagcaagctatgttttcatagataacaagaacattaagttgctcttatttgtattttcaatattgaggccctctagattaaggtgactaaacgaacagctaaagtagagactgaaactgccaagtctagacatggctctttaccaggcttccttccctttgtccattctctctgcccctctccccctgtaagagattattctttaaagagaaatgccaatagagaagtcactttctgcagaattcatgtgagtgatacttaatagctcagtaaccctctctggcagcattctagtgttaatgagcaaatgtatttgtaagcagataagaaatagcaaatgtcatcagtttgcagtagacaatcagtctgcccttaatggagaagggcattgactaatgccctgtttaccaggtcgtggcagcctttccctggtacaaggtgggctgcagattggacttctcaaactggcagtactaacatcactgctggtggcggtgcagggagaggagggaaaatgaatgaatatttttaatctaacatgcagtcaagaatatacatatcatattaagaataatacattcataccatgatgttcagatgagaaagctagaatcttctattatataccagaagataatggactaatagccttagatcaccagtaatcaagatcactgatgataatcttcactaattggcatggacaggtagaatatgttcgtagatcacctttgttgaaaaacaaacaaacaaaacattaatacctccaagaggccaacaaaatgggcaatgaagaccaacaggcagatgcagtctttaaatgtcttcttgctctatttgtcctgtgttttgcactaacataattctttaaaatatattcacagcaggaacctatgaaactatacaaatggtgcaatttgctgacaaccagttttacttccaagagttagtaatgcacagatgttcatcaagttccttcaatacagaggacatattataaatttaagtattgggtctcctcctcccatccaccctcaattttattgatttttctagctgtaactgactttgacctttgataataatgggtgacgtttctgcaaattgaaagcatcccattcaagccagatctgttgcttttttagtattaatatgttcttcctatctccccttggtttaattgtcttctgtctggccactaatatatgatgacccaatattaacttcatcatgtctgactgaccagacattagtgcaacagtaacattcaagatttatgatttagcaaaccaggggctcaaaggagaggaagtcatgtccactactgcatgtctctgtatgtagaggcagggcagagtgaagatttcaaaagcaggctcaagtgatgggcagaagagcatgcaagtgggtaggattgcccagaagtgatcgtatttcacaatcaaaatgcaaccttggagattatgtggcctgcaagctggatgaagccacacacataagaaccgactggatagaacacctgctggcctcatggtggcagccatgggggccctggataagtgttcttttgatttttgtttggttttgtttagagacatgatttcactctgtcacctagactggagtgcagtagtgggatcatagcttactgaagcatcgaactcctgggctcatgtaattctcccacctcagcctccaaagcatctaggaccacagttgcacaccatgcctgactaatgtattttattttattttttgtagatttaggatctccctaaatctgtgttgtccaggctggtctcagactcctgggctcataggagcctcccaccgtggcctcccaaagcgctgggattacaggcatgagtcattgcactcggctttgtttagttttaattttaaaacttacctcaagagtcagataactcagggaaagaccatgcaaggctgttactgaagaaagtgctgtgagtgtgttctagacatggcttgcacagtcctgagcatccttcctcacttctaagtgagcattttccagagtcatttgtgcaccgggatcccccaagaaagaggctcaggcctggtgtggtctttcctgtgtactgcatgctcaccccccaaaaccatatggttaatccagatccagcccctgctttctaagttatgatgcttctcatgacaacacaataaaaagcaaatgttcgatgatagtcatgtctgaaaatacatgttaattattattgtcttcaatgttgtaacctgagctatagattgttgagatgcacgcgttacttttttgagtttaggtgcctcaatgcccacttcatcatttctttctttctgaactgtgctaatttgacagggttgactacctgattggggttccgaacttagccttcatcttgccatatatagtttctttttgtctccatcagcattagctctgtacagcaccctgtagagtccaggactagagagaggatctccaaacagaagcccccatgcccacgtgagaacagggagacgcttgtgcccccaaccatgttttccataggaccgcccagccatgtgcactctggcccaaatgtccctcacctttggaagacacagaacttccttcaaaactaatgaaatatcaagatcgtttccccagaaagaaaatttcatttaaggtggttcatggactacccccaccccccaattttactcatgaattatagtaattctatggacctcaggatatgaactttactttggtcagaaacattaaaagctatttggggataagacagaaaccatagacttaattaatctactttttaaaattatactttaagttctgaggtacatgtgcagaacatgcagttctactttttaaaaaaccatacttaggggttaacaaaatgtcacagattgtttataactatgtgaaatacattcctgaaagcatcaaaatttttactaactttaacaaactattactaaaatgtttactagcctaaccctgtagtaaaataccctagagtattgttataatcgttagtattttgaaccatggtcagtttgggttttacggttcatctcaggctgggttttctgcctatctgttattttgcattcgtgctgaaaagtttatgcctttgctcacctttcaacaattttagcaattataatatattagaaaatgctctctctgaatgacagagactagagtagcaggtcccatagctgatgtttattttgtaaaagcaggatgtagtagaaataacacatgtaccacagccagaaggctgggatccaaattcttgtgctgtcacagaaaaggtatttgaacttcctaaacttatttcaggtagagtcctggtgtttggtaaatagtaataatagtcaagaccttaccatgtgccagacagcattcccagcactcacacatacagagctcatttcatctttaccacaaatatgggagatatatgggattgtccccaatttataaatgagaggaaaggagacaaagaaacttgaaataatatgctccaagtcacagacctaaaagtgcaaaggccagattcaagtgtagccactgaactccagcatcaaggctcctccccacctcactatactgcctcccataggtgaccttggggattactttaactcatgtatgtatcaatgcttagagcaattcctggcatggagcaaatgccatgtatgcgtgacctgttactgtttttgagaaacagcacagaatcgcttaatcattaggaacacagactctggaactacattgtctgaactcaacccccaaccctggttcctccattggcaacttgtgtgaccttggacaagttacttaacatctctgtgctcatcataaatgaagatgaaaatagtctaccttgtagggagctatttatttattttttaacttttaggttcaggggtacatgtgcaggtttgttatataggtaaactgcatgtcatgagggtttggtgtacagattattttgtcacccagataataagcataatacccgataggtagttttttaatcctctccttcctcccaccctctaccctcaggtaggtcccagtgtctgttgctgcctcctttgtgcccatgtgttctcagtgtttaactctcactaacaagtgagaacatacagtgtttgatttttccgttcctgcgattggtcacttaggataatggcctccagctttatccatgttgctgcaaaggacataatctcattcttttttatggctgcatagtattccatggtatatttgtactacattttctttatccagtctactgttcatgggcattttggttgattccatgtctttgccagtgtgaatactgctgtgatgaacacatgtatgtatgtatctgaatcacgcatgaatcatatagaatgatttatttttctttgggtatacagccaataatgggattgctgggtcaagtggtacttctgttgtaagttctttgagaaatttcccacactgctttccacaatggctgaactaatttacattctcaccagcactctataagcgttccgtcttctccacaacctctccagcatctgttattttttctttttaataatagccattctaattggtgtgagatggtatctcattgtgattttaatatgcatttatctaacaattggtgatgttgagcattttttcatatacttgctggccgcatggtaccttttcaagcgtatctgttcctgttttttgccaaatttttaatggggttatttggcttttgcttgttaatttgtttaagttccttatagactctggatattagacctttgtcggatgcatagtttgaaaatgttttctcccattctgtaggtttttctgtttattctctggatagtttttcttgttgtgcagaagctctttaattaggtctgatttgtcaatttttgtatttgttgccattgcttttgacatctgaggaggtgtaagatctctacagcgagaactacaaaacactgcccaaagaaatcagggatgatacaaacagtgaaaaaatattccatgctcatggataggaagaagcaatattgtttaaatggccctactgctcaaagcaatttacagattcaatgctattcctatcaaactaccaatgacattcttcacagaattagaaaaaactattttaaaattcatacagtaccatagaagagcccaaatagccaaggcaatcctaagcaaaaagaacaaagctggaggcatcactttatgtgacttgaaactgtactacatggctacagtaaccaaaacagcatggtactggtacaaaagcacacacgtagaccaacagaacagaatagagagcccagaaatagtgccacacacctacaaccatctgacctttgcaaagttgacaaaaacaagcaatggggaaaggactccccattattaatattattgaataataaatggtgctgggataactggctagccatatgcagaagattgaaactggaccccttccttataccatatacaaaaatcaactcaagatgaattaaagaattaaatgtgaaacctcaaactataaaaatcctggaatataacctaagaaatagcattttggacataggccccagcaaaggggccttttctttttaatacccagtaagttgcccatttacaaaataatgtccttttttgctgaccttgaaaatatactcagacaaagcagagtaggtcttactaattgcatatgttcacatttcaaaatgtaagtagtcttatgtaaacccctaaatagctagtgacatgaacttttcatttctcacatgtgaacaaacttaaactgtgcatagttaagaagccttggaacaattcatagagattgtgatctgtggagaactggctatccagataggccccaccacatgccattgaccttatcaccgccatcactgtcttccttttatgctcagaggatccagatgcccagtgtcatctttgaggatgccaggtcacattggcaaagaccacagaaactgatatggagaaccagatgccagatagtcatttacaatgaaaactgtaaccacccatcagacagaactgccaaggtcaggcaggggcattctgtgtgaagaggaagatgccttggcagaagatcacttcatcatgaccagggcatctgaagaaggggtcggagagtttattcatgattcaataagtatgcaccacctgtcttgtagtgagttggcataaaacataagctcagtaagaacacaagaatgaatgagtgaatgagtaaatgaatggattgggacttacgatgtgccacgcaccacttagacagtagaatatctcagccaggtagagaggatggctcatgttggcccggcaaagccaaaatcctggggcagattttggtggcattatctccaacatctctgactatttctgtttcaagttaagggctggtcagcttctattcttagaaacactttctttacatatgtcagtaaatcaaatcctgtatttagagacagtccatcttgttaaactaactttgcttggctctaccctgaccctgtttgtgtaacccctgtccccatacatataatcagttttgtctgtagttataacttgtccataatttgaaaaagagaagcctaaaaagttccctccagacactttcagctaggaacaaacttttatgtgaaaataataaaaatgtggggagtgaaggtttatagtggaaatatttacagagcctcaaacactgcacaacagttcaaactttgttgtagtgccttcattctttttgctgtcaatttgtttttcttctatctttattccacatacttctggtataggtttaataaggatttttcaaaaagataaatatggtttatattttcccagctcaaaattccccttcaggcctctgaagcaataaataatagtgctttgaatgctgcactcactttcctgggcaagccattccggtagtggagggttctcagagcgtcagtgtaacttctgcacactctgtaaagcagcttttttctcttgcattctggcctccagatggagatgaacacttgaaattatttctcagtagaattgaaagaacttttttttaaatcaaaagctcagccttcagtaaacaacttttgtttttattcttccaagaaccagtgcagcttgcacttcaagtgcaaattctgtgttagctagcactgtgcttcctggcaaagttgttcctgcattgtcagtgagttgtaggttatgttttggattcatttgttatgtcctatttgagactaatttaaaagtattacctagtgaagtggagtattctctggtttccaaatttaaatagggatgctttgagaaaatgtgatttatatacaggcgaacagtgactccataaaagtcactgtcgtaagtattccagctacccagggccaagtttatacagaccctgcctgcattttaccaaccatctgtggttttacaagaaagaatgaacaattgcaattagcagcttatccagaaacttccttttaaacaataatttctcttcactagattaatttcaaaagatagttgccaattagccaaatggtcactttcatagacatttctcatccctgtgctctaaataaacttgctcattagcaatgagaacatttaaaggaagagttaaaattaaaagatgaagtaaaaaatagagcatgtcaggtaacatccacctatgttgttatagatgccataaggaaaatgtggccctctaataagagaaccaaaattaatacagaataatttgaaaataaatgatgtcctgttgttaagcaagcactcagatttaaggtgtcttaaaacaaatgctttttaaaccttcaagagtatttagaggggttcctcatttgaagtagaaaatttgtagaatcttttagaggtgacagaaactttaagaagctcacagtccagtttccttgttttgttattataacagttggcacttaaagcagaactatatttaagtgaccttcatccacataagttcaagtgagtcatatatgcaaaagtatttgcaaactgcatggactaacgttcatattttaatagagtgtgtgcaaagttcaacctaggagaaacgtcatatgttaagacagacctgttcccccatagggccttttattcaacaggaagaaaaactgtgaggttacatctttctctcaggtgcagccctttaaaaggagagagctgaaactaatacccatgtactttccaaagtgctggcttccccgtgcctctggcaacatgagtccttgcaaagcaaagctactcctttacagcctggttcattcaaaattgaacaaaggtttctgtgcacctgtcacttgccaggatcagcacacgatccggaatataccagtgacttcagaattacccagtgtggaggtataaataaatgatacccaactcttactaatttgtgattttaatgcacccacagatttggggacttcattttgatttttaattatttagatttttttcaagagacatggtctcactctgtcacccaggcaggagtgtagtagcatgatcatagctcgctgtagcctccagctcctcggctcaagggatcctcctgcctcagcctcctgagtagctagaactacagggataaacaaccacacctggctaattttttattttattttttatagagacagggttttgctatgttgctcaggctggtctcaaactcctggcctcaagcaatcctcctacctcagcctcccaaattgctgggattacaggcatgaggcactgcacccaacctaggaacttctttaagccatttctcttctccacccctaccccattttacagaagaaaaaataagaccgagtgcagccctagaaccacttttccagaaatctgggcaccaggtttctttttcacccatgggcacagtttaggaccagtttttcaaggcagcaaacagtttaggaagtttctagctataaccagtgactttttttcttgccttctcactcaaaaggaagctgctggaaatttcctcatgcaacacccttcactgccatggaaaatttgagactgtctgcactgagctatgtctagggagccaatttatctgtatttcattcatttattagatttattctcttttttcttaaataaaagaggattccacttgtgtaatgagaagagcttaattaaggaagatagagactaatgaaagcttttatttctctggcagtagcccctgaagcatatgaatataggctgttcccttcactttacttccttgacagaaggcagccagatcctttgggtcaccaaacccctccattctgaaggctgccgttcattttttttttttttgtcctcgattgccgtctctctgttcccctctttacagcatgcgcaagtacccaagctcagtttctgagcgttctctttggagaccgacactgatgaatgctctgtacctccgccagcaggatgtttctgtgctgtggacatctgtcatgttccttccttccgaggccacagcactttctcctgcgcctcttttcagctccccatgcatgccgccattcggtctgtcccagggatcagggactgaaggtccctctggaagcagtgtctctatctctgcattgtatagcatattgttgccacacactacctacccccattttattcttttctatattagagatcctctttggtgccctaatccatatcccatcactcaaatctgatgggtctgcctttctcgacctgctttctgtgtcaagaataatagaaacctttgcattccttttcacagtggtaccactgcaacctgtaatagtttacgtaactgctagggaggtccgattctagaagaggactgaatatcgcccaaaaagaatgaaatgcaaataatggtttctttcggtagatggagtttccagaaatgctttggaacatttcaattctaagagcaagtcatgctaggctacaaaccaccccattattggttttacccatagatatctctttgctttatgcaacatagtcacaatcagatctcttcaacttgttcttaaaatttcttccatatacaaccatgttttatgtcagtaactaggccaggactgtccgctccccactaaaagaagataggcagaatggttaatgaaagcctacactctagagttgcacagcctaggctcagatagcagctctgcaagtaacctctcaatagatattagctacttattgttattatcattttgtatgttccaaaagacatatctctcaatagcagagaagcagttcaggttttaaccctagtataatgtatactcatatagttttcatgaaagctgatacatcctacacctgttaatgcttccttccagaaggatgtatcaaagggagccacttaagtgtgcaccaacatcctgtactccctccagagtacaaagagtgccatcattgttcactgttaaactgtagacaaacataggttggaaagacaacagctgtatcctaagctggaaaagcatattttccttctgtttttgaagtcttgctgaaattgagcagccttgatagcagcgccagctccacgtcttggtgttctgaaggcttccctggtgcacacttaaagtcagatgacatgtgagtgaaaacagcttaattccaaagaccagacaagttccttcctaacaggcttcattgaaagcagttcctgagataagaattacacaggggtgttttagagaggagctttaacatggtaagttccttatatttcttaggaagaaaatggctattgattaaatttatctttattataaagacatactaaataatatctactatgtaattatttgtcctttttgtttttaaacatttcataatcattttaattgaataaatgattaaaagaaaagattattaaccagaaaagagaaaatagatgatggttgaagggttgtatagcatattatagacagaggtttcccaggctattttagtgtttatttaaaacctgtccgttaatgtttggtttatgccaattttctcttaatgaaatttgacataaccttttggtgtccaatcaggatttcatatgttttagaaatacacccagaaacaaacattccatgaaactaagtatgtagagaaagccacaaatagtcacatggtttatattgtcacactttcttacttcagtctgaaatgagaattttggggaatggaatgagtgaaatgtaagcatcaacatgtgggttgtgtgcgctggagaaaaggctaatcgtggatacagcggaaagtgtatgcctgattttaggtataagaagagtacacacctgcaaggcaatttagaagaaattgggcaaacagcaagtacccgccaaccagagagggccaggtgaggggaaaagactcttgtcacaggaaaccctactccagttgagaagagatgtgtcattgtgtggcatcactgtaatttattaacaaaacactctttaacatttattatttaagtcatcactttcaacactacttctaataaggtatattttattatagcttttctcttcttttactgtcaccaaattgaaattccagtggaccagtgaacacttctaaccctattatgtaattctaggcataaagagtttttcgtgtgagagttgtccttagaaaatgcgattttaacaggccagttatatttttgattttaggttaaagtattgccgagttttccccatcatagaacaattctcagtgtgtttgcttgtaattcattagttgatttccattgtttcctttaaatggtaattttcttgggatattcttagcaattcgggataatgagcaaatcatgtcccttgtacccacccatctcaactttgcttttccttttctgcagctgaaacaaaaaatatttcatgaaagttgcatgattttaacataagtagcctcaggggagaacaaatgcaactatcaaataagtgatgttaaggattattaatgctgaagccaagtatattctgtgtcactgttaccacttctgtgacacatgaggcagattcagtttgtaaagcatggtggcatattttaccgtttacatctcactactgtaaaaatgaaaagctactcaatgtaaaattatagacttaagtgttatggaagcatcatattgaaaaatcacataaagctttataataaaaacttagaaaaccactgaagggacaactagttctctaaatgttgagtaactgacttcgtaacccttattatagattatcaccaacagcaacaggagcaatcatggatcaaaaatttaggaccacttttattcctgtagcaagagctttaaaatgaatgcctctcaggctcatcgtcttctgtggttaagtcccaccttcagccatcttcattgctgatggagggaactggctgccagtgcccaaaggagggagcccaggtttcctgcagctgctttgccttaacatccctcccctttcccttcgcacttctgccattcagtgtgtacccccacccaccacacactccctccttcaggtcccagaaccacgctagaaacaaacattctggtgatgcgctcaaacgggccctggtctcgggcagttcagttcattctgcagtcagaatagtggtgctgggctgacctgaattggaattccagctttgccacatactggcagtgctgctgtaacaaaggcacttcatctcctaagcctgtttcttgggctggagtaggtgcctcacactgctgtgttggggaatgaatgagatcgtgcatataaagagcagcatccagcacctgcctggcagggagccatctagttgtacctatttatttgtccaacacccttgtcctgggttccccttattccagcctagaagccttggttctcttattgctgacagagctttagggatggcaagagtcccccttggttttaacactgtcttcctagtacagccccagtcctccctggtctgaatcaagaggtcagcctatccaccaatcccctggttcctgagcccacctgagcctcattgccacactggggagccttggagcccacgctggccctgccagccacacgtggccggcttagggcctgccccctgccctataggctctgaccttcctgcccccaggctctccctgtgctgagccatcacctgcagccacattgctgctgtctgttggattcccgacccatcaccacctggacatttctgctgcagatctccgccagccatttggatgcccagggagctgttcttgccataataattgtaaaattataaaatatgtttaaactttgcctctcattaatcaatacggaccatctttttgttcactgttctttactgttcacattcaacatattcctgtttcttaggagttgttttgttcaatggaaagagtagacccttctgctctggacactggcgtctgtccagaacatgcaggagagctcagtgggagcctttggacttggctttggatagctgggctcagtttaccatttctctcagcccaccgtaccttgctcctcctgttcccacttcatcctcagctgctgatggctggtcacacctaaggctgagcccacacctgatcaaacctccttgcagtacaggtgccccccgtagagtccgttccaacaacaaaacacttcttcctctgttttctttctctgatttttcccgagctttgattctaaaaccggaactttccttagtcatgttttttagtatctgtcatggttgtcttccactcctaaaatctgaacttgcaaatcttatcagaattttacatttcctacaagagggccccatgggagtctccttccctcccaagtggcaacaagtggctcctgctggaggacctgctatccccaccctccctcccctctcccctccttcagagtcataccctgtcctttgagacctatggcaggtacctgacttcaacaatgctagtcctgctactgcgtcgccagtcagacctaagctcttcctgactttgactgccacaggcatcctcatacatcagttaccgaccctggccttcagacttttcttcttgtgtatccccaaaagaagtttgaagaaattatgcacctgctctaaacatttgagtttgatatcgaaaactttcatcacatgtttatgtaagtgtatttgttaataagagatagacagtatgaaatactttctaagacaaaatgaggattggtgtaattaagataaatattttatgatatgtggtgttttttaactgccttacagattcaagcataccaaacctgaaagaaaactcatgaaactttcacttacgggtttcatccaagaaaatttggctctcctcgaaagcattctggttccatttaaaagagtaaatatggccaggcgtggcagctcacgcctgtaatcccagcactttgggaagctgaggcgggcagatcatttcaggtcaggagctggagaccagcctggccaacacagcaaaaccccatctctactataaacacaaaagctagctgggcgtggtagcgcacgcctgtagtcccagctactctggaggttgagccaggagaatcacttgaacccagaagccagaggttacagtgacccatgatcgcgccaccgcactccagcctgggtgacagagagagactctgtctcataaaaaataaataaataaataaatagtaataaatattaccaacctctactgcttcaagggttctgagttcagaacatcttaacataagccaaaatgctaagttttactcctcacagaattgtttcagacagggaagtgagtttctggagccagaattccagcccaaacctgtaggtttttacacctgggcagtgccccatggtcatatttgagataggtggtttttcaagtgtatgaaagactattgtgaggctggacacagtggctcatccctgcaatcccagcactttgagatgatgaggcaggcagattgcttgaatctaggagttacaaaccagcccgggcaacatagtgagaccctatctctaccaaaagtacaaaaattagctgggcatagtgcctgtggtccaagctactcaggaggctgaggtgggaggatcacttgaatcaaggaggtcaaggctacagtgagccgtgatcataccactgcactccagcctgggcgacagagctagactctgtctcaaaaaaaagaaagaaagagagacagacagagacagacagagagagagaaaagaagagaggaggagggggagggagaggaggaggaggaggaaaaagaaggagaagaaggaggaggaggaggagagaaggaggaagagaggggaagggaagggaaagggaaaggtagggtcacacctgtaatttcagcactttgggaggctgaggcgggcagatcatgaggtcaggagatcgagacgttggtgaaaccccatctctgctaaaaatacaaaaattatacaaaaattagctgggcgtggtggtgcgtgcctgtagtctcagctactcagaaggctgagccaggagaattgcttgaacccaggagatggaggttgcagtgagccaagatcacgccactgcactccagcctggcaacagagcaatcgtcaaaaaaatgtatataataatacattttaaaaagaaagaaaagaaaagagaaaagaagtggaaagaaaagaaagactattgcatatggaggctggagactcctgcctagggaataagttttggcagagtccttatagatattaagtatctggaaattaatacttgaaaaactactcatatatgccttagatcgtctttatgtatctccaagggtatgcatagctcagtttgaggaggtttttttcaattttttgagacaggtatgttgcacagactggtctcaaactcctgggctcaagcaatcctcccatctctgcctctgagtagctggaattacatcagttgaggtttaagtgtcccaggatgtttgccttactgtactttacatgagagtgtgggctgttcttatcttatctctaccttagaaaatttcaagcttctggatggtggagaccatgtatgtattactcacctttacatctctactatacctcacagaatgcctggcatttaacactaggctgagtgcttaactgctgcacgcaggggtggccactcatacccactggggccaggacagtggtataaacgaacaaagcaagttaggcatgaggccacgttaggaaaatgtgcatggaaaacacactggcagcacaactcactttaaacatcatgaagaaacagggagcctccacttgggtcttggaaaagtgacctgaggaagtgacttttggactgctcagctgaaaccagcaaggagatgtgcaggctttaagtgacgcatcagcagaggggggtcttgcgggaggacgctgggaaggagcgtgagggagatagatggtcagggaggggcaggtgccctgacacagtccaggcacagactgtgtgggaccgcatttgccttattaaagaatttagggcttactctgagagcagcggaaagccgtgggaggatttatgcaggaaaatgacatgtggggtttacagtcttcatagatgagccctggctgagggatagggaacggattcaggggaggccccatgtgggtttggggtgttgtattcatccacttggtaaataggtgagttgtcatggtggctggggtttggagggggacagaaatggagtggaggaaacagggtgtgctgtgctcttgaagtagtcctaccgggtaagcacagacgcttgggggctggctgtgcttgtgaagctgaatttgattctgtatcagtgggaggcccttggattggagtagttaaaggagggaagtgacctgagatcatgtaccctagaacttaaagtataatttaaaaaaatatatatatatatggaaaaaaattaaaaaaaatgaaaacctagaaagatacaaggttctatgtcattacattaaaattgtaatgcttaaaaaaaaaaaaacacctttaaagaggtggtttcagtgtggttaatatgggttctctcctgttttcttcttgccgggattgtgaggactgtgtggtacacacctgtctggtagagcccttctgagttgcttccgatgttcaaatgaggcggtatgatgtaatgcagtcagacttctggttcaaaactcagccctatagctcactagctgtgtgaccttagacagcttgtttgacttcccagtgcctcagtctccatcagtaaaatgggggtgagcaataggacctatttcataggatggtgttttctaaatttaatgcaatagtacatgtaaactacttcaaacaggacctgggaaacagtaagtgtttaagggacattaggtattattctgtttatgatggaatgccaatttgtacttatattatctttctttacttcaaaaaactcgaaaatgccactgtgagcttaagggaccttgacttctcagcagctctagttaatgtagaaaacatagtgtatagaaattcaaatgtgaaaagcaggggtacaagtcatcaaggtttgaaaatgatcatttttatagatgtaggggtacaagtgcagttgtgttacgtggatatattgcttagtggtgaagtgtgggcttctagggcacccatcacctgaatattatacattgttgaaacgatgatttttgatatctctcacttcccatgaactagagaactcatcttatacaataaagcccatccttgaatgtctttcattaatgcttttcattgcttgttaaaggttaatgttttttattgaaaaaaaaaaacgttccgcccccttttttttccctttggggcttggtggtggcaggaatggccccctgcacctttccttctcagtagaggtctctgtgtgcctgccagctggaggagacggaatgtattactggcctgatattatagaaatttctagatgttacctttcagatttcccacagggggacaactgctgagattaaccgtgttgcctattgtgcaaacatctgtaaacgcaccaccacagcaattgcagtggctccccgccagccagaaactgcggaaatcaaatgccctgtcttgcaaacacatctgttcacaccttgagagagggaggcttttcagagctccttgctctgaaaaatcttgggagtttgtttgtttgtccactctgtgagcaatccacagtgatcttgggagtcagaggtcaaaggcaaaggcttactgacctcccatgctgttccccctgtctttaggtccttcaagggcatgggtgctaagaggagcctccctgtgtaccaggctcacatctttggacttgtgatgttggctcatgatggtcgtggtcactcagaccccaccaccaggagctgctgaatccaaatggagtagctcttggtgacagtaaagtccacccctcccctggcctggtagggtatgttctgattttgccaggagacaggtagctgagtaatacttgagatcttgggaaatgatttgaaatatgtggaagagaaaagaaaaaacaggattgatacattctgcattaaaaaccttatttgggcaccttccctattttctaccctcaaaaaaaaaaccccacaaaaaacaggatttgaatgaacatttggaaaaatgcctggaatcatcagccacgaatcaccagtgcccacccctgagcaattttactgtagagccaccacagtgaccaggccagggagggagccatgcgtgtggcagaaggaacggccgccaagtgttggctgcacagcgccccgcgcctgcaggagagcggagacaggagaaagcgaggccagctgcactgcagggagatgtctctgcctgtactttttttttctttctgggatctatttagaataatctttgtgttcaatttcatttttagattttaacaccgaattctttttgttcttctggatccacatatctaattttagcattgaaaagaatttcacctagtttatttttgtatcctaatctttttttagcgtaggtcaatggataagaaaatcacaaaaactaagtgtatattatcagccaagtgagctgctagtgcttataaacaccctttattttaaagacaatgcgaatttcattatgtaaacatgtaaaaacccaggccatcttaactgatgcccagccgcagaggtgaggtggcatggtcatgttcctagatgacatgttatgaatggagttccttctacatccgagcaaaacaggattccatgattcacagagcttgcaggcaaggttagactagtcaggagattcagaacaaacaaatctttggtgtttcacagttacaactccataggagagcacctgatggttatactggaagacgaagccgatgtccttgatgctatagatcaggagagatctgaaaacacacccagacccacctccaccccaacccagttcagtcagagtctcttgggttaggacctgagaatttaaaaaaatctccacagtaattttaataagcagctagagttgagaaccattgcctcccgtggagaacagtcactgggaagctaggattgtactgtggttacctagggtgatggactgagctaagctgaaagcagagccttgggtggggaaactgagaggagtgatctgtatagtgcttgggagcagtggtttaattccagagctccaaggctgtgctgtgaggacagtgataattatgctccttctgaagaaatccttgcagaagatgtcacctttccatgaattgaaaaggaggaaaggtgctgtgttttcaagcttctccagataatcttagaaatgtaagtcgagaaagggaatcatacaaacatcatgtcttaatttgacttagtacctagtatgggtttaacataacactgtcataataatatggtttacacacatgcatacagacttaccatccattcattgattcactgggttcctgctatgtgccaggcatttcctagggcactaagaaaacagcagcaaacgaaaaaggctgagttcccctccgggaggggtcttacaccgagcaatcccagaatgtcggctggcaagaaggggtgagtgaggaatatgctggaggcagaatggggcccctagcctagagtgcctatgagaagacccctgttgggccctgacaagggaagtggctttgctcttcctgcaggcacaagctgtccatgatgctgggacctctgattcatccactggagccattgtcatcagaactatttctggaagtttctgagtaggtggcacagccctgtgtacctagtgaagccccccccccctttgattcaggggtcacattgggctgtttgcgcaaagaaggactcactgcttctttttccccttgtgaataagtaacaagctgttaagtacacaatgaatgtacctctctgcaagccagaactgtagtgattgatggaatccgatgtttacttgtcccctctgtaaccttagattaaagtcactgaaatcttcagcctctacatcaggagaatggcacgcacatgccaagggacgtggccaaaatggctggtggagctttgtgggaggcagagtgcatggtcccttccccaaagggattagatgcagagacatcaggagagcaagtcagcttttatggggagggtaacagtgtagtcagaagcggcaagggagaaatgataggaatttgtgttgtggagagaaaggaaggaggcctggacagggaggaaggagaagaaacattacacaagaaccgattgctaattggtcaagagggatggggagtgactgaagggccccttgggtgtgtcactattgttcagtgtccaggctgctgcaaaaggacagctattaataaacatcgttaaatgcatcttgttttctttctattgctttgttgtttataaaatgcctgagtatacattaattccaagaatcctcaaaataactttgagaggtgttactgtgatcagtatataaagaaagaagacattgaaactcatagaggctaagtaacttgcccctaatcacacagccagttaaaaggcagaagcaaatctcaaattcaaatatttgagctccagctccagcaatctgaaatgtcaagatacctagtacaattgggttctggtcctggatgtgcctgaacatttttatgatttcacatatatcatgtgactctccaagcctttgaagttgcatttctctcatttccttgcctttctacatgtcttataaagatttctacgcttacatttataccctcaagtatgcatggacacaaagtcgagtttgggtttttttaaaatctggattaaaagaaattttaaattccaactttctttacctgattctctctgtagcactggccttttgtaatatatatttttccagccataggaaagagctttttaatgctcagatcccaagagctaaggaagtagatggctatttatgttctgccaggaatctttatgttcagtgagaggaagtgcaactgcttaaaactcttaacttctctctctcactttagaaagtcaagcagaaaaaaaatggattaatttgacagatagcacagaataagaaaaatattagaaacaagaagaggccatttttcctatagaggctcatttcattctatataccacttccctgggatatctgctaattgttagcagaaagagtaatgttatctattttttaaaatttcactcttgagtactatggagataatagctaaatgatggagaaataactttctttcacggtagtagtttaagaagggtaaaaagagctcaaaggcagatgtttgatgacatgagaaaattcagcgacaaatgacaaatttgatatttctataggtgcagttttagaaagagtatctttttgcattgacactagagacctgtgtccatctgtacaagtgagggaactgcatgtgggtattaatagatgtatttgtaagccccggaaattttccagttgaaacttacaacaaaaacaaaaagtttctgttgtgttttgctgcagggccaatgcaggaaaccatctatgacttctggaggatggtgtggcacgaaaacactgcaagtatcatcatggtgaccaatcttgtggaagtgggaagggtgagtggaccgtctgctgcaaatggccattttgttccttgcttagttggtaacagaaagtaaggcatgaggcaagcttttgaactattatgtgtactccccaaaacattaactactccagctcctcctattgcttgctgcacttgcttataaattatcagtaaacatagcctgaattgctttcatttgttgcgatagcaacagacaggaaaggcactcaagatttaaaagcagttgttatcgggccatattgagagcacaaaaatacctctaagcatgaatgctgattgttgagtgtcaaaactcaatgggtgctgcattagacatgactaccttcccaaactcaagaaaattggctctaaaaacagtgtgcagctctagattcaatccttagattagaattccagcatcttctcttgcttaaattggcctttcctgtgtctcagtttccaaacctgtggaatggaaagcatcatctttctgaaggtcttgtactaccttctccgtagtaactgtttatgagcagtgcttttatttaaccaggaaacttttacatagttgtaatctcagtagtagtatgctataggattatttccaaagtgaaattttaaaatgagcaaacacacagcgtgcagttgccttttttacagtaggttgaattccatggttgtgctaactgaagagaagttggcatcatgagatttgccctcagcaaaggcagcctagaggttatcctagaattgaaacagtgagacaggagccataaaggggttgtctcttaagattctcaggtttcaggaggcacaaaccaggaagaagaaagacatcacaattctctcataatgagaatattcagtaagtaggatatatatatatatacatacacacaatataagtaggagatatatatatgtgtgtgtgtgtgtatatatatatatatatatatatatatatatataaaaaaagtggcacataaacctgaaaatccccctacagatatgtgtaaattctatataaaaatataaatatgtattttaatatgtttatatgtatatcacgtgcatatgcaaatatatatattttaaatgtttagcttagcccttaataaagacagctactacagaccagaaataaagtgaggactagagatcctagggagtgtagcgcttgcatgcacccttaggaggctgggcagggggttctgtgtgagtgttgggggagggtgggcagcaccagtctttgtgatcttggatcccgggttttaaagcccactgagggcaggaaataatgtggacacgtacaatgctaagaatttagatgttgactgccacacagaaccaaaacccacaaacagtagaccctcagagaaagggcaaactggggaagtggaggtagggagagggaggagggagaagggagaggagcaccagccagcccagggaattggcaaggaagttacaccattttcacttaggtaggatctgtgggggtaaagcacttcggccaactccagggtcaaagtaaacacctaataaaatcagaaaataattagaactgtgaatcataaagtatcatgatagtgttaaagttgtcacatgcaaataacatggtaccagagaaggaaatacatgtttttaaatgttgttattagaaaagaagaaataccaactaagcatctaattcaagaagacagatgaagaacagagcaaaaccaaagaaagaaaaaaaggaaataataaacatgaatagaaatgtattaactaaacagcacagaagcaataacaaagtgcaacaaaataaaaagctggttttgtgaaaaggttaataacatggacctctggcaacagatcagaaataaatagagaaaaaccacatatagccaatagcagattttttttgtactgcaatagaataatatgaataacaatatatttgatgaattaggtaattttctagaaaaatatgactttccaaaactgactcaaaaagaaacagaaattctgagtagataataattatcttaaactcgaattctggttaaaaattgacgcatggaaatgtaccagtgtatttataggtactaaatattcaaggaacagataattcaaatgttgtaaatgttaaaaatatataacattttataaatatataaaaatacataaattatatacattttataaaaattattctaagagaacagaaaagaaaacttgttcccccatttcattttaagaggttagtataacctcaatatcaaaaccagacaagactacagtaaaaggtaaaattataggtgccacacatagataggaagagatgaatagaccagtaggtccaagcaggccagatgtaagacaccaaaagcccaacatattaaggaataggataggaaaatgtatgatagtaagatttacgtaaaattatctgtattacaaagggtataataagtgaccagacaaggggggaggtactatggggctattatgcaaagtttaaacacttccagagcaatattttatatactaaaagtatagaaaccatttctttctttcaatgatgtctctgccgggagccagcatgggagtgcaggtgagctggtgaggaggctactgaggcagggaggaccaccagcccgacctagaagagggtgctgggcctctccttccacagacctttctctggaaagaggaaactagcagtactgtgtgtccacctggttgggctgccataaccaaatgccacaagccaggaggcttacacaacagacatgtactatcttcctgttctggaggctggaaagtcccaatccgggtctggcaggattccgcttctggtgcaggccctcctcctggctttcatgtggccaccttcttgcggcaacctcacgtgtcagagagagcgcacgctctgtggtgtctcttcttacaaggacacgaatcctattgggtgagggccccaccttaatgacctcatttaaccatcattatctccttggaggcctatctccaaatacagtcacacttggggtttagggcttcaccatttgagttttgggggtacacaaatattcagtccataacagcctgcttaatggggttctcgtaaagattcagtgagtttccacatgtcaggaggttagagaagttcctgcccattccgaggactcaataatacagctattagtgtaaccgtaggtttccaccaacaaacctaagactgaagaaaaagaccctttttgttccgcacaccaaatctacctacttttactatgaaaacattaatgactattgaaaaaaaaaaaggccaactccactggaaagcaagttccttgaagggaagagatggccttgctcagcagcctctccctccaggcccagggccctgagcaaatgcccagcaaggtgaataaagagagtacctcgccatagtgtcacggagcacaccagagccacctcatgtagcctaaacatttcatctgctttcatgtgcttgtgtttcttcccctgagaggtatagtcccatctgactccttcatttacttcacacatccttgctgaccacccacatgtgatggggagaaagaggtacctggagcccactctcgggtgccttcctttcacaatcccagcactcccagaaagttgtgcacccgtgcacacgttcaatatttgcactggagctcgcttacaggaagagtcctcagtaaattattttgaaaagtagataattgctaaataacaactattactggatttttaaaaataaaggcacatgtattttttgcttaattggaattccaaaggacaccactgtgtctggactcagtggcttaaaaggttaagctgattttgtatgatacagccttttactttaaggaaagatgaggacagcatagtctttggttgaaaagtcaaaagaaaattgtgctgtaaaattactgcagcaaaaaataataattacacactaaagcccactgtgtctgagacatggcacaatttgcagggagccaggtttcattcagagcgacctgggtttagaaaaggaatgaaaatgctatgcagtggtggtcgctgttccttccatcaggcacctggacccgtcacatccagggtagtcactggtgatttttatgacagcaactattccttctgacaaataaccatggaaattttgtttccaataaggtgtggctgaagtgggtggtggtaactaggtttctggtttacccataaatctaagtccgtagatttaaagtaactcaaccatttcaggtctggtaaggttattaaaaaaaaaaatttcttccaaatccttaccaggtttgtggggacacgggtaagctctgaagaggccccacctcattgccatcagccccttggatgggcctgactttagtaatgaaattatggcatctgtccttgaaatgtctggcatgatttgggggttttgacaagaggtcatgttccctcatgggaaaagcactctccttgttccaggctgtttcccattgttaatcctgcacatttgtttacagatagctcctccatttttagcttaaaaacaacaacaacaaaccacccaagaaatcaaaatgacatggtttttaagggcaatagctacctacttaacatgtgtaccgcacatagtgcgtccttcatgcattaagcatgagctaggcggatgcgtgtttgtttacacagacttgctgccgattcattaaggcagagctggggacctgcttccccccattttgccctgaagcgctctgcattaggcggccctaattgctggtgttggagccgccaggagacctttcctgtcgcagcacctggtgcagaagacacagatgctgcacttccctccagcggggtccccggtacatctgccaggacctgtcattatctaagacttccttgtcaccaccatgcctccccttttagcccacgtgttctgggaagagacccttgtcggttttcctggcacctgccaccggctgcacacctggcattgaaatggcgctggaacgtgttgtgattattttccctctttaatgaacccacctgagggacatttagtttcttaatccagtcgcctgtttcccaggcattcccatttacaccgtttgtgtggagattcaaaaactctgttgtggtattgagctgttccatctgccagaagtcttataaccaaatctgcaggactcccaaaggagactttttacaccggtaatttaagctaattatttctaaacatatttagtcagttttatgaagacctcattagaatgtgactgtttattaaaaatccaaatgaggtctcacagtcacttaggaaaattattgttgagtcactctgaatagttctgataacagaagataaaatgttttggagctgagagaagtggggaccagagctgtggacctctatcacagtaggggatgggaagaaaccacctacatggattcttggatattttccacccaaggagcctgccctaaaattcctctcacagtacttgtcactaaaagagtcatgaaaggaaaagtttactatgaacactagacgtcagaactaacaactttctaattcacatacaaggaaggtatattaagattccaggtgcccctctcacagccaagaaaaaaacatcttcttttgtgcaacagccaccagacccaggatcaatgaggaagcaagagagaggcaaggttgcccttttataaaaagtgtggaaatactggttaattataagaataaaaatattagtaatcgtttttactacaaaatctcttgagttgttccaagacatcaaactcataagaaagggaagagggaaattgtttttatagacattgctgacagttttccgtcttgagcactcactgttactttcataggtcctttttcataaactgatatttaagattgatcttttgtgacctgtgtaattacagtcttagcctttgaataatttatgctcattcagcaaacactcctcatctcaatctactgtcatcctttcgcctatcataggatgaagctgacataagccttacctccctcctgcatgttacccctgggcatttaactgctcattggccatctctacctctgtgtcccacaactggcacaaaccaagcaccttagaaactaagcttgtccattcatcttcagactcctggtccccagtacctattcttatcattcaggcttgaaaacaaatttcattttgtactcagcccaatccaatgtcaagccataaaaacaccatgtgaacagcacacctgcctcctgttttcaaggtgcctccagtgcagcttgggaattcacagtctttcatatcagtcccagtagcagcgtccccactggtcaccctggtgttcacactggtcaccccagcatccacagtggtcaccttgtgctgttgtggtctcagaggccaaaatggatgccccattatcaactaagacagaaaggtgaaggaaacagagttacctacaggttgaaggttcagggcctgtcggggcaaatcctctaagttcctatggccaaactccctaccaataggagctacagctctgagtcacaacccagaccactgcaactctgattggccagaggaccagccttgaaaacactctttcctgataagcagctgtagaccttgagcccatttcggcagctcatagaggctgcatacagactgtctttgtgtcccatagctgaccttttgatgtaaagagccaaatgccattttcttttcatggtaaaaaccccaccccaaagtgaacatgggatgtatggtacatgtatgtttacctattgcacatgtgctcagctccccttataaatatgtatagctttccccccaaacctgctgatatgtatgactctgttgtgtgatacagacctggtgaggcataaaagccaacctgtccttctttctgaagagagagcaccttcagtccatgctggagactcttcccagcttgcaaaccgataacccccataaagctctcctttctactgtccagccatcctggtggtcttttagacaacaccatcttctatccattccatgtgtcagtgctgcattaatttttataaacattggctcctgacacaccactcatctgttcagaatccttcagtgattcctgtcgaatccagaacaaagcccaaacctcaagatccctctattctgtgccttcacagtgtggctctagtctacggcaagcttatttcccagcattctcttacaagtgtttgaagtgccaggcagacaaagtatttgccatttgccacacacgcccagcactgcattccttgtgcttttggtgctgtctggcccatgcacagtggagctctccaggaaaacccctgccagtttggaatgctctaggtctacacagtccctgcagagcctctagtcgcaggggtctactgagtattttcagtgtggttattgtgactgagagattgacttctgaggtttatttcatttgtattaatttaaattgaaatggccacatgtgactaatggcttttgtctgggacattgcagggacagcacctccttgccttcctccttatgcctgcttaaccagggcccttcatttaatactaattgaaaattccaccctttctaagaaggaaacccgacctgattattcaactggctattttatctccctcatcagcatcctctctgtatgtcacttgccatattctgtcctttagtataagttttagcccttcctcatttatagtaagtcagtcagagaatcagaaggccttggctcttcccatgcccattgcaacatctctgagccccagattcgtcatctgttaagcatagggaatgatgcactaatacccttctgtgtcacgggattactgtaaggattacagaataaattgagcatctgttgtgcctgtttccacttctgcaaactcaccttctcagccattcctgtgcacaaccaccaggctgtgggtccttccaggtaggcccagtagaagcaattggtcaagaacctttccctaaatctggccacagggacggcctctctgttgtcagagatggtggagtttgcaccttgccttgaattccttcaattctgtaggtcatgaattatctgtttctgctggaaatagcagcaattcctaaactagaattgctgtaactttaacacaaaactagaagtcaaagaggagattggcagtgtggcctgtgatgattcccatccagacactgccaggcttcacgccactacccccagcacatcagccaagaaaggaggcactaacgaatactgagctatcagcagcaggagaaaggccttctacagactcctcaacaccagctcctccaggaaagatggttccctggctgccctggtgaacctggaggttttctctgcctgaaaacctcagttcccctctgtaaaaagttcaaccaaagagctcgatttgtcatgttcacaaattagcccaaagataggctttttaatcccttctcagcacaatttaacccaacatttagtgctgtacttactgtatctatgacactaataatccaaagatagttataattcacttgtcctcaaagaatatcacctgtggtcattgagaaccgtatatcaacaatgaactgtgatacatgttcagaatgtgatagtaccaacaaagggactcattctgcctgtggcaatctaggtcttctcggagcacgtggtaaagagctggaccttagtaggaggaaggattttattttgtctttattttagatttagggggcacatgggcaggtttgttaaatgggtatatttagtggtgctgaggttagggcttctaatgatcccatcaaccaaacagtgaacatagtccccagtaggtagtttttaaacccttgccctccttcctctctcctcccttttatattccccagtgtttattcccatctttgtgccgtgtatacccaacgtttagctcccacttacaagtgagaacatagtatatttggttttgtttctgagttaattcacttaggataatggcctccagctgtacccatgttgtaccaaaggacatgatttcattcttttttttttctttttttttttttggtttgttttttttttgttttgtttgtttgtttgttttgttttttgagatggagtctcactctgtcacccaggctggagtgcagtggcacgatcttggctcactgcaacctccgcctcctgggttcaagcaattctctgcctcagcctcccaagtagctgggattacaggcacccaccactacgcctggctaactttttgtatttttaatagagatggggtttcaccatcttggccaggctggtcttgaactcctgaccttgtgatccacctgccttggcctcccaaagtgctgggattacaggtgtgagccaccccacccggcccgatttcgttttttatggctatgtagaaaatgtgtatataccatattttctttatccagcctaccattgatggacacctgggttgattccatgtctttgctgaggaagcattttaaatggcaggagtgagacagtaaccacttcagcagcataaggaagggaaagcacaggaaggggaggaaatggcaagatggagaaagagctagtggcctgcctgatgcagctgatgagggaagaactctgaggccgggaagctaactgcaggcttgttgatgaggatttgaaatgtgtttctaggaaggaaggagaggtagcaagtgggcagtgtgtgtgtttgtttgttcactttaatggaaggcattgaggtagtgaatcgtgttctaattggtattgaaaaacaatcttggtgaccattaagaaaaggctgagaaaggctatggaagagtatggagacacgtttaggaggttagagcaaggctctaggtgaaagatgatgtgggcttgagtttgggcagaggtgttgggagcttatgaggagtatacagtttgggtgttatggtgggtaggtggtgctgataaggaaggaggagaacttgagaatgaaccagggtttctaccactgtgacttgggttgctataaaggatattaaccaagaatgggtatctctttccagcccacccccacacccccaaataaaagtaggtgtaaggagaggcaatgtgtttcatcttggacatgctgagtttaagaagctgaatgagcaataatgtggtgctttccaggaagctcaagagagagatgtgagctgaagacacagaaacaaactatgaaatattagcgtccccctttattcacaagcatctactgtgtgttaggctttggctgcactgaggatatcaagatgaaaagacatggcacaaactatgggacaaaaaggcaaacaaaaaagagtataatgcggctgggcgcagtggctcacacctgtaatcccagcactttgggaggccgaggcaggtggactgcctgaggtcaggagtttgagtccagcctggccaacatggtgaaaccccatctctactaaaaccacaaaaaattagctgggcgtggtggcgggtgcctgtaatcccagctacttgggaggctgaggcaggagaatcgctcgaacccaggaggcggaggttgcagtgagcctagatcgcaccattgcactccagcctgggtgacagagtgagattccgtcttaaaaaaaaaaaaaaagtgtaatgcaaagtgataaccactgcaacagaacagagttcttgggagaaagtggaaagagaaaagaggaggactcacaacagaacactggagaatatctgtttctgggggcagtcgggaggaacagctgggatggagtctggaaaaggaaagcaagaggaatagggcgagaacaaagagacccagatcatgagaacgaagagaagacagcatttcaacaggaaggggatagcgaccaggtcacgagctacagaaaggccaggtaaacaggaatcagagagcaaggtagagagaaagaatgtactgagtcaggcatcctgctaaatgtttcacaagccctattgctcttatcacagctaccctgagtacatttaaagattcctatttttaaactaagtaagtaaggcttggtgtggttaaataatttggccaagggcatagagctagaattgaaactttggtctgtccagttccaaagcccatgctctctccccattccacagtgccccccgttagcactggagatgtctttggtacgtaccaagttcccatgggatgatagaaccaggaatccagcagcagtagaacagtggctaagtgtgcagcaaagatgcaaatgtagcttgttcttggagcagcgagtcacaggagagagatgaagcagcacctagaagggaacagggtctagacagtgattataatggttgggagtgtgtttttagtgatagagtagacataagagtaactgggagtctgaaaagaagatgtaattgccttctcaaactaaaggtacaagaaaaggggaaaagtgacagaggaaaatcacagacaagacagaaggggatgccttcagttcataagcatatgctgcattcacaccactcaatgtgcagtcacagaaagccagggatgctaagacaaattaagtgtgtccctgtacacagggagggggcatcaagcaaagggatgaaattccgtgataaaggtttcacagcatgctgtggaagttcatgaaagaggcacctcatctagctgtggagttgagtggaggttgaagggatttgtcaataaatgcatctcagaacaaggggtgcctggtgctgagtacaggaggtgggagagcaaatgaaaattaattggcaaaggagggagggaaggtgttccaggcagaggcaaccacaggaccctggagggaagctgcagggattcagtatgaaccaggggagatagggaatggggattctagggagaactgaggccttgtcatggatataccacgtcaggaattgggcttcagctcatgaatgacagagagccccaaaggatttgggtgtggaagtgacaaggggaaagggccacactggagatactgcagagacagagtggatcatccaaaggcagaacaatcagcatctgacttaacaaggaaaaggttactggcaaccttttgcctcagtgttttcagactgatggcctatctgagttctttgattacatgcaacagaaatcaactctggctaatttcaggaaaagggaaaagaatattataagctcaaaatgttgatgtgaagagtaaggcttacaaaagataggaaagaaggtaacagctccagagggctagtgagccaaatgggtctcacagccagacagtctagtcaaggcgctgatgctaagacagtgagctctctggtctctttgtcactgtgctcaggattctaataacaaggatagaacctccgactcccaaaggttggttcatgtgctcatccctcgctgtccagggcctctaattgacaagccacccaatagggaagaagtaattccccaaaaggaagtcaaggatccattaggaaggatgaatggatgaaatggatgttgacagaccaaatgatgcattcagtacaaacggcaagcactgaagccagcctgcagccttgaggcaggagtagcaaatgaggatgcatagactgagtgtggacttgacagaagagaggagtgcagctgtaaacagaggagcatttctgatcaaaggatatttataaggtgaaagacccttgacagtagttatgtgttaaggaaaagaatcagaagagagggagagactggacatcttgggaagtggacggagtctttgccagggagccaggagggaagggaccctgagtgcaggtcctccattcaaccttacaagagatgacatcttttcctctgagcctgcagagcagagacaggcgtggacacacttaaataaattgaaccaaacagaaacacactcaggatggcaccctctcctggtaacagtggttttcccagtgtagtaaggaacaaggccatgggctgagaagctggacgaaaagggaagtagctattttagggatgcatcaaggacataggtaaaggtgttcgcctggaatgggagtgacctcttctctggggagaaggtaaggatgggcagatataagtgagactccagttggcggctacaggatgcaggtaggtggaatcccaggacagccaatagcccaaatcctccaggtactagtggcaggggaatgtgactccaaggagaatagggtgttgtgagcatttctaggtgaactgaaaaccaacccattcttaccccacaccttactttttgcaaccttggaatgaagggaattatccatatgaactctaaaattccatgtttatatgagagatattttcctgtttgctgtttacattttggtgacgggatccatttgaataacaaaagcatctgcactccagatccagtttaatccacatgcttccagagtccttgatgcttcctgtacactctgaataccaccaacagcagaaaacgattgagtgtggattgttaaaggggaaagattcaggacaaaaacatgaggactgtcactcccttgggagagagccctccgctcccatgtcctctgcactgttttcacatgaattgtgtagaggatctggaatggaatgttgccatgtgattaggtaccagtgagacaaattctgtcagtgatccttctgtattttaatttatgcagaccataaaagatattcagtctgttctctaatttatagaccttcttttgaaaataatctaatctgactacagtaaactaagatttttgaagaaatatatccttttcagaagttctcaaaattacttaaagctatccccccaatttgtcaactgccacaatcagtcgcacccggtgagcacatttccgtgtctttacctagtgatcagcagggccgcagcgggttcctgcctgcagtagggagggggtccttggagagaatgtggtttctttggaggactctcacgatcgtttaatgaagatatctatgcatgccccgttgtgttctgtataattgcaagtgtgactgttacctctggaagatctccttaggcaacgaaatggctattttactcaaagtgtttaatcaatagagaatcatcgtttcacatccgtcaattcaatttggacagcaaatccatttaattaaaggtaaactgtggtttaaaggagatgcaaaaacatatacaattataaaacaacttcatttaaccaggaaacacttaattgactacaaactgggtaatgattttgaaaaatatgagactaaaagaaacacatactcgcagactaaagcaaggagaaaaccatataacttttttctccaatcttattgaaggcttattcagtattttaaatactaagttctgcattttataacttagagtaatgaggtttcttatataaaacttcatatcatatgccaaccccaacctctgtaaactttattctgatagtattcctgcaaatacatacatacacaacatatttacacatgcacatttttgtttaaggctagctattcccccccccacacacacacacatttgcctgcgtgagtaaccagactagatctcttttacaattttcacattccccatatctgatcagaggttcttcccaaatgtatgcacatgacacgcacacacacacacacacacacacacatgcatacacttggacatgcacacacacacatccctatctccatttcagaaatgttctttgctttgttgggagcaggaagccactgtttgttctgagtgcagaccatggtctctcttgttctgaattctggtgagttgtcaccatgaatgaatgaatttcctgtggggaagacaggatcatcttcctatctgtttctcacgcctcctgtgtctctgctgttgccagtgttagaaaccttaaccccttggagtctgttcatctctcttgctggttctgctccctggtatgcgtgcagctagtgactgtgcaggcatcaggtgacctctccgcctactttaggcaaaagccagagaataaaagagaggatccttcaagacatgtacaacccaattatagaggtattacataaggttgtacacgagaaggaacaaaacaccttcagctgccatgttgccttccctgccagaccataggcttctgtgagcagaaccccgaaaggctggacacagagaaagtatgagtgactgtttcaggagaggtggaagaataattacaaaggaacatgtaagctgctgcaaaataactgagtgcatacgaggggaatttctgtgtactgccctccttctgttgatttcttctacattggaagaagagacttgaatctgaagccatacaaatatgtataatatattcactaaggatgtgagtgaaggtcactacacctgtttgaaatgacagaaatgtgtctacatttagcctacccaattaatccttttgtattaaatacttggtaattcagcctaatccattatgtccctttaaaaagacaaaaaaagcaaaagtcgttttcactcaaatatcgatgaaatacaaatcaggcttcagagacaattctttatgtgctataagtcatctgacacttttgtgtcagccatctctcatgctgccacagtggcaggatattacaggatcaaagcaaatttgcaggtctgaataacaagtgctgctctgagcacgctctcctggctcctccaggtaactgcgagctgggtgcagatcagctctttcacattgtctagctgagcctatggagacacctgtgcctgggcacctgcctccatggtcacccctgcggagccctgtcgctagccttcaatggacactcttgctgctttgccataattggctgaccctggaaaatcctcacttacatctgtgcctggacttcttgtctctttgccattttactggcctgggcttggggcctctgttgtgtcactctgtcacctctaactttgtctgccacagtctttggggtacatacaggtggtcacctgcctttgtatctaaaaagtgcttcagagggcagggagcctgcatgtgtagcagatggacaagtgcacctgggaccgatgcatcacagcctgagcggttttacagtgtggttccagcacattcctacctgctcgggtgtgcacagctggagtttcccggcaccatcattggacgcaatatgggacagtctcagagctgcaatagtctgccttccttgttctgctcacgagcccttgaaagtcagtttttctcccgttttgcgcacagcaggtatatcctattcttgaacaatttgctgaaaagcagtaaatgaggtcctttcttgaaggcaggattcttttctcctttctctactttccaaatctactccctgagcccttcctctgccttagaaggcttagggttgtctggccacataaatacatgagtaaccactggggcctctcccaggaggataggaccaaagaaacagaaaaatccagtaactggttttagatagagcctttacacaactgcgttcagactaacaaagtggcaaagacatcagtatctctactttagtttcatgaactaaggaaataaataaggagaaatgtaattcagtaggctacagacaaccagaattcactgcctcagaattttttcactgaaagtgcctgccacatgtctaagaccagagaaagacagcaacttatgcataagctaccactccctgtctgtaggaccaggtttctagcagtgagaaggtggaacgggtctggacacacctctgccgtgaaatctatgcaaaaaaaacccttcatacccgacaagaagatagtgtgtcagttgcttccctatgcctgaattacaggtttgtagagctcaggacaaggaacgtgcatttgggtaacattatttgaaaattgtgggggtgctgctgagttccaaaagtggactggtcaccttggccaatactagctgaggaagcagaggtgagttagccccctggtattgcactggattacttgctaggactttgtataaagaagcacagtctgaaacagacgcactgcaggagaccagggatgaacagtggggaacactgcctgcagaaggggatgtgaaaagaagctgggagtagatgtttcaacacccgacactgtttggatttacatcttttagctttagattgtctactgtaaaatagaagcagaactcttatcacttaaaattgtaagtaaacagatgtctttattctagagtaacatagcacatttgttatctcaccaaaaatagattcttttctgatgttgtagagtagagaatctgaaaccaacagtgtacgtgtaggagcttcaatccattcaactggtggcatcatatacttcacatccttaggactgcttatgtgatgtgcagtcaaggattgggcaggtcatatatcatgtcactccatccttcaatgccttttgatctgtttagcagctccttgtgacaacctaaggaagagggtgagggtggtgagactcagattgacccgtgtcttttgtaaattcttcttcctttcttccttccttcacccctagagccctttatttcctcaaagagatgaactgggacaggtacgcacttcagactgtctcagaggcatttagccctgattaatgcctctgaaattaaagcttgttatcttcctaatactgatacagaccataaagcattgtgtgttacaataaatggagcacccggagctctatactgagtgctgttcccttctcgatagcagaagtgctgggggatggtgaccaccactaacagttactggacatttcttatgggtaagtcaatgtggtgagtctttagctcatcagagtgattaagaaatagacatgattgttattctattctccagataataaacaaacttaaaagacattaataaattggtccaacttcatacagctagttaatgtgggacccaggatttgaactctggaacccatgctcctgactcctaaggcttccaaagaaccacattctagaatcacataatcagataactgtaggactcagaatacctttaacaatcatatggtcttgtatcctcttttgccagtaaggaaactgagtactagaatggttcagtgacttgcacaagatcacagagctagattggaacacagctaggattagccccaagccctcctgcctgcctgccaggcttctttctgttacagcacactgtgtcatcattaaatgttcatttttaagataggctacaaaaactttatccgaggttcttaaaaataaaatgttatccttctatctagaagaaaagaatatcgtgtgtgtgtttcaagaactttcccaggtcttgactaagtcagagaggtcacatcttggcaacttgggagacacaggagacccagtgcctgagctcaccagctctaggaaccctgatatgtgcctgttatcctgccaccccagtcctgaagctgctgccctcttctcaagcagtgtgaaggatccaagcaagccgctggtgatggggttgccagacacctagtcctgggtgatccccggccccaactgctcccagctctgccatatccgacctactcacacatcccttgtcgcaattagttcgcaccttgcacttagcagcccatcccagcagggcagctgcctcagctgcagagagccccatggtggtggcagtgattacatacacctacacaaaggaactaggtaccctttaaaaacactgctcctacagaaaacccattcctgtgtcttcctgctcctgttgaatacaaactttccttcccaatacaattccctttatttcaaagtgtagcatcaaagtgcagcaagaagggcctcagaagcagctgacggtcacaaaatagtgactgcttcctgctgctgtcggaggatcgcgccctcccagcccccacctgccagagcctcaagaccactccagctgccctctgccaactccccaagtctagaatatccctctcttccatatccacccatagaaacagcactccatatttctgtctcatttgtaaggtagtttcccttatgaagctttgcatacctttctttggaattagcatacttctgactgccaacagcagttttcatttttaaaattttaatgaacatttacttgtgctgagcatgttctaggtgctttacaaggaaaagaattgagttaatattcataacaactctcttagcccattttacagatgggaaaatggagccaaagtcacacagctaataaatgggacctggctttgaacccagacagtgcggctccagggaatgtgctcttgaccagtcagcttgccccttattctgccttgagttgagtttgttgtttacacatctgtctcttagtgactattagaactatgtctccttgctctctgcatccccagcaatgcccagtccgggctctgcttgtcatgcgctttcagggctgtctgaatgactggcaggacagcctggacaccacagcccggagctaagcacaggatttccctcattgcagccacagtgttggtcccttaggtctcctatctcttaatctctcccagctttacgttatgtgtttgtaaaataaggataatagtacttaccccacaaagttaatgggagcgggcgtataatcagatagcgttaggagttggaatcgttttcaccagcatgtgatctagtctttggcacataaggaaactgagggccagaacggttctgtgactggcacaaagtcgtagatctatactgtgaccctgacacatgtgaagactgacaatgacagaaaatacggatttcttttctcaacagatatatcatgtaccactctaagaaatgtcctctctgatgtacctggcggcatatatatgtattctaataatgtcattgctcaaaagatttctgaagttcttatttcagagtaatctgtagagtagtatgtgacactctctgtttattgcccttgctggtggcaaatctccctcccctggcaggaggacttacatttggggaatagctaaaagtcaagctgaacctcttgaataagatggggaacaagcagtggaaataacatgtctcctgaaagtctggttgtagtttgagtgatgctgctttctgattaagttttcatcaagatgaggtaagagagaaaagtaacaagacagatttctcgtgtggtttgtaggataacacttaaaattccacaaggggaccaggctgcatgtttctttacagctgatgaaaaccagcgttgtgggtacagatgcggccttgtgcttataagtattgtatgcccattaaataacaacattaacgaatagatgcaattggaaaacagacgctttgtgagggtactttaaggcaggaccgtaaaggcatgaaagagggatttacttatgatatgaagttatttcccaaactgaaactatccagacttccagaagctcttgatgtagtgccagttttgaaataatcttcaaggatgtttcccaaggaaggtcccccttccaaataaagccagtatgaaaggaagaatctaggaaagctatgataagccaggtacttaatcagcaactttatatatactttaaaaaatctcatctaatcttcacaccctccctaagaagttaataataggatctcatattatgcatgagaaaacaggctcggggtggaagtcatggaagtcacctgccgcatgagaagactgaggctcagggggtgtaagtcacttgctgcaacatcacaaggtagatggaaaaaaaatccatgtgcatcttactccatcacactgagaccagagcaatctgtgttctcaggatatttaaatgagtaatattttattcctgtgagacctctaaaccaaaaggtttggggatacaataaatctgttatcttggaaacaaagctggcagctgctcttggctgggctctatgtggtagctgtgcttcatggcagtgtttttgctctcactatccaatatccatccaccctcttctcagcgggcccaaacacaactattaatagaagtatggatactcggtttggatatctctttcaaaacaaagaagagtctcttaaaaactcttgagaaatcaaaacttgtaactgccttattctttttcatcccttcttcccctttaaagttgtatttattggatcacattatggtgcccccaacttaagagctaacaagtacatttcttagtccttcttcatcatgggtttcttagcaaaatgagtactcatgcgcatgcacataaacacaccttcagttctgcccagactccttcctgtggatggggagagttgctgacacaggaggcagagtagaaacgcagcagcttgtgctaatggaaaaaggaggatgatggtttcagagcatgcattctgctctcctgcccacccctccacccgtctccagttctgcccccaaaaaggcagctgaagtcatttcaaggcttcctactttgtttctgttccagaggccaagcctcctggtaagactgaggaaagcgtaaagcaccttgagttccatcctcccaaagggccctgtagctggagtcagagcctgcgtttcagcctctccttcaccaccatctaatttattgccttgagcaagccacttgcactccctaggcctgcctgttgcttcttccttccagagcacgaggaaatacaaggaatgaaaaggatcgagaccagcctggcccttgctaggtctcttctgggcaaatcacatgctcttccatccactaagtgaggccacagatgtcagaatgcagccatccagtgtgtccagttcaaagtagaaactgctcggtggatgggagttgcaatgatcttgaaaatgagtgtttggaaattgactgtctctgagattcctcgcagctatatttgatttgaatccccttccccaaaaccacctattgtgttgggagttaatcaaaccacactgataggcaaatggacatgccaatctctctctccctctctccctctctctcctcttgtcagataaggtttgagggagagaggaatcagcaggggttccccctagctgtccctccaccatcataagccatgcacaattgtcagtactcacctctgccctcctccttctccgggacaccctgcctcctctctccaggcctccatgggctccttggcctctgaattcctgtagacatctagagtccagatcacaaaacaatcacttaatagtcggaattttcatttgttcaatttccatttttggataaactgggcacatggctaaatgttttcatcacattgtatcaattaatccagtggttcccaaatgtatctacacttcagaatggcctggggagaggggggcttcaataaactactgatacctctgtcccaccccagaaattatgatttaattagagtatggcctgggctgtagaatttgttaagacctccctccccccagctaagtgattctaatgtgcaggcaaatttgggaactgctgacttcttagaactctctgccataggacttataatcatgtcctatttacagatgaagctcctgcagttgagcaaactccagtgagcccctcaagctcacgtccacactgcgtgagagccagcactccagcctggcaagactgcagctgtgctgtctcaatccttgctacccacagtgtggtccagagaccacagcatcacctgggagcttgttcaaagcgcacattttcaggccccacaaagtcagacctaccgaatttattcagaatccctccaagggagtctcatgcctgcttcactttgataacggctgctgtagtcatgtcaaatgccctgaaggttacagtcatgtgctggcagcctcgggagccacagctctggcccctagccatcctctgactttaatttacctgagtattatctgggctgctggtttaaaatgacccacctcaaagatcttttttcaggaagttagaaatcctggagttatagcgtttctgtgctgtttcgtgtttgtgagttttaaagccaataaggatcacccctttggagcagggaccacacatctattcctgccgccctctggcagtaatgagcaggtggcagggctcgggactgttagcctgattgatggcctggtggaaccaccaccagggcactaaggtaattagacgatctgtttctggaccttgctttctgggctggaggctgccgccttacgtgattaggatgcgtgggaggcgccgcctctcctagaagctgtgcaggtagcgctgggctgcaggaggcagccaagccaggcgcacgatcagagcagggacgcctcccgttccttggttcctgggctccaacgggcacctccaaaccaatagttccagcatctctgtatgcagaccttagaggacaggaagcgactgcgagccccacactctccagacacggaaactctaaatgcagagagaacgaagcatattttgtcttccttttcctttttttttttaagcaaaataataacttgacacaagtccaagtagttaaaaagatactaaaagaaacccaatttagaagggcttttagtaggctgaaaacagatgtggcaaaccatttcgggatattctgggagatgagatggggaggaccggattcgaaatgcctgggccgcctgttctgggcccgccccgccaggtgcctgtgctcgggaggggccttgcccagcacgcattctagaaggaagcggccccgcgcctcctccctcgcaattaccgccgggtcggaggcatccgggcggtgcgaagtcagcaccgtgccgagcagttgagagcagacggtgttttcttttcattgttccctcgcttcgctgggagagcggcggcacctgttccgcggaagcgcggccaaagttggaagccctggcggctgctgcctgcagccgacgcgcgggggcgcccggcttcatccggccgcgggggaccaggagcctgagagcctggaactgggtgcggggggacagccagcccgagagggcccagggtcggatttcggatggaaccagagctcgctccagggagttgaaggagttgggagcgcatctcccaataatcccaaagaaaccgagctttcagtgcatgcaaggggcatttgatttccctcatttctgagcactgaagcactccactgtcatatttttgaaattcgagaacaaggaggttaaagagtctaaatggaagactaggtgaccatccaaaatatcatacatcaattgcatcttgtaattagtaaaatcatttttattacttaaggtaaatcttgataaggtgtttttattaggtaagataaacctggtataacatacgttgcgggtgtgtgtgttttgttcagttgtcattttcagagaaataaatgaatttttaaagtgtatatttattcatcaataattatttttaaagtgtgcctgtataccatatatgtagttttatatctatcccactaccttctgcttgcataactgaagtcacaaaaaggtaaaaactaatcccccaatatacagaagaatctagtatgtcccataaaagcatctttgctaactggcatcgtgaaagtatggtgctggacactcttgaaatgaaatcattgttactgtcaaattagacatctccacaaatatacatgatctgctcaaactgactttacatctgggaaaggagaaattgtaggtctctcttactctgggatatttttgatagagcaaaggtatccatgatgtaaatttctgagatattatagataagccctttataaagtcacaaataatattcccataatgaggggggaaaagattccaaagaaggctgagcacttactgagggcagggaccatcattgtctcctgctttacagtatctgcaactcctagcatatctggtttacgtcttgccaactaaaggtaatgaggcttccctggaagggcactgaatccatggccagaaagtttcacaaggaggcagctgaaataaccagccacatagctcatgggggaacatcagtgcacctcagggggttggcattctgggagaggtcctctcagctcagatttcttttgtaaactttcccagtctgggactttccttcctacactgatcctatgactctgcataaaattcagttttatatgtatacattgcatatttagtgcacacaggacacagcgatcaggtgttgcagggtttgcagaaataagcaaaacaacaccctttatgtgctggccaggaataagtttacagtcaaacagtgcaagaagggcatcataccagggtcagaacaagcatgtttcatcagggcagcaaaaagagctcacatctatggaggagtctttgaaggagtgcagcgtgtgagatgtactttaaagaatgcaaaaaatcttcaactgggaagaaatggatgggaggagaatattctgaacagaaggaatggtgcgagtaggagtttggatcatggggtatgtttggggaacagggcaaacacttgtccttgaacataaaatatatgtgcatagaaaagagagctataaaagataaggctggaaatgctggttggggccatatttaaaaactcgttcttacctgcctggccaaataatttgtatttagtttcagaaagtagttagaaataggagattcttgagcagaacaagtaaatagcactgggattacacattgagagagtttttgtggtattgggacacatagaatgcccatgcaggaagacagtagagcctgaatttaggattgtggcagagggattaagaagttggaaaatacactttgagagctgcttcaaagacactcctagccttggcaaatggttgggtttgcgagaaggaatgggttggttaagggaatcatagcagtcacataggaagtcaggaagagcgcagtgactgtggggcaaagaattctcttttagacttatggtctttgaggtgctggcaggacctccaagggaagatgctcacagaagaagttagaaatcaaattcagaaggttgggcacagcggcccatgcctgtaacctcaacacttttcgaggccaaggcaggaggatcgcttgaggccaggagttcaagacctggcagcatagcaagaccccattgctataaaaaataaaagattagctgggcatggtgacatgtgcttgtagtcctagttacttgggaggctgaggagggaagatcgcttgagcccaaggattcaagattatagtgggctgcgatcacgccactgcactccagcctagatggcagagcaagaccctgtctctaaaaaagaaaacaaaacaaaaacaaataaaaaacattaaattcagcacatggagaaacagggctagagttacagaatagaaattcatccatggaggggcagggacaggaatagatgaaaatgccaggaatcctggggaggcagaagaggccaaggacagagctttgaggtggtcacgtgttcctgcccagcctctggtcctgctctcctctcgttgatgtctagaaaaacattcttaccaaaaaaaaaaaaaaaaatacaatttgctaggagaatttcaaaaatatgacagtggagtgcttcagtgctcagaaatgagggaaatcaaatgccccttgcatgcaaaattcttccacctgagattagttagaggcttcagacaatatggaaagacaatttcagattttaggaagttttgtttattgaatttatttatactaaaatgaatctgtagttctaatttgggaaaatgacttagctacttccttcagaaaaaatataattctaatctttagtgttcaatctgattttctgcccactcctcctaaaaagttttcaatcactttctgaaactagaaataattcaaaagaagagctaaaatattgcaaacttccttcacagtttatttttgcaggccgttctctgagtagagatgcacaggaaatgaatggttacagtaactgggatgtttgtggtaaaaatacaattttttaaacttagaccatttttccaggttttacgtctcccataactcaaatattgttttcttctgagaagaataaaaacacaggtgatctacaaaaaatagaccttcctcttgagtatacaattaacttttgtgtgcaaattttgtcctataaatcatagtgtgacccatcatgggaggaactccaaaaaaaccaaactgtaaacccataatttcttttatgttttctaaaggtcaaatgctgcaaatactggccagatgacacagagatatataaagacattaaagttaccctaatagaaacagaactactggcagaatatgtgataagaacatttgctgttgaaaaggtaagttttcatactgcttttaaaagctatggtcagacactagtggtaccatactagcctcattaacttacctaggatactttacacatgctcatatctcaatgcaggtaggctctatctgatggtttctcaagattgcatcttgctctctgattctataacagctcagttccatctttaaaacaaatcattctcatttcataagaatctatattttgcaagtaaaccaaaagttaatgtctatttgtttattttctttccctggttgatattgttctgcccgtctctctttctttgttcacagaacaaagtttgctaaattttgataaatgtccttccagtttggtaaatttccttcatggtgtatgtcgatatgcattttccagtagggagttagtatcagtgttgagacacaggtcctaactcctcctggaatctctcacttccttgtggctttcgaaacctctggtttaatgtggactgatggattttccaggtggaagtgacctacctggaaacctaagtgactgatctccatcagacatgggacactcttgcatgaaccagcgcattcattcatgctcactcccatactggttttccccttttgtagttgctggtgttgggtcggtgaatgttctgctttggttctgccctgcctcatcccatgtgcatggatggggcttcttctctgggatgcactgtagggcataacagggaatttccttattccccctctttctgctgacatagggaggggccggaggtgaagcaaactgcagtccatccagagaagtgtcacaggtaggctctggggaaagtggaggtgatgtggctgaggaacactctgccttccaaagatccacagacttttctatccagagttgattctccataaccgagccctgcacagctgccctggacttagggatcttggtgtgaatttgttagcttctactcatgtaatagtagcaggtcttcttggaagacctgggttataggcagattgctagggaattggattttggccttcctctccactctatattctttttttttttttttttttttttttttttttttttttttttaagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaatttttttgtattttttttagtagagacggggtttcaccttgttagccaggatggtctcgatctcctgacctcatgatccacccgcctcggcctcccaaagtgctgggattacaggcgtgagccaccgcgcccggcctccactctatattctcactgcatctaaatgcgctttttagatgaacaagaccagttttaggaaatcaaggaaattgcaacatctgcttattggctaatttagtctgatgttttgaactacctttcctggtttgcagatccaaatttgtcatagaatcacaaagctggaaagactttattttaatctgtttctcatactatttagcattttttttcttagcctgtcttttttaataagcaggcagaaagcttggagacttcaaagaatgaggagttctggttgactcagttcttcaagttctgaacctcacactttgatgtcaattttttccttcttaggcagaattggaaaaaaaaaaaacacatggaggatttttgtatggctgttggcaagagcactcatgaataaccgcattaaaacagcgataaaagaccctcaatatttttttctttaaaaaaaaatccaaaagccatcatttaaacatggagtttttttgaacaatagtcagctctctaataagctgaaaatgcacctctgtagctaaaggaagggtttgtttgtttctttcctctttttttttaacctcttattgtactcccctgaattcccagctgcacagaaatgtgtctgaaatatccagtcattttagtcactagacaaccagtgaagaggtggtggagggaagagaaggaataaggagcttgttaatgcatttggggaaatcaaaatgacacattagtgattttctaaccgggcaattggaatctttaaggaaaacaaatcattagtacttttgtagagcatttcttataggttttaaactttctcattagaaaggaaagaagagaacaggtaagcatgtactttgagatgcctgcaattctgattctattttgagagcatgttgcatcgagggacctaaaggtgaaagtggattagggctctgctctgcaaaacaagcagatgcaatgcactttggaactcatgaattcctgctttgcatctgattgttgtcttttatttcccacatagctgatgattccaagctaaacagattttaaataatacacagtacccagagtgtcagaaggaagacacccctgaagtctccatgcatttaggctgtctggtgaatctatccctgactattctgggagaaacaaagttgacaatggtcactgaattctcgctacccaggagctgcctaggattcagaaagggcatgagaagatgatcctcctgtctccaagacagaacatgtattatacaagacagaacatgactattcatttcacaagtatttcttaagcacccacttcaggccagggactattgtatgacttggatcaaaattaagtgactaactgggtgtggtggctcatgcctgttaatctcagcactttgggagactgaggctaaaggatcgcctgagcccgagagttcaagactgcagtgacccatgattgcgccattgcactgcagcctgggcaacagaatgagaccctgtctcggaaaaaaaaaaaaaaaattaagtgactctcacatttttgtatataacattaatgcttgttatgatgaaaaaccaggaagtaatagtatcaaattgggaggtatttgggctgtgataactgatgacatctatgatgttcttccccaaatgtattacattccaaaacagaaaaaaggagacactgctatgtcaatgaacaagaatgaaaactggatcagaagccgtttcctttgccactcttgtcaatagcaaacatattcaagggtggaggtttaattttgagaaatgttttctactttccagaaactgatatttaccttgctcagaaaaagagtcttagatcagttaagagctgtagttcagcacttgaggttgctggaactgaaatctaacaaagctagagagagaagcacaccccatgctcccactccccaaaaaccccacaccccaaaaacccaccaggacatggagaaagatatgccccttttttcccctttggaataaagtatttaccgtcaataagctttcccagttcatatatgggaatgcataccaccaaaatgggatcactcctatgtgggtcatcatgcagaaagctgggggagctttctaggggttttgagggtgacacagcctcagctgtatgttttctaagggagaccatggcactggcaaacattcccttggttttagggataaggaatttgggctcctaaccacctaatcatactactctgggatcacagagcctatttagcagacaacaatattgatttgcatttgtgaatccccgactgcttaattccttatagcttaaactctagtaaagaatggcattttcacagagaagtaaagcttcagcatttgtgggttattaaatgaagacatgttaacacatgggtgccaaggaagtcttatctcgaaatctgcagttgtttgcttttctggtctttcaaagcacataaaaattctgaatttcttctttgctcactaagtatgtgtgaacaatgattgatggtgaaagtgatgaggttaatgagtgtttacttttaagatacaataaaaccaaatgcagaaatggttcagaaaatgatcatggaatgagagaaggaagaaagtctaatttgatcctagatgtacatccagcgttgattccggttttgttttcaaaacagtcttttgctttaaaacacagtcttaatatataggcttatacttagaaaacaaaattgacaggtataaattaccttaattattctcaaaacaaaagtaaattaaaaccaagagcaaaccgtaaagtctctttctttctgccttcactacagttgagtggcaggcagctccccttcgatttactgacctagcctagaattccagcaaaaatatctttcgattcccatagtatgtattggcttacatgcctgtttgccacaagcagactgtgacagccactcaaaaacatatttctgtagccctagcacctcccataatgcctggggcagtgtagtcactcagattgctagcaattggatgaatgggtaaaatatttacccacattaaaaagagaaacctaacaaacagagctgtaaatgcaaatgagctctctgacctgtctagttggaaaggtgtcctcattcattcctactgcaagcatcatctgagcatgctcagtgagtgtgcaccactccagtccctgctgtgagaggtaccaggatgccggaaagccccaacacggagttggtattgagcacacagacatcctttaatttcttcaggcccctcttctgtgcctctttctctacagactctcacctcaccagccaccttgtgatctaagtgagacaaacctttaacatagtctactttttagaaaggaatttcaaacaacccaaccaattcatccatttgctggaattacacctaaaaattagcattttccccaaacatcatccccctttcatacccagacatcttcctaagggtacaatgccttccacattgtgtgtgagatctaaggatggcctctttccccagcagtccactgtttcctggccctagacttgctacctggggactgtttccactcccccagctatccctgcttatttgtggtttgttttcccttgttctcttccttgttctggctaaccaactactgcagagaggtgtgcatgaaatccgagagatcagacagtttcacttcactggctggccggatcatggggtcccctaccatgccaccggcctgctgggattcgtgcggcaagtcaagtccaagagcccgcccagtgcaggcccactggtggtgcactgcaggtaagcagagctccagagcctcttgaaggaaacgcagtgggtgatgggtgcagggccacctttggggatgatgagtatgttttagaacttcagaggggtgatgattgcacaacattttgggagcactaaatgccactggagtgtaccttttaagaggtttaattttatattatgtaaatttcacctcgataaaaaatttaaaaagcagcagcagcagtgtggtccttcttcctccactgacagaccccccttttcattcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggtactcccgctcatcacctagcctggggccttggtccctgggctccctcctgcatctccccatttcagggccaagggcacaaggaatccaggcaattatctgttcaagtgatctacctggcattccctgttccttccctccctccctcccttccccctttttgtttttcctctcataaacaaaccaaacaaacccaggagttttccaggtaacagaatcaagagcccaaatttgcacacttttctgtattaagggacccaaaaaagtctctgttaagtgctcagactttcaataccatttccttttattatctcttttaaactagctggtaaccagagcaagaccgctcctgagaatagtggctgaagggttatctctgtgcactttgttcttctcccagggtcctgggaagaacagaagcctcctgaccctaaaaattctgcccagtgtctggcgtcctggggatttgcccattttgtgaagtactgtatactaactagtaactctgtaagtggaaattcaaggtatatcgggaatttccattttttcagaagcaatgttacatcctgctcttaggacattcgtatttttactcatatttgattgttttaagtaggcgtcacaccgaccacctggaaaatgattcatgaagtgaagtgaagaagaagtaagaatcccttacatttagatggtgcatttaagtttatgaaagcctctgggaaacctaatcccatttttttagctaacataaaaataacagaaactttaaatgctgctttcatgggttcttttccttagaaaggggatactgtgtttgaaagataataatcgtaataatttatcttttaatgtactttatagtcaatcaaatgttgccactcgcatttctcacttggatcttccattttcaggtgttgtttactggtagtgtgctgtttttgggaatcaatctgttggacaagaggttgttgaaaaaaaataattaaaggtcatatttatgtatagaaaaaaccgaattaactgtaataagaggctttttaaacttcccatataactaaagattaataataaatatgataagactctaccaatgaattttaagaaaagtcagtgccaaatcagaattagaggccccatatttacactgtgaactcattgaagatatatatgagaacagctctctgtacttctaagaggtttcataatcatattaacttttatgttctgaaataagaacttctaagtacttttatgttttgaattaagaacttccagacttcttgtcttcacagtaatgccaagtttttctggaccttctttgcactattattttgaccagcaaatcctaccatagacaaaattctgctcattcctcatgtgaaatactgagttccaagtgagtaggatcagaatgacagaggtcttcagccacagttttcatggtgctgcagtgcgtgtggtggtttgtattgggtccgattggttttaatcaatctgtgtaatatttggcattgcaccccagtctcctagcacttgagcccttggaccgtgtttctctctggaggaactgtctccactctcttgatgatgtggggctaaaattgataccgtctttcctccttctctggttctctaaagttagtaactcgttccatctccttctccaggagcagtatgtgtttatccacgatgcgatcctggaagcctgtctttgtggggacacctctgtgcctgcttcccaagttaggtctctgtattatgacatgaacaaactggatccacagacaaactcaagccagattaaagaggaattccgggtaagtgatgcctaagggaggggcactgcacggtgacttgctcctcaagaaggatttcaaggtcagcacctgagtgagcccttgaatcacaaggttccttggcctccatagcactgttcgtattcagggctgggtaacccagagctctacccaggagacgtctatggtatcaccaccacacaaaaatgtgtgtagacattgccaggtgtccccctgggggacagaaatacctggttgagaaccactggtctaacaaccatttccactccttccctctgaaggcagacatggactagtccccaacaccatggctccttgtccacagcataaccatggcacagttacaccatggaagtgtgtgttcagactttccaaccaagagctctccattgtattcctcacatatgcattttgtccagatgtacccgagtcaaggccagactcttcccccacctctgacctcccaaatccccaggtgcctcactccactgggacttgagggctcttaattctagggacccacagtggcccttacgcctctgcctctggcccctgtgtctgatgggcactgtcagtggacgaaatccaaggagcaaaagaaagaaaactcgaactatggtgggttggggagggagggggaagggaccgtcttgcagtcagccacaggaagtttgcatctttcgaaaactgcacgtgagaggagtccgctgccaaggcttcttgtcctcatgttcctttcttttctcacgcagacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacgtgagtgccccgcttcccgcacgggtccgaggctggggtgtttggggagactgcagaacaggcttgggtcttccccattctgctcaccagcccttttgttttttaagacacaaacttttttttccaacaaaaaatagatttcagattccacgtatgtttttgtgtcggggctgatatccttcgtttctcaaagaccaccaggccaggagtatccgtaaatgcagcatggcacagttgccctctgagagctgagacttttaacctgctggctggggaacaggggacaccatggcaggaaaatgggttaataggtttgcagcattattttagttcattttcctgtaatttagcctgcagttaacataggggaaagttcaactcattacttcctgccagtctgttttcttattgctattccgttgatgcaaagagtgaatgggtatgttctgtgctaacacggaaattttaattctgttggtgtcatatcataaaaggtacctgaacttttttgaagctcttcagagctgtaaaaaaaaagtacatgtattctttacggcagaaataagaacactgtcacacatacaaattgctagcaaacaagttttagaaaaagcagaacttttaattatgtgtaattttaaaagtaaagttaaattttctccatcaagataattatgtatagattcgatattgcctctctaccagaaatattttaaaaattgataagagatactaattaagttttcttggtatcaaagtaagacttttatcactattattctgcagagaagtttatatttagtctatgttggtgctgacaatggtgacagaattcaacagctgttaaacatgttcagtgttttgtgccacaagcttccttctgcatgaaataacctagcttcttctcttcccattttcctgagtatatttggagcattcttgtttgtgtttgcagagctataaacagccttcagcttttatagtcacccagcatcctttgccaaacacagtgaaagacttttggagactggtcctggattatcactgcacatccgtagttatgctaaatgatgtggatcctgcccaggtgagacccggacttcttacagtcagaactagtgccagggggtcaagtttgtttttacactgagtttgtttgcacccgagaagtgcaggccctagtgccagatctcaagtgccagttgaagttgagaactggggatgctgaacacaacggttaaaaatcaggcggaattaggggttagaaagtcagttgaaaccagaaatacaggctgaaatcatagatggttgaggtgacagggcaagacacggccagaagttgagctgttcctaaaagatggaaatactcactggaggttgacaaggtcgcagaccgagttggagctcagcaggaacctgaacatcgcagagccaaagcagaatgagcaaaccagaggacagtggagaagggaagatagcgtttgacccagcccagatcccattcctggagtgactgtgtgcttcctggcacagctcaccgggagcctacaggtagagatcgtcatgcagggcaggtagagattgtcatgcagggtgacagtgtcggggtgacagcagagacaggcaagcaattttaaggcacagcaattagttttctcaatgctttagtaaagatattaaaaagaaataatactgggacttggagataagagaagtttggaatgataaatggggcttttgcatagttactcttaaacattaaagagaaagaattggacagtgatgactcaatgttagtaatggagttagacacattttcttgaagcaggttgtcaggcaagcattagcacagtggtcctttaggagatgaatttattgctttgggatgtgcctataccaatcatagacaaccaccatgacagtaggcattatgggaagtttgaccttagcgtgttttaagaaaaaacttgttctggaaatgaattaatttcctgtccagtagacacaaattctttttcttaaaaaaaaaaaaaaaaaagtctgaagcatttcggcatcccaactggacatgatggcaagatttttccttcctacaatctgttttcttgccatcatccagccataaatggcatggacattcaattcagttctataaggtttttaattatgtctgaggcactgcattatattgtcaaagctcttgcctgaaagctggttaatgaaatagtaatgataatctttgttcttatccagtccttttggcttaagaagcttaaatattttaaaactcttccccactgatgctctgagaaggttagcttacagtcatttataaagacaagcagacaccacggcttgtgaagcttcaaagacccaactcaaaatagaaccaagggtcctgattttctcacttacagtggcacggccgaaatttcactaattctagagtcttaagttgcagacacttatagaataagggacttcttccttatttagaatcatgatggtttttttcttaatgtgaatcctgaaatgtggagatatttttgttcatattagtgaacaagacatcagtgattctagtgcattctttttgaaaaactgcattggaattctaaagccgcattctaaacccgaactatctggactcaaaccaagccttggctggctcatgggtaggagagacaaaaagactccagttctattcagcagacagagctgattttcagagtgagagaaaagaggctcctgggattcagtcttttagcgaacactaaactgagcatttgaatgtaaaggctttgcaattctacaagaatagcactcaactattttaagtatttataggtccggttcacggacgtgttatgcaccatttaagccattttctacatggtttacttgggcagagcatagaatgcaatgtgccaagaggcaagtgcaacccacgtcactcatatttctttggtgtaagtggcaagcttttggtcaggagcttgaactgagaaagcaagcagaaagcagagtaagctcaggcagtagaaaaatgggcagaacggttcagatgtacatgttacagcttttattaacatctcggcttcccatcataatgcctattaatttcaacagtgggtacactttgggcatcaaaaagaacataaacatcacatgctattatttgacaaggcagttttataacttgtcaccaggaagtgctggtgaggaaggaaatatttcacggaagcattatttaaaaataaataaatgtaatttttaaaatactgtcagcatagctaacataaaaggcacccttggttaccctactttcattcttacttataaaatcccaaccttaactgttctgtgatggagagagagatactgctgttttgattggcccactgctaactgaaaactatcctgcaatcttgggtataaatcaaccttagcaacctttgacaatgagattttagatcctttggaaaacagaagtcatctagaaattcagccagtggatcctcctttcctgacacatcattctgcataaaattaggtgattgtcttcctctgctcttggcccaggatagaaacaggttgtataataaagtagttctccccttgcctttccataggccacctgtccctcagctaaatcagaaagataaaagttagatgcggccaggcgcagtggctcacaccggtaatcccagcactttgggaggccgaggcgggtggatcatgaggtcaagagatcgagaccatcctggccaacatggtgaaaccccctctccactaaaaatacaaaaattagccgggcgtggtggcgcatgcctgtagtccctactactcaggaggccgaggcaaaagaatcgcttgaacccggggggcggagtttgtggtgagccgagatcacaccactgcactccaacctggcgacagaacgagcttctgcctcaaaaaaaaaaaaaaaaaaaaaaaaaaaaaaaggtagatgctactcaaaaaaaagttataggaataagaagtcccaaaggaagagtaatttcaaactttaaatgcctgttaaggtttcggggctttgagaagggtttttgaagaaaaaaatcttagcagttcttccttcctgactatttccaagggtaggaattttgtggggtgctggctaataagcaccttcataagccaccatgcccagcaccactcctactgccctgagttgtgcatttacattcatgcaaatgttttagttactcagtatcaacaatacctagagtttgaggctgtaggaaattgcttttttaattaggccacttccaggcagaacagcaaagcatttattcttattacagcagatttgctagatctgagctgcaagggtttggactggaacataaaaatgcaacccaacaatgttatcagttccaaaccttgtcacaaaatagccttattcccaatagtggttataaatccacatgcaatcccagccagcagagcgtggagatctgggcattaagagttgtatagccatcttgagtaccttacatcctggggtggcacctagtgcctctccccggggcctgatgagagttcccttcaccatgcaaaaggggacatggcgactgccatccacatgacctcgttggaaagcagaattactcatggcttaaaaggtgctttctgagaaaatgaaggaaaaagtcccaggaaaaggacaggtggagttgaggaatcagccagcaaggaagtccaaaagcctacattgctgggaggaaaagagaaagaaaagaaaacaaagggagtcagtgaaatcttcagaattcctgaatgatgtctccaaacacagcatcccacatccgtaatcccagcaatttgggaggctgaggcaggaggatcactggagaagagggcttcaagaccagcctgggcaacatagcgagatccctgtgtctccaaaaatacaaaaattagccaggcatggtagcacacacctgtggccccagctacttgagaggtttaggtgcaagggttgcttgagcccaggagctcaaggctgcagtgagccatgatcgcaccactgcactctagctggggagacagagcaagaccctatctcttaaaaaaaaaggattactgagtgtcaatactaaccttatccaaactgttaggagtaaatttcctcttataactaaccttgtgtttatatgttttgaattcagttgtgtccacagtactggccagaaaacggagtacacagacacggccccatccaggtggaatttgtctctgctgacctggaagaggacatcatcagcaggatattccgcatttacaatgccgccagagtaagagacgggcctgtcatgcctgtgattatggtttcatttattttctcactcactgaatacttggagcactcactctatgtcagtcactgttccaggagtttggagtatgtcagtgaaccaaaaaaacatagattcctgaccttatggagcttacattctaataggagcagtatttagaaagtaatgatacttattaaagcacggcaaggcagattttattcaagaccatcacgataggtgcagggacccctgtcacaggaccttgcagtgggtgagagagagtgggctcaactccgagtgtggcatgggcaggcaggaatttatagccagcaggcagggtgggggtcagtggatggaaaattactaaggggaggcatgaagagtaaggggggttctggctaaactgacttaacaggattctggctgaaggcaggccaggtgaccagacatccgaggaacctgatcagatatcaaacatggtcaggtattaagggtgggtggttcttgcccacggtgacttaacagaaattgctaaaactggattttacaaggaagttcatggataggcctaggagaatattcaggagcctgacgaaagtttggtcaagcaaagaattattgtcagaaatcagacaataaataacagatacaataatagatgtagtaagttaggaagtgacaaattctacaggaaaagaagtactggggttagaaagtgctagggccttacagtggggagcaagctctgttgtaagcatgtgtgccctgtgagccaagacggaggagtccagggagcaccgaggctctctggggaggcagctttccaggcagaaggaagggtcagtgcagaggccccaaggcagggccttgcatgtgagtgccaggacagcaaggaggcggcatggcccaggctcagtgagcagaggcaagagtagctgatggggagtgagcagttcacctggaaggacagtggcttgggggccccggctggaagggcctggcagtcactgtcagcatttggacttttgctttgaaggaaataaggagccattacagagttttgagtgcaaaaatccaatggtgtaatttacattttaaaaggagcactctggcacctgtgttgagaatagactggaggagagaggcatcaggaggctgttgggataataatccccgtgagaaatgacagtgataggagaggagatcatggtgagacgggagagagcaggagtggaggtcatgagaagggggaggttctgatattttctgaaggaagagccagcacaatcctggggaatggagtgggctctcacggttcctgtcctgagagctaggatgatggaatggacactgactgagttgttgtccaggctgcccgtgtaaccggattgtttgtgggtggggggcattgtggagagaggatcagaagctcaattgtagacatactaggtttgggatgacttttaggcccctaagtgggaatatcaggtgggcctttgaaaatataagggtgaaattcaagagagagggctgaaccagatatatgagtttatgacttattgggatattggtaatatctaaagccgtgagcctgaatgaaatcaaatgagaggcagaggaagaggaagggccccagggattgagcctgggggcttctgtcagcaagaggtctgggagaaggggagactgaggcagagagagagggagggactgctgtgggagaaggaccagccagtgaggaaagcgtgttgacaagaagagagtgtcacccatgtcagatgctgctgaaggccacagaagatacagtccaagtgatttagccgtggccagattaaagctgttttcatgtttctatcataagctaagtaacacttttttgaattctgcaattctatttcactatgactaaggattaattaactattgctatcttagcaagattcaacatcaataagcaaaaccatattatgctcacaggaagcagtgttctctatcttcacactgagctcagagacatttccaggttataaattattcattacctgtaatttacctgtaattgaagttattttaccacttaacatgacaatgtggtcagtgcttatgctgtgttatttttctcttggcttttgcagaatgggaagcattctgcctcactggcctgtcatttgtctggcctgtcatttaaaacccctggttgtttttaactgctcgagattaaaaaccataactcttcaggccagcagaagccacgttggtaatttgtaggcaggactcgcctttaataatgggaagatcaagtaagtggaatcagcccactggaattcagtaaataatgcctgttttctttccactccccgattgttgcctggttctttgtagccccaagatggatatcggatggtgcagcaattccagttcctgggctggccgatgtacagggacacaccagtgtctaagcgctccttcttgaagctcattcgccaggtggacaagtggcaagaggaatacaatggcggggaaggccgcaccgttgtgcactgcttgtaagtgcttgacagagctcttcatttcagaacagcgaggccccacactcactctcacctcctagttctctgacttttgtttcactagaaatggagaagaaataagtaggtctaggtgaaggggtgatcatgacactcagtgagggattggttggcttttcaggaaacaggatatgcacattctgcatttggatggtgtgccgctgccgcacaagcaagcactgaccgtttcattaggacccctgcctccgccgcccactgccaagagagaaaaaaaaaaaaaacactggctcttgagagccaattgttaagttttcaggaattttctgagctgggtcttcaactgttggtaacttgaattcatccatggtagaaggatttacatcatggaaatcaacaaatgctacaactcagggctccgtcccaccagccaaaggccagtttaccatcacattacttgattattcaattggaaatcatgtcaggtctcaaaggacctggagagtgtgtgtgtgtgtgcgtgtgtgcgtgtgtgtgcgcgtgcgcgtgcatgctttttgggagaatgtgtatattgggagcatttggttacagccaatgtccccagaatgaggcttccaggccagcaggttttgcaggtgctaaatatgggcacccctgctacacatagcccgcagccttacctgcacattgagaattatttggggagctttacatgaaaaaaaaaaaagcccacacctaggccacaccccaaccaattaaatcaaaatctctgggagtggggcccagacatgggtgttttttttaaatgcctaggtgatttcaatgtgttgagataataaggttgagagccactgaatggagaatgccatgtttctcaaagcactttcacctgcattttctcattggcagtgatatgtagctaatcaaccagctgcaatcggcttaatagaacaggcaattagaaagtcacggcagataaggaagatgtttagagaatttggggaaatttaaaggataagcgaatgtcacttttcagtgaagtatcattagaagtacacaatgagatctctcttaaattgaaggcaaaataaagtttcactccgggtagatcaagcctagttaaagttgcagacctggctcagggcgtgggttactctccagtcagtgcccttgtctgatgcaatgccacctcctaccccgggcctgcaaagtctccctggaagcccaggactctgcctgcctctcaacgatcaaaacacgatagtgtctcatcctgcaggaaactgatattcctttggaaggagccttaagaacctacccacagttgtcttcaaccagaagttccaatcttttgtcctctaaaaagcagtttattaacctcacctttctctagttgctgtcatcccccctttcttctcatggacccagtgcattaaaaaatctctgttggccaggcgcagtggctcacgcctgtaatcccagcactttgggagaccaaggcaggtggatcacgaggtcaggagatcaagaccctcctggctaacacgttgaaaccccgtctctactaaaaacacaaaaaattagccaggcatggtggtgggcacctgtagtcccagctactcgggagactgaggcaggagaatggcatgaacccgggaggcggagcttgcagtgagccgagatggcgccactgcactccagcctgggggacagagcgagactccatctcaaagaaaagaaaaaaaaaatctctatcaagaaaatgacaaaaagaattcattagcagtccacatccctatttttatttctcttcaatccagatccaacctctgatcagaacaagaggctcacgctgagatgatacaatcccagcaaagaatattaacattgtagttcgtttgtattagatatatcagatttttctaaaatactaaaaataggttgcagttacccctgcctgcatctggagacccccagcgtctggagctagatgtataatgcatcgctccccccgggattagcagctttctaaaaagggtcagtgctttaacccacaggactaagttactagtgactcgaagaagttgaggcaccaggacaggcctaacaagaagacataaagacttcttaaatcactgcaccttgtcaacaacacacttcccagaggcagctgtgaccacagaactaaccagtgacattgctgttccatgtaaaacctaaagcaatcagccgttcttcacagtggacggtgggaggcatccgttgtttcttctctcctgcctgtgcagcatctcttcccattttccactgagagaaccttgattattctttggaatactcccccctccctaaagccccgcctctgttcatgtggggctgtctcttgctctcttagcatcaaggtgggcatgagacctaggcctggtgagaatgtttatttttgtttacatttatatatctaaatctaaggctttttttagctataagaaacaaagttagtttacattggcatcccccagtactggccaggaaagaatcaaaccactccagtcttcctcttggaggtaagagcatggcattcagcatagtgtagcgccacctaacggctgtgggtggagagttcccggctgagacaagacctgccggtgctttgaagtgaatggttccttgagccacagatattcaaggtaggcaaatagagagtgtttttctttatatgtgtctcccagctaataaagctagattaaatggatagaattaagatttcaccactttgcaactcttgatgaaaataatagattagacagtggtcttcaacagctgccgaaagtattaggtgcaaagctgataggaaaagcggtgtaatggtaaggcaaggatagaaaacagctaatcttctaattagcagaagagacagtccagggacagatccgtacctcagcgtcatctgacttacaacaaagatgccattgcaacgcagcactgcagtgggtggggaagactgcctggacacgttggtctccctcactccatgtacagaatcccttctagatagatggtagaccaaaaggggaaagtaaaataacaaagcttctagaagaaaacataggagaatatcttcacgaccgcgggtagatttgttaaacaggacacagaacaatagccttaaaagaaatattgacaacgtggactttcattaaaattgagcccttctcttcatcaaaagatggcaataagagggtgaagaagcaaggcagtgggaggagacttttataatacatgtgtctgacaaaggactcggccacaatgtcgaagaactgctgtactgcaagccagtaggaaaatgatagacaactcaatttattaaatgggcaaaaaacttgacaggtacttcactgaagacaaaagatgtcccagcccagcgcagtggctcacgcctataatcccagcactttgggaggctgaggcgggtggatcacgagatcaggagatcgagaccatcctggctaacacggtgaaaccccgtctctactgaaactacaaaaaattagccgggcgcagtggcaggtgcctgtagtcccagctacttgggaggctgaggcaggaaaatgacgtgaacccgggaggcggagcttgcagtgagtcaagatcgtgccactgcactctagcctgggcgacagagcaagactctgtctcaaaaagaaaataataataataataataataataataataataataaagatgtcccgaatagccaatgagcatagaaaagttactcaatattattcatttttaggcaaatccacattgaaaccaggatcacatgccactgtgtactcaccagaatggctgaaattttaaagacagacaaataaatgataatcccaagtgttagtgaagctgtggagtaactggaactcttatacactgtaggaaggaagtaaatactgtacaaccatttggaaactgacagcatttaccaaagctaaacatatacgcagtctgaggctgagctcttctgttcttagagaaatgactgcagaaatgaatcatctaccaaaagataagcttatcacaggtttactcataatatttaaaaactggaaacagcccaaacattcatcagctgttggataaattgtacagtgggtattcattcagtggaattcttcttagcaatataaaacaataaactaccaatataacaccgtgggtgattctcacacagacaacacagagtgaaataagccagtctcagaagaagacatagtgtatggttcatttacacaaagctgaaaaacaggcaaaaacaattgatgatgctaggcttaagaatggattctctttggtgatactgatggtattgttgaggaaggaacgtgagggagcctcttggggactgaacgtggtttgtatcttgatctgaatggtggttacatggtgtatgcattggtaaaaattgactgagctgtctacttacggtctttattgtaggtatattatactttagttaaaaaactgattcagaatttcataatgggctgatcaagctgatatccgaacacgatgatctctcttaaaaccataaaacaagggacaaccagatatttttggcttgcttcctaatgaaagtatactttaagtatccttgtataaataaatcaatcttgaattcttaccaagccctggaactacctaccgatttacaggaaatacagagttagaaagcagcatattaaataatatcacagagatgtgatgaatgagaaaaatctaggatgtgggactctctacaggacacagatgaacttgtttcctcaacaaataaattctcaagaaaaaagagagagcaaagaggaactcacagagtaaaataaatttgcaagacataccaaccaaatccaatctgtggactttgcctagatgtggattttttaaaaagcatctgtaagaaacaatctgagagtggattttttaaaaaagcagctgtaagaaacaatctgggaaactggaacactgactagaaatttgataattttaaaacagtaatgttattattttaggtatgatagttatactgtgtactgtgtttaaaaataaaaaggtcccatggccgggcgcggtggctcacacctgtaatcccagcactttgggaggccggggcgggcagatcactaggtcaggagattgagactatcctggctaacacggtgaaaccccatctctactaaaaaaatacaaaaaaattagccgggcatggtggcaggtgcctgtagtcccagctactcgggaggctgaggcaggagaatggcgtgaacccaggaggcagagcttgcagtgagccaagatcgcgccactgcactccagcctgggtgacagagtgagactccatctcaaaaaaaaaaaaggtcccttatctccttgaggagagagtgactgcagagttgatgcagggatagtgcgggatgagcctggaccattatgtggttgcagagagtaaagaaataaaacaggctggggacttgtcagaaaagaacaaaagagccagcctgacggagctcccactggccaaagctggaacaatgtgaacaaaatcaatattagtacccttggattttagctgatagaataaaattattatgtataagctcacactgaaataaacaaatcataaaataaataaacaataatagggaagaagagacagctctttcttagtgtagaatgttgaaagagagggaaacaggaaatcaccattaggcaaacaccacagtgataattaattgttgcagacaagatccaccaacggatgctcaaatcagtgggcgagaaacaaaatatttgcgtagtcccaaaatatcttcctcccagatatttattgactgcaaagagaaagatgataactttatggtgagaaaatctggcagacaccatcttaacaagtgagcaagttaacatcaccagtaataagacagatggacatcctgaacccctgggaggagggaacatcccctctctggttttcttaccgaaatgcacggccttgtttccagtcatgagaagacatcagacaaacccaaatgaagggatggtctacatgttatagtttgtgatgacttctcagattgcggctggggacgacagctactttctacttctgtgttctacattctttatattctacaaatcactgatcagtgctcttcaaaagtgtcaaggtcaggaaatacaaggaaagactgaaggaaactaaggagacaggacaactacatgcacgactggatcctggaccagaaaaaggacattcgtggaggaactagtgagatgtgactacagtctgtggtttagttaatagtattgtcccagcatcacgttcttggtttgcataatgcgctgtgggcaagtaaggtgttcatatcagggaagttggatatgcattctctatgctatttttacatttctgcacatctaacatgggttcagagtaaaacgttttctttaaaaagagcctctatgttttatagataaataatgaaatgccaatggatttgttgttgttgttgttgttgtttgagagggagtctcgctctgtcgcccaggctggagtgcagtagcacaatctcggctcactgcaagctccacctcccgggttcacgccattctcctgcctcagcctcccgagtagctgggactacaagcacccgccaccacgcccggctaattttttttgtattttttagtagcgatggggtttcaccgtgtttagccaggaaggtctcgatctcctgacctcgtgatccacccaccttggcctcccaaagtgctgggattacaggtgtgagtcactgcgcccagctgctaatggatgtttttaaaggccagatacgtctttgaacgtaacccgtacttgtcacagcaattttcctggcagaacctaaataaggttcattgaaaattttctaccatgggcccttatcgatgaattgctgtatcagagaatgtgaccagggctgaggtgagctgggaaaggctctgcagtcaggtgacctgtggccaaacactgcggatggcttgctctgtttgctttaattaaaagaatctgcccaggtaagaggtcccccggcctcagagccctttgttgttactgttccccagggtttagacagcttgtttccacaggtgtttgcaagatgcagtgtaaagacagaccgagtgcagtcatctgatctttttcacgacaggaacgggggaggccgcagtgggacgttctgcgccatcagcatcgtatgtgagatgctccggcaccagagaaccgtggatgtctttcacgctgtgaagacactgaggaacaacaagcccaacatggtcgacctcctggtaggacaccccctctgagctgttccatgagacaccccattagcattagaatccactccagctcccagatttgcagggaaactgatgcgtagaggaagagactcattttcaaaatcacaatgtaatcactttgcttgtagggcttttttcttctttcttgttctccctcttcctctctttgttcttcacacggagactttgtctccagctcattcgaaatgcggaaatagctgaaactcacaagtgaacatccttattaacttcccttcctggcagtgccttccatgtggctaagcacttagtcttcacagagaagaaataatcatagtacgtgaaatgccagattttcaaattatatattttataaatagcttaatcgcctaatatttatcaaagctgtgaattttagtttgacatccagaatattgcatttaattatggtggccatatctgagaaaagtattaaaggagatgagaaacaaaggacaatgtacaattattttcttaagagtattttatgaaatctctttttatgtggagctgttgaaatgccaaccaccgtgactctagaatagtttaaaggaggaagcttttagattaggtttttgcacttctctgtgagtggaggaaggatctgtaggaaacagcaggactaatccaaggttggaaaatggcttgggggcaggagagggaggaagagatggccgatgggacaagcgccaaagccaatgttcccaggtccacagcatcacaacactggggttgatgttaaaaattaaaataaagggacttaagagggagttgagagtcaagctgaatttgaggaagtagccatggtcctcatgcagtttaagaagtcataatagcagtgctccaggctggctaatagtagtgaccaatgacaacgagctcccaaacgtgtcccactcatcacgaaccactctccagggcatccactttgcccagatacatgtctcgtgcctgatgagctgctccatttccaagaagcatggctgttggtcagaaaatttgtcacacccacttggttaggcacactctcacccatcagctgttagcatgttggcttctagaaggggcagaaaggactgtgctccccagactcctgcgcccctcctccccaccctacggggagcccatggaaacccaaattctagtctcaactctactactaattctagttaggtgaccccaaacacattagttttgtcatttaagtgtccttaagcatgtcacttaactcccttaggttttagttttgtaaactagggataccatgagctcactgaggtacccagtgtgcagagagatgtgaaagtgttttggaaattgcaaaggggagaggtggttgtagagagtgtaggagtctgccaggcgtgatgccatcagtggcctggcagaagggctctaagtgccctggatgtagtaacggatttcctgtgggttgttgaaaggctggtgtggggcttcactaggaccgtctccctccctgcaatcccacctgaatggtaaagagttctaccgccatggaattcccagtgttccaggatggaggcaattgagcaaagagtggccatgctgtcggcagaggcctgagtttgggctagcagaggatagaaacaaatgcacaaatgaaatattctgcctgtggctttgtgaggtagttaacctcactaattcagggacaggtatgtagcctcgagactctggttggtacttgggcacagctgaccttgatcaaaaaaaatgtcacttccctctcactgcagcctgaattaagcacatcattagaaacagacccttccaggcctttcctctaatggctccagctgcagctttcatcactcaccaggttttatgggcaggagtgatggggctttttccaaatcagtggtgcacgctgaaggacaggggtgatttttcgtgaaataaatggaggcttagatggccgaaccagaagggagcttgcggtcccagcccacgattctatcgtaacttaggactttttgtattatgtgtgatcctgagggagaagatgggatttctgggtgcccagacctccaaagtcagcagcaggtggaggataaggtcagggtctgagaaatgtaggaaagttttgcaatgtctggagaaaactatgtgacatatctgtcacggggctgttagcagggtattagataatatctggtgacaaagaaaatctcaccatcctcttttcagtgggtttgaagcttccagaactgaataggacctgttgtcatttggttttgcctgtaaatacgacttctgtttagtttggtgttgatacctctgtatgttgtctgagagaattaattagcttaggccagggtgataaagtctggtacagttttattgggcatcacaggccatctgaggcctgagtgtgtcctaagcacagaatgttgtgccagcagctgaaaagagcagtgtactgagtctacttagccgcgtcttcagaggatgacgagcatgtgccagacagccctgggggcacttccgagtgtctgcagaggcaggctagggtgcaatagaggggccctcgccccagccccaccagatcacatgtgtggctgcattccctcatggtcccttccgttcagaacaggcaaatgctaccgctctaccctccctgccagggcgggtgagcacacagagggacgctgtgtctctcaccatctccctttgcagctctgattgttctaaattgcttctgagtgggaagattcgtcggttcgtgttgaagcatgacactctccagggagatccagaaagccctcaagatgtatttctgcaaatttttagctttgggagctctggagaaaagccagtggattgccaggaggcaaaatagtttctaatacaagactagatttttttgtatccagcaggggcagctgcatttttcctgacccctttttcagcccgcttctaagttatccatctcttcaaccagcctcaagtccccatcaaagaactgggtccccagaggatggacaaggacagcacagcctgagattccccacgactcgcctagttatattcagaaggagtgctggcacctgagctcctttgaagagactccggctgcaggaaagcggctgcttcacgctggcagctcccctctcacttttgccttccttaatggcttttgaagttcccagggctctgttttaacatagaaatggtcttcaagggcagatcttgcctagagaaacatagtgtcccctgtgaggtggtgggaactttggaagactcccctccacagcctagtgcactgcccaggaagtgaacaactggccccatcatttacccaaatgccttgggcagggctgacaaagctgcctctgcaggtaattacacactttaatatggagtgcagtggcgtgatcatagctcactgcagcctcaaacccctgggctcaagccatcctcccacctcagcctctcaagtagctggaactaaaggggcatgcaaccatgcctggctggttttttatttttatttttatttttttagagatgggagtcttgcagttttgcccaggctggtttcaaactcctggcctcaagcagtcctcctgcctcagcctctcaaaatgctgggattacaggcatgagccacagtgcctggcctggcatcttatcttagtttcatgccattctgcacatatttctcagcctctgttctatgtgcagcatcactgggcattgatgcaagagaagtagaagatacagtctctcccacatggagcttagaactcactggagatgcaaaagtcctacctgaacctcagttttctcatctgtaaagtgggagtaagaatattaagcctggccaaacacggtggctcacgcctgtaatcccagcacttagggaggccgaggtgggcagatcacctgaggtcaggagtttgagaccagcctggccaaccaacatggtgaaaccccttctttactaaaaatataaaaattagccgggcgtggtggcaggcacctgtaatcccagctacttgggaggctgaggcagaagaatcacttgaactcaggaggcagaggttgcagtgagctgagatcgcaccactgcactctagcctaggtaacagagtgagactccttctcaaaaaaaaaaaaaaaaactattaattcagtcacaaaaggccacatattctatgactcctgtgtctgtgaaatgttcaaaacagacaaattccatgagacagaaagtagagtagtggctgctgagggctgggggagggagatgggggtgactgctgataggcacagggtttctttctgaggtgatgggaatgttttaaacttagattgtatataagtctgtaaatatactgaaaaccactgaactgtgttaaagtacaaaattacaacacatttaatttgaaggtctaattggcttgtattagtgaccctagaatcaggcaacatgtcattctgtaaaatagaacgagtgctccaaggagctgagcagaggaggctgctttataggcagaaaaaagcttgagaaggcagagacagggaacacaacgcagatcggttgtttcaaacttccttccatcatacggttaaaacagaagggacttctttatcatggcagctcaggaaaaccgggtcgcttctgactggttgttgcacttctcctgatgtttggaaagctgccctatttcaaagttcagttggatggcgacgtagcacctagcacgagggactccattctggtttggtctagtctgtcagggcctcatccaaacagtggcctctcatgaactttatgtaacaactgtatcctttaaagaggccaattttatggtatgtgaattatatctcaacaaagctgttgttttttacaaagtaacatcaaaaacaacaaaaaagaatactgttcatagaaggctacggggcttttctgtttatggaacatgtcccaagagttatcttgttatactcagtcaccttcaccaaagccagaagaggtgctgccgctgcaccccctttacagagaagtctagcgtttcgtcattcgtgcaagccaaatccagatccggatccctcctcccagctccaagcctgctgatgttcaaccaccctacaaggagccccccaagctttctcccagcctagaggctggacaccagcggggctctcagggttcatgatgtgtggaaaaggtaagggaaaaaaatcgacaactaaaagccattagacgaaaattccaaatagaatgtagccggataagcagtcccaacccacctgggagtctgaaagggagggccctgtaggaaggtgatggtcataacccttcgctgggttgatttgttactgagttgctgggagaaatccaggataaagggtggtaaagcagtgcatgctcttgcaccgggagaaaaagggcacaggttagtgtaggggacctgggaacagggcagagctcaatcactgtgtgtgtgagcttcatctcagaccaggtgtaacaggaacagccccgtccaccatcacgtgccttgtaagattcagaaaagagcatctcctcagtggttctcaagcctggttgcccactgaagtcatctgggagctttagaacaattctgatccctgggcccacctggagactgattcgattggtcaggggcctggctgcagcagccgagtgttaaaagcccctggtgagtctcatgtgcagcctagcttaagaaccatgtctgctctagacgcagtatcagcccaggctgcacttgagaatccgcccacccccaactcccgggggagctttcagaaataccagtgcacaggcctgccccagcccacttcagccagaggctctgagatggagcccccgccaggtaggatagacgtgccacacggctgagaaagttggtgtaggaggatcagcgggcctctcccttccctgcagtgccatgcggcggtgttcacagctcgccgccccctccccctccgtcccacttactccagagccaggccccatcctgatctgcggatctgccgcacaggttcaggttgccccctctgtaacttacagccgaccctccagactcagcctcacctcccctttagtaagccaacaatggactcacatacaaaatgcaatgtggtgtggggcctacagctctcccccttgtgccaccaactggtgtgtataggctgtccctcaatagctcttgctgtgaaatttgcagcctatttaacggctgtgcatgtgtgtgtgcatgtgttggggtggtgagtgcaggagttgggtgggaatcagaggtgagctagggtccccaatccacactccaggcaccttgaatccacccatggtcagtcttcctgcactgttgaggaaggtttgtaataatttttgctaataccccatcccctctccccacccccagattccacttgcccatcctgccccctacactcagcaccagccaagcgcctggctcccaggagtttcccagtaagcattttctgagtgactgaaccattcttctctgcagccagacctgagtccaacctgagccaccctttgctgccctctccaacctaggggaggttgtggctgtgctcagcagggcctcaataaggaactgggcatggattttgcagggggctttggtgaagaaagttctacctataggtattaaagatagagattaagggaatgagccactcatcattccagggacatgctgctgtctcgctgagcagggatgagaatttattggtctccttggcacagagtggctggccacaacctggctgggaacactgaactgagggatcccaccacggtaatagggcccacgctgcccttctggcagggcatcactcagaagaatttttccagcccgaaggatctgtccgttcagggtctagccaaaatcatagagcttgccttagtttcaaaagcaaccaggtcagaggtggaggctattctctttgaacctttggaggccgttgatgtggtgtttgaagtgcccacgctggccgccagcctgagttccttagacacaggcagcctgcgcagacgacaaggctcgggcccctgacggaggcccccagtgccgcccgctggtgtgctggcctcgtgacgccctcaccaagctagcagtggcttttaacagccaacctcaatttccagttcccttgcacattttgctttctcccactcataggtacaggaagtctgatcgggagcggggccagcgtcagggaccttggtgaggaatagcagcaggttgccctggttacggtctgacccaaggatgtgaggaggaccgggccaggctcccacctgagcccctactcagggcacctcctcatgcccgaagccagctaatgtcacccaaattggagcactcaggaccaaggcctaaacattcctttttcccctggagcacagggatggctcatgtggcttaattatactgttcaaaagggagtgagctgagagaggaaactgcagcagatagacctatacctggtaatcaaatgtaatcagtttccaatgtaggaagatttcaggcatttacccaggtgcttgggggaggggacacaacaatttgtggtcttccttctctttccccttatttttctgattcagaaaccagtcatcacagaatctatggggactgggtgcttgctcaggaaggataaggtgggagagggagaattcattttgaaaattatagtcatgcctgagacagggcagcttcggtgacttccaagcagcagctccttagcagcgaagcccaaaatccctcctgagtttccggcctgtgttgtggcctgagggcagcagccacatctctccactaggtgcattttaacatgttaaaaggaaatatgttaaaaggatggctctgagtagccactgaaattaattgcacaattaggcttgtataaaatcttttttatgcagtaagggatgggaccgtgtagatttccattacagaaagaattgtccctgtgattcacaaaagcatgatgggagcacttcacagccaagatgtcggcctggtgatctgacaacgtggccttttggaattttgaaattccaattatctcttttaaatattctgaaaataaaagtatcaaatcctgaaataataaatactagaatatgaatcagaaatctaattttgcccagggcaagaaataattttttccagttaaaaagttaaaaaaatacttctacctttattggcattgtgtgtggaaaaagtggtctatttaagggaaatacaggctagtaaaatatttgttatttgcactaggagataatttaaggaacaccttctcaaatgtcatcagacttactttaaaggcaaaccaagtccaaaagttctaaattgagaaagctggaagggaaacttaaatatgatccaaccccctgttttatgaccagaggggaatggattggccaagatgtcggggatggttaataggacctcaggctcctggtcagtgtggggcactcagacccatgagtctagaaagcaaagaacaactggattcatgtttcctatgtcagagtccacccagttgcagttccacctgagtccttcacagacattaaaggtaggattcacatcatggaataagcatttttctactagcgatttttttaataaagctttattggaatataatttgcatgccataacatttccccttttagatggaaataatagacactgggaactccaaaagagcagggaggagagggagggttgaaaaattacctgttgggtataacattcgattgtaatcagtttccagtgttttgcattcctaccagccgtgtaatgcactatgaacattcatttgggggatgaataccctaggagcccaatccccaccattacatgtgtaatacccatgtaataaacaagcacatgtaccccaaataaaaaaaaatccccttttaaagtgtgtcattcactggttttcagtgtattcacagagttatgcaaccatcaccacaaaccaaatgtttaacatttccatcacccacttagccccctcaaagaaatcctagacctactagcagccactccccattacccacttccaggctctggcaaccacccttcagcttccagtctttatagatttgcatgtgctgggtgttttcatagaaaaggagtgtgtgcccttttgaatctgatttctttcactcagcagattcatccatgcttcagttcatccacgttgtaacatggattagtacttcattccttttcatagccaagtaatattccactttatggctatactacattttattgatgtacatttgagttgtttaccctttttggctgttaggaataatgctctgtgaacatttgtttacagagtttttgtgtatacgtatgttttcagtttccttaggtgtacacccagtagtagaattgctaggtcatatgggaattctgtgtttaaccttttgaggagctgccagacggttttccaaagtggctgcaccgtttgacattccctccagccgtgtatgagggttcgctttctccacgccctcgctaacacctgcgattttcttgttatgtgagccttctcgtgaatgttattccactgacattaatctcatggcaccgtcagtgattgaaatgatcttcttgttctctgtcttcgcctctggatcatgaccttcccgaggactgaatgtgtcataaaatccccagtctctagcagtacatgtgtattgagttggatcacatgctgctggacccatggcttgtcatcatgtgtacatgtagccgactttgactctcaactgtgtcagttctgggctagagactgttactttatacaaagagagataaactgtgtcccttgtcctcaaataaataggttggactactagggtatttacaaaacagagtgtaggtgaagaaaaggaaatttcagtgacaaattaggaggcacttaagaaatactggacgttttcaattaatttggcaaaatgaaaagtaatagatacatttccttggttgtggctgtgatgggtagagacagtggtgctgaacctcgctcacacatgtgaaagcttgtctgctccagaagtagaagagagccttccagttgctaaggctctgtccagggccgggctcctgccaggtggcaggcagaggcttcctcaagccctgcgtccctcttctgggttcagagaccactcccaggcttggttctatcagcacactccatgcatacaggtgcagaatgctctccccggccacccgagaccacacctcagccaggaccttgtgcagagcttgcttgggccaaggtacacgatccaggaaagctgagctcaagaaaaatgaatccaatgctggatgtggtgactcgtgcctataatcccagctaattaggaggctgaggtgggaggattgcctgagcccaagagttcgaggctgtgttgagccatgattgcaccaccgcactccagcttgggtgacaaagggccatgtttcttaaaaagaaaaaaaaaaaaaaaagaaaggagggagaaattaattccctgtctgatgaagaactggtctatgggtcccagaggatctcaaacatttccccttctgtacctttcctcgtcctgttgcctccgcctggaatgcctgttttaattaacgggtgaggatggccacgtactttatccaaactagggcactttgagagtgaaagagggttatgccaggacaacaggcagaagccaggaccgtccagggcaaaccaaggctgcctccactccacgcatcagttccgtcctctggggaaggcgctgtccacttcccactgccatcttccctaagaagacctgccgtcccctgagcatagggaccattccacctcatgtgttgtcattgggttacctgtctcatcctcctcactggatcacggacttctcaaaatcagggaccaggtcaaggggcttggtattcaggaggtgcttatgaaattctcatgagattgaggaattcccacagactgaaagtcaaaggtaaagctggatcatgcatgaggcctcatctaggtaccaagggccttgtgagagatgtcaggaaggcatttcctgaagcactcgttactttctcttctacccctgaccctcctgcacaaagctcagcatgttgatatcctggaaaatacatgtgtggacaaacatatttagagttccaagtgtccagaaccttccgggaattctagccagcacaggtagcaaaataccttccacccagcattgtggggagcatctccaaacagtgaatgtatctggagttcagaaccgtgactttctgattcatttctaattcaaatcctcccagattgatgtcttcccattaagaccctactctatggtaattgctttactaggaacagcgttgagatattcttgagctgacactttcccctcctgttttccaggatcagtacaagttctgctacgaggtggccctggaatacttgaattctggctgatggtgtaaacagctctgcaaacaatccctttcataccacaaagccaagacgttccatggtatttgtgcaaaagagatgaagacttctcaatatgcttattttgctttgcataattggctctttttaagagcccaagaaagtgtttctaaaattgcttgcactgcccaatcccagtaatgctgctgcctgacagaaacacacacacagccacagttgccaaatcccgtactccttgccaccggcttcctagagcagcgtagacagctggtaaactgaagagcacaactatattcttatgaaggaatttgtacctttggggtattattttgtggcccgtgaccctcgttattgttacagctgagtgtatgtttttgttctgtggagaatgctatctggcattatggtaatatattattttaggtaatatttgtactttaacatgttgcataatatatgcttatgtagctttccaggactaacagataaatgtgtaatgaacaaagatatgttgtatgagtcgtcgtttctgtcagatttgtattgtttccaagggaaaagcttgggggaggactcagttcacaaaatgcaaaactcaacgatcagattcacggacccagagcttttccatgtgtttatattgtaaatatttttgatttcatcaaattatttattcattaaaagaaatttttgtgaagcacagtgagtgacaatcatttttcttaaggcctggaaacgattttctgtatgatgttactttatgtgaattctcatctcaataaatgatgacccgtgagcagccgtggcatgttcctggtgtcccagtgcacaggcggtggaggccgcacccgacacgccagcacacagggggagagagtgcggccggggcctgtttgccggagcaagtagagtagagtttttttgagagagagtgttcgtcagtgagagcactgagcccttcacggtggcctgccctggtgccggggaggctcagccatgagcctgcaccatggggcgtgagccctgaccttgtggggcagccaggccaggggccatggcagagacttgctaactggagcatcgtcttcctttctctgtttcccctcagtctgcgggggataatatctctcttctctatgcctcaggccaacctaagacttgctgagagaacagtttttaaagggttagagaatcagagtgcattgaaggacaccgagctgaacaagttcccaccagagcacctgctctgcgccaccctgggctctggccgctgacacagaaggcaggtgcacggtggccttgcagcttgcatttagcttgggttttaggctgtgttaacgattgccaagagctgacagaggcaaagctctgtcgaacacctcttgtgaaccagataccatgcagagcatcttcctgtgtggtagcacgtgctccccaaacatgagccaggtacaactgcgaaacccacctgacagatgaagaaactcaagctagaaaagattaaataacccgtccaaagtcacactggctagcaagtgccagaagcctccagagcccatgggaggtggaagggcagcaccctcaccatggcagaggagcagagtctgctagtgccgagacagagactggcccgccacccgctgtgggaagtggagaggcttgagggcactgttcctgcctgctctggggatcttggtgaccaaagacttcaagggcagaggttgccctccaagaggactgacctggacatctgcgtgttagacctttactgcttcgctgtaccctgagcaatctatatgccccgattggtgtaagtttctctagacccctccttaaactgggtgggtgggaccctgtcctcccccaggaagagctggctgcagcggagcttcgagtctgtactcaatgcctcacattcagactcctcctggaggatggcccctcgccatcccacccagttctctttgctaagctcctaagagactagcaggctgctatttttgt

SEQ ID NO: 14180 - DNA, 9350 bp, Human
tgaatttgcattcaataaacaaccagactcagttcttggggcccttgtttgcactccctctgggtggagctgttgaggatgaggggagaggcggaggtcttccatttccccattcttcaagccatggccctactgggaactgcaattccttgattctcccgtttttcctgtccctccagcaacagcattaattcagtaaacatttaccggggcactgtgctggacagaggccagttcctggaaaagcctttcccacgccatcccactgcagacatccctccttacctccccaggaacagcagtctctgcccacctggccccgcccaccagactgaggctcacttcacctctgacctgagcggcccccagctcaccaggccacaggcccaagcagtgctccctgatgcggcgtttataatccgctcagcgtgcaggccgaggcaggagggtgatgaaagctgggcaggctccaagaggagggagttttgatatgtccctgaaagattcatttagacttcagtcggctaaggaggacatgatttgggggccaaggaatctgttgaattcagaacacaaccagaggtctgcagggtcagggatggaggagtgggctttcccctcgccagggcccactcctcttcctgcttttcctgcaggcgccactgggaggtgctatggctgtgcctcccctgggctctggagcatgtccagttgcagtgggcagaactgcggaggcgggcccctcctctgccaggcctggcagccccctcctagggccttgtttggctaggggtggtgccgggtgtggcagtgtgtgtgtagtggagagtgttaggtcttccctaccaggtgcccttgcaggggagtgccacagcagtcagtccagggatcccactgttagtctcaccttttttaacctcttatctctccccaggatccctgaagccaggtacgagcaagatgagagtgggttatctctggagtgacagaggctggtctgttttccaggctggtagggactgttcctaaagggaggaagggatgataccagcctcctgagcctccttctcctgcgttagtgtctcaggccctgccaggccttatagaccctcttattgacactgcccactggatggggaccggagttggactcagcttctgccgaaccctcaaatcccagccccaactaaagcatataactcaagacctacctgcactgaaagctcttctcaacctgagcagggtggtccaattgaaagggtgggtctgaccacctctcctgcacccatgcgggttggcagaggtgtgcaggatctgccacttaccattcaccatgtggccttgaggaagacgcactcggggcctcagtttcctcatctataaaatggggatgtaattacaccctcacactgtagctgtgagtattcaatgagagcactgcaaagggcctggtgtggagtaggtcctcaggaaaggttggatcccatgtcccatcagagctaaaagccccaggaggagagggtggctggtttgtccccacaaacccctgggattcccggctccccagccccttgcccctctctccagccagactctattgaactccccctcttctcaaactcggggccagagaacagtgaagtaggagcagccgtaagtccgggcagggtcctgtccataaaaggcttttcccgggccggctccccgccggcagcgtgccccgccccggcccgctccatctccaaagcatgcagagaatgtctcggcagccccggtagactgctccaacttggtgtctttccccaaatatggagcctgtgtggagtcactgggggagccgggggtggggagcggagccggcttcctctagcagggagggggccgaggagcgagccagtgggggaggctgacatcaccacggcggcagccctttaaacccctcacccagccagcgccccatcctgtctgtccgaacccagacacaagtcttcactccttcctgcgagccctgaggaagccttgtgagtgcattggctggggcttggagggaagttgggctggagctggacaggagcagtgggtgcatttcaggcaggctctcctgaggtcccaggcgccagctccagctccctggctagggaaacccaccctctcagtcagcatgggggcccaagctccaggcagggtgggctggatcactagcgtcctggatctctctcagactgggcagccccgggctcattgaaatgccccggatgacttggctagtgcagaggaattgatggaaaccaccggggtgagagggaggctccccatctcagccagccacatccacaaggtgtgtgtaagggtgcaggcgccggccggttaggccaaggctctactgtctgttgcccctccaggagaacttccaaggaggtgagtgtgtgaacgcacctgtgttggagcacggtgtcccactctggcgggtccccagggcctgagcagcagcgatagccctgtgacaatgtgaagggccacagaactcttgtattccagtcaggggcaaagagtggagacggaaggcctgtccttctgacaagcagccccttccactgtctgacagtgggaggtcacccccactgtagcagaggggtggggggcgggtactgccaaggaggagctttggagtgataggcggggcaggcctgggacccttggtctttcccaaagggtggttccctttcaaagttgctattccaaaggtagcagtgaggatggcacaaatttatgtagccaggccactcctgtttgtccgtggagtggagaggagccaccctcctgccctctcagaggtccaggtgtgctcactcctatttgggaagagagaaggggcacagcagccctgcaggggcccctggctctgctcgtgtttctgggcttctgctggtagggggtgcgaccttcccgtttgaccctggactttctttctccactgcccactttcacccactgggcagctcaggggaggggtcctggcaggagccacagggcaggagggtccatgcctgtccatgctgtcctgggagtgtcttgagatgcccctgggggggccgccctgtaatcatcctcctctccccctccccactggctcgaaggcaggactcgggaggcttcatcagaggactctaaaggatttctggggattctccacttttcgaccctgacccaggaggaggaaggggaaggatggtggtgctgggtgggagtggggatggtgtgtgcttcatccccctctgaccgaaatcctaatcttgtctctagatctgggggctgcagtgttgtgtacctgtcacccttagccttgctgctttgacctgtattgtctgttctgaccctcctgagactggaagctgggggtaggggacacactctccttccatcctgttcctcaggagcccagcaggggtgcagaaggggaaggcagacatgagggcaggtggagtgggggtagaagcagggccagagacagaaggtggatgcctgtctgggatggtggtgcaaaggctgagacagaggctggggtggatggaagccaggatgcagggctaccaaaatcacctggtcccagctgacttgggggtttggaccacagttctttgtgcaggagtccttgggtggttggggagcgggggtgggacacacagggtgaagggagggattggctgtttgtagctgaacagcagaacagagcactctgcctttggggtctctggcatcactggcagggagaggggtggctgggccaggagcccacctcatccccagtgctcagagaactgggtcctcagaagtggtcccgcccccactttacacataaggaaacagacgcaaggaggagagggatgcccaatgacgggcacttcgatgagtccgtgtgaactctgttccgtgtgagctgctgcgcgctcagggaatgattgtgagaagcgggtggaggctggagtgggcagcaaagaactgacattttgaggtcagtttttcactccttggtcaagggcaggctctctccctggtcattaccaggagcctggctccgggcagcaaagaactgacatttcgaggagctctgctaagggccaggcagtatgtgagggagttcacagacaccgtcccattttcacagccctctgaggttggtaacataacccccacttcacagatgaggaactccagcccagaaagcctgtcagccctgagaaaggaagggcagggcatcgggctgggcagctggcctgggaccagtggggtgtgatagtgttggctctgcttcccgcgggtggggtgccagtggggaggggtctcaccagagagggagccgggggagtgcgctcctgcgtccatcctcagaccagcgtgtccctcccaacctctgacccctctgaggccaggggatgggttcggcttcctttggtacctcttttggaagtctcttcagacaaacactggagagaaggcacagcaccctagggtgacatcagtggacaggtcagtttcctgttcctgttcccagccacccctgtctgtctgcccagggacctacctgcctggcccactcctgctgccacccctctccatgagtgggactcctgagcagtgccaggcccaggccctcagggtggcagttgctggatggggccaggcttcccattccctggcaggcagactcttggctctggaagatccctgggggactctgacttcttggttactcaggctactccgtaagggtagccttacgagagcgtaagggcatgaggggaagtcgatgggtagaccaggtgtctctgatttctctgaggaaatgcagcttctttgccaagaactcttgggctttggtggcttcgtcgcccttgcctggggtgggcgagttttagtctcttcagctgcagaccagaagctgagctgacctgaaaagagctggagttctggagttcgggcttccaggccagggcctgcttctgggtgagagtgggaggtaatggttgcttgaggcagaggcagtaaaccctcacacccgcagctggacaaaggcaccagctggctgtattctgtgggggcaatgtggcttctggaaggtctctccagtggctctgtagctggtcttggcaaagaatgttctagaccaagggttgtcaaactacagctcatgggccaaatccagcctgctgtctgcttttgtaagtaaagttttattggaacaaagccatgttcatttgttacatattgtctatggctgctttcacactgcaacagcagagaccatgtgtcctgcaaagcctaaaatatgttctgtcttatcctttacaaaaacagtttactgacccctgctctagacctccaaagacctggtatcctctttcctggtgttcaagttcagagaggtgtctggagtaggggctgagcctggcctggatgggcagtgctgtgacaagtgtctaggatggccgggtatcctgcacagagctagaaggctgcctggcacgggtgaaagcagagctgctccctgaccctctgcccctccctcctccaccctggcctgctttagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtggtgagtggcaccctgggctagggcgctggggggctggggtgtgccaccctgtgagtcctgggccaatccctgagctgactgctaagctgcgtcctatgccctatgcctggtagattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggtagagaggaagaggctgggggaggaggtgggcaggaggacagggtgctgggacagggagagggaatgaccagaatatgccacaactaggggtgtgcttgcccgcacacagcagggatgggatatgccgagaataacacgccacgctcacagggcccactgagaggcctcccttgaattggggacaactcttggccctggtttggccatttttttgtgagagacgggggcaggccctggcttggagtcttgtttatacgttcttgatgttcatctcctctctcctgtcttctcacaggcaaagacatggcagcagtgcagaggaccctgatggctttgggcagcttggcagtgaccaagaatgatgggcactaccgtggagatcccaactggtttatgaagtatgtggcccccagggagcttgggtctccgcatggggtgggaggtggcttgttctaaggagcttgcgggaaggattaggggaagcagatagccaagaaaggataaagtgagggtctgggatggggaataatgggtccttaatactccttgacccctccctttccaccctcctgcgctcagtctccctagcctatgaggcaagctagattagggaaaaaaagtgcaacaggaaggcaatgggattgggctaggacgtaacagagggatcagaaaacgggtggaaaacacacagttctaccaagtctttatcctggttcctcctcttctaggaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttgtcctggaatatttttggggttggaactcaaaaaaaaaaaaaaaaaatcaatcttttctcaggcctggctggcagagtttgatttgccctggtcacttttgttatggtttcagatctgcgcaggggacaggcaggcatctcgggcttgtatgtgttcctggctgccgtcctctgaaggacccttcatgtgccaagattccaggacagtcagattctttcagaggaaacaggccatagaacaggagagtgaatcttggggaccgaagggaaaaaggagccactcagcagcatgcagtggctttggggagacagaggaaaggagagattgcgagtggcagaattgtttggaaggtttttattttggaaaagctgtgcagaaaaaaattcaagaaaatgttgctgtgaaaagagaaaaacaaatcttaagcattaaaaaaaattcaaccaactagctcagaagaggggagaaggccaaggttgagagaagagtcacagcctgtcaggcagatagctggcctccggcgggaaggccatttccctgagcacttgcagaggaagacagggtggtggcaggactggagtggcagtggctcccaaggctctctcctccaacatgtgcatctgccatctgctctgcagtcctgccgcaggattccctagtgaagcagctcaggcctgggggagccgtgtgtatcccagctgtgccggcagcatcataccaatcgtgggggtggtgaaggagccaggggttcattcatggttggtttctgatcaggcatcttgggaatggataatggaggcagccgctttcaggacaggcatgtccaggggctcctcccagcctctaccccgaagtcctcttcccaagtgaccccagtgatgtttccattgagatgcgctcctggctatggcaggcaccttctcaacttatatgtgggaaggggtcccccatgcttgggggacctaggcagctggcttggcccaagagagatgaggatggaggccaaaccaaaggggggcgccaatcccctgtccaacaccttctcaccaaaagctcccgtttggctggaggcagaccctgtggctctgaccagacttctctggcagcaatcctccaccatttgtatcttaagaaggccctcaccctctttgagtggagtcagaggatgcctcagattccagatgtaagcatcagaactgctttctgtcaagagctccctaattttgggaaagaagagcctgtcccacactgtcaggccctgaggtcagcagatctgctcctccttcccgtgcggtacgtctaggtgctgatgagggcagtccagggcgctcttgttctgggacaggctccagtccccttgctccagcaggtctggggcaaggaggtcagaggtggtgggagggcccctgctctctgtttccacttcgtctggatccttgctgctgcaaagtggcactgattctagctctgtcccttcctccttggctttccggctccgatggggccagtggcagggtccactcctacaaacttgattggaagccacattcctctggctcaaatatacttccagcatgtagtaaacggtccagaagacggtgaaacagcctaccagcaccagggtctggggccgaggcaagcacctacgtgaggcactgtttcccgaagcctacagcctttctcagcccaggacaatgagctcagaaagtctttttccttctagggactgcctttttcacccaaactgttccctctgccccctcccccgacaaggcctgtcctgtaagagttaggctagcagggtaggagcaatgctatgaaaccactgctgggacccaggtcttcccagtccttcaccccgcaggtcaccctgagaaacacactaagaactccatcccccagacaggacagtcccatctacccgcagcttgagtcttggccctagtaccttgagggtgttgggggtgatggtgtaaccatcttcctcaggaattttcagccccggtgggcagggcagggcgaagtcatcgtg

SEQ ID NO: 14181 - DNA, 14761 bp, Human
agttacagattgaactccttgttctactctttccccacttctcactactgcacttgagtagtcttaaaaaaaaaaaaaatcaaattgccccctttgaagatgacatgatacctagtatatagaaaaatctaaagatttcaccaaaaatctcttataactgatacattcagtaaagttgcaggataaaaaatcattatacaaaaactagcatttctgtacaccaataaggaattagctgaaagagaaatcaagaaagcaaccctactacctaggaaaaaatttaatcaaggaggaaaaagacctctacaataaaaactacaaaacactgatgaaagaaactgaagaggacacaaacaaatggaaagacatctcgtgttcatggattggtggattggaagaattaatattgttaaaaatgaccatactttttttttttttttttttttttttgagacaaggtctcgctctgtcacccaggctgcagtgcagtggcacagtcacagctcactgcaaccttgacctcccaggctcaagcaatcctcccaccttggctcccgaataggtggaactacaggtacatgccaccacatccaggtactttttatttttatttttgtagagacagggtttcaatttgttgcccaggctagtctcaaactcctaggctaaagcaatcctctgtccttggcctcccgaagtgctgggattacaggcgtgaccaccacgcccagccctcacgttcttattcctatgtgggggctaaaagagttgatcttatagaggtaaaaactagaatgagagctgagcgcggtggctcatgcctgtaatccccaccactttgggaggccgaggcgggtggatcacctaggtcgggagttcgagaccagcctgaccaacatggagaaaccccgtctctacaaaaataaaaaattagccgggtgtggtggtgcatgcctgtaatctcagctattctgggagggtgaggcaggagaatcgcttgaacccgggaggcggaggttgcggtgagccgagatcgcgccactgcactccagcctgggcaacaaaagcgaaactccatctcaaaaacaaacaacaaaacaaaacaaaaacaagaaaataaacacacacgcacacggaggtggggcggcggagtggcggcagggaggaggaggggagaggtaagaaacaaatgataaaacaaatgaagcaaattgttaacaataggtgaatctgagccaaagtttaacgtgcgttcttttgccctattcttgcaacttttccaaataaaacgtttctctaaaatcatgtctaggggacctggattccaagccgagccccttttctcactcggtgcatgaccctgaatgaattccttcctctcggttggtctcagtttttcagcacagatggttctctctgggtctggtaatcaacgtctcacaactctgaggacgtttgcagacagggctttggaaggaagacggcccttcgtttcccccaaagggtctcagcctgccggtgatttcaccacgacttcctccagagttccacctgtcctcttcatcagccatgaacttgcccctactaatttttgccaccagctggacgcccacctcctctttcccggagccctaaggctctccttgcggcagtcttagcctctgtacaggataggcacgtgcatttagccccagaaaactacagcccccaaaaggctttgcggcaacatcctcgcgttgatcaccaaagagaaaacgcttttctccgcgggcccgccgctgcatagccttttgggagttgtagttcatctgctaagagccgcagaaccagggtgaggttctaagccacccttcccagaactcacagcgctcttccacaccaataggaagcgtggatcttggaaagcgggcggggcagaggagctcatgcgcagtatgtgtggttggggaattcatgtggaggtcagagtggaagcaggtgagaatggagggggcggcaaaggctcgtttctgggcatctctgcagtcctcctctgctccatgatgtgcactttgggcgaggagagtgcgtgcgtgagtccgacttgtgagggaggggagaaggggctgagcccgggacgagccaggggttgctcagagtaagggaggtgtccatggaggcagggtgaggaataatccagaagctattacaaatgtaaagggccgggtgtcccagcctcagagaaggaagatttaaatgcactggacgagatcagggtagtctcaggagttgaggtctgggaagtagggagggaggatttgagactggagcgggcaacgacggtggggcggagcgttagaaagttacatgctggcgtgatttctagttaggtcaactgtgcttatgcccaccccgcctcagccccaccctcccagttattccagagctcactgtccctgtgcagctagttagagcctttctcccaaatgggttcttcagttatcttggccccaggatgtcatccagctcctgcttccataagaagcatgtcgttcttaatacacgatgttgacaagcagtatggtgaggaggtaagctgtgtctgctagcattagacctctgggttctaattctggttctaccacttaataactgcaatctcggcttctcatgtaacctctctgtgtgcctctgtttcctctgtagtaatatgcttcatagggtaattgtgagaagtaaataaattgcttttattaggctacctgatataagtgttagctgttacggttactttttttgttggcatcaacatgtagcacattttttaagttatttttttcaaaccataattgcaccaatctaacctcacagcctctttttgggggcctacttgtccaggaaatgagagggtggtttagtgtggtgctaagttctctgtggatttcaagcccatgcattgttttcattattgaaccaagtgtcccagacaccttactttaaatggttgagaaaaaaagagaaatcagccaggcatgatggctcatgcctgtaatcccaacacttgggaggccgaggcagggggatcacttgagcccaggagtttgagaccacctggggcaacgtagcaagaccccatctctgcaaaaaatgaacaaaattagccgggcatggtggcacacttctgtggtcccagctacttgggaggttgaggtgagaagatcgcttgagcctgggaggtcgaggcttcagtgagctgagattgcaccactgcactccagcctgggtgacagagcaagaccctgtctccaaaaaaaaaaaaaggaaagaaaagaaactgaaaaaaaaaaaaagcagaagaattgatagtacactttccaagctataaagcattatttattaggtatccttcaatggatgatttagcactttcaggaatggggaaataaatagccaggttgaaaagtgactgttgtgtgtcagagagggccttctctgaggatttggcatcaagtttgattgtattttgtttttatccccttaggtgtgagagggtccagcagaaggaaacatggctgccaaagtgtttgagtccattggcaagtttggcctggccttagctgttgcaggaggcgtggtgaactctgccttatataatggtgaggcatggagggacagtgggtcactgcactttcctaggagttttctgttggtctgcatagcccatgtgacactcttgatggtagctgccgtcagtgaatgtgtttgtggccaagagggctcacctcctgccatttcataccacaggactgcattgttatcagagcccctgacctttcagtcataggttctctcagagcctgtattcaaaaagagcttcccagcccacttcctagttggatgtgtccagtggcttctgtcaaggtgaagtgaagccgcaccacccaaatgctgccgcacagtgtctggatttccctggctatctgaaatggagatctcatttgttctcctctgcttgcatgtggaataacagcaaaggctgcagatctgtttgggtgaccttgtcctgaacaggaacttttgctgtgctgaattcgggtagtttcagagaaagtatctttgagatgcattgcccagcttttaacagtgtaggagggaggttaagctggcttttcttccactttactgtggaagcttcctcattggtcaagcaatggatttgacctgactttatctgtaggacctcctttaattctgacattctgacactttcacatgctgcaaagcagcaatagattgacccatccggtgtgtggctggctgacaagaggagctttactttcagagtgaagatatttggaccaatgataaagttcagagaggcagctgattagaaaagcctgcttggcttatatgacacatcttagcagtactgtgatccttttggccacatctgcaactagacagaaattgccatcataaatttctctctgtgccaagacagctctataaccccttaaaactttagcgaaacagagctattaggaagaaagagtaggctcttcgaaatgtaggattcccataatgagggtgctacttctgggagcactaggttaaattggagcccgatggatatgtggtaactgggaagacctcactgagttttagaagttttggtagatgattcctggaaatatgttggtgggagttcagggatagaatggtcattcagaaaatcaacagccagttccctcaaggagaaaggatgctaaggaacaggtcctattaccaatccttggggacatgtggaacaggaagtgactgcttagttttgcagctagttagaagtctctagagaccaggagttggggaagacagagagaagaggggagacttaataagtgaacagaaagcaccagggctctttcaaagacatgatccttttgtttaaaggatgagaggatttttatgacatgtcattgtcctttcttcctagtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaaggtgagtcttgcctatggttcaggtaaagtagggagtgtggaagaggtgctctgttcttctgtgtcacaggagcatctgtgggataccaggatccaaaagagtttgaactgtacatcataggaatgactagactacttgccctggagagcttgatatggaatcttagaaatacccacttatggctgggtgcggtggttcatgcctgtaatcccagcactttgggaggctgaggcaggtggatcacctgaggtcaggagttcaagaccagcctggccaatgtggtgaaaccccatctctcctaaaaatacaaaaattagccggtggtggggggtgcctgtaatcccagctacttgagaggctgaggcaggagaattgcttgagcctggggggcggaggttgcagtgagctaagattgtgccacttcactgcagcctgggcaacagagtgagactctgtctcaaaaaaaaaaaaaaaaaaagcctgcttctaatcttcccatctctttggaatttctttccgtactgttttgcagttgttttcaggatacattatgtacctatttctaaaactattgataggagcttccagagatcagggagttgtaggtattaatacattgcccacctctcttggtgcccagttcagggctgtctcatgggcgcttggtccatattgttgacatctgtaagcaagccgtgacagtgctttggctccaggcaggcctgaattgtccaggggaaagtataattctctccctggatcctttaaatggtccaagtaatgagaagcagaacataggatcagtctgttaaccccttatatgtgttacacatttgacagagtgcttttacgtctgttttctccttcaattttccccaacatttccgcaaggcccagaaagcaaatgaaattgtccccattctcatagacagggaaataagctcaggttggctaaggcttagagaggccacatcattagtaaatagcccagatctttggactgatagtctaacaccgtttccaccagacccgaactaacctctccaaggctgactcctgacttggccacaatcaccagagcatgtaaaggcctcaccctacaattcttagcattgccctgtctattgtcttaaaatgttcagtgttgcaaactttgcatggcacctgttagacatataatctgaattatgtatatctgagggcattcaggggataccaaaaagctgctatcactgaagcctcttaagaaattataaactctttatgatgctctattgggttctctgccaaggaaaccaggcatacctgcaccttgccctctgggatcttataatcagcagatttgcttataaattgtagcaaatttggagccaggcacagtggtgcgtgtcagctactcaagaggctgaggcaggagaaatgcttaagctcaggagcttgagtctagcctgggccacatagcaagaccttgtctctaaaaataaaaaataaaaattgccaggcgtaatggctcacacctgtaattctagcattttgggaggctgaggcagttggatcacttgagcccaggagtttgagaccagcctgggaaatatggcgaaaccccagctctacaaaaagtacagagattagctgggcgtggtggtctgtgcctgtgtagtcccagctacttggaaggtgtaggtgggaggatcaactgagcccaggaggtcaaagcggctacagtgagctgtgatcttaccactgcacttcagcctgggcaacatgtgaccctgtctcaaaatacataaataaaaattgtagcaaattggagtaggagaggtcatataaaagaccacttgtggccaggtgcggtggctcacacctgtaatcccagcactttgggaggctgaggcaggtagatcacctgaggtcaggagtttgagaccagcctaacatggtgacaccctgtctctactaaaaatacaaaacagctgggtgtggcggcgcgtgcctgtaatcccagctactcaggaggctgaggcaggagaattgcttgaatctgggaggcagaggttgtagtgagccgagattgtcccattgtactccagcctaggcaacaagagcaaaaacctgtctcaaaaaaaaaaaaaaacaaaaaaaaaacacttgttttcctacagtggtttttatttttaactccagtgtttgtcccctaccctaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggtgagtgaacaggggcctttagcctcgagcccagagcaccaccctgggagggtgccaggtggcaggaagcgcttggcagtgggttggttgggatgtggctgctagtttcctggttccttttctgcttcctcattaacctgacctgcccttctgctcctccctttgaaaccaggctcgctttgatgctggagaactaatcacccagagagagctggtctccaggcaggtgagcgacgaccttacagagcgagccgccacctttgggctcatcctggatgacgtgtccttggtaagatccttcgggagaccgaggaggggaaggggctgcagttctcgtttaggtgcctggctccatttctgggtagacgctattaggtcctcccttctgctttgctagatgtgagacttgaaaacacggaaacatgctgaggtgaggcagtctccgtgggtttttcagttgagggttcttttaccttccccctgccacacacatttttcttatgacctctggttgtatccagatagtctctaaccactaaatgttttaccttctccaaactgttacccagagagtgatgccttgttaaccctgtttgacacaggcagaaactgcctggtagagaccagagaacagctcgggtagtccttctccctagcacagacctcccagcctgactcctgggagcttcctaacactttacagtccgaagctcagtgaagtaagctctgggaaccccagtgaaaggtgatagagtgtaaacgaacggttggattcccccaggcctggtatagggggcaagggacatctctgaggcgtaagctatcctcttgagacactatagcttgtgtgtttatatgacattggatgtcataactcagaaagcaatgcaggcaggatagcgtttcaggttgaggagggtgaggggaaggggtcgtgtttctagattctctgggaaaaaccatttggagtgatttgttcgggcagtgaggtaaagtgtttcctgttcagttctcccgtgcattgctagggaaaggcactgcctcccccggcatctgtgcagctgtttaaacagccacttgacaacacccagtgctaacccctgggcactgctccaccttgctccgcctgctggaagtcctgggggcttggggctccctctgctggcaagaggccaggctgcagccattctgtgggcccttccctcgtaattaccgttaacctgaacaccttggctgtgagaaaacgctgagtaaaaacctaagggaaaagttggcattttactagactttaaccacatactccattctggggaaatgtgggctgaccacaagaaaccctatctaaggtgtgagaagaaaattaggtttcatggggaatttgctgccctcagctggcccttgtagaaataaattttattccttaattatacatttcatttttcatgtctcaggatcagattttcttacccaaactttgactaagaaactagaaatggatcaggcgaagtacaacagctgcagttagagttaggaggttaaaaattctggaagagaatgagaccaggatttactcttcaggagaagtttggagctgcttttttaaaaagcagaggttgggagagtggaggaaatgaaacaactagaatttgatggcaaaaccaatgctcttctcttgattctttttcaataaaaattaggatgaataagtaaattgctctaggctgggcattaggaattctgaggtcccttcccattgtttgtgctatctttagggacagtcccgtcagacctgacatgattagggaaggtctatggatcatcagacttctaaaccctcatgccgaccaatgactttacctgctttctctttcttttaaaccgtttaacagaaccattcacattgggaataccatgatttgcgttccaccgtccctcgtcctcttcctgttcagtggtggagctgctgtgggaagacgcggactggttaatccataaacagagagcatcaggctcttggatccctgggaaccagctgcctccctcactctcagggaccctgttttccatctggccttccttgggctttgaacaaggcatcaaaggcccttggaagagcactagtcagtggcgggggtcttagaacccacagttctcctcctctggggaggtggtcgattgagtagataccttctggtgcctgtgggccccatcaaaagcccccggtgccatttgctacatgaggtcactgtactgagagtgacagagtaatatacaggagcagtttgggcagccagagagtctgggtgtaaactcagtttggatacagatacggaggtggaagagtgttctggcctcacggatgcctccagctgctagagccattgctggcctcttcttccagcggccatggagccctcccagcagtgctgtcgaagcaatcacactgcctcatcttgtgctcactctctccccttagacacatctgaccttcgggaaggagttcacagaagcggtggaagccaaacaggtggctcagcaggaagcagagagggccagatttgtggtggaaaaggtgagccttcgaccagatggcaggagcctctctctcccctttctccggcactcagcttccccatttgctgggtggcctggaaattcatcatctgtcatcccttcttccgggataatcagaaggggcttgaaggaattgtacttctgcaattggttccagagtcttcaggggctagtcaaggatatgtggagttatgttcctaaatcactgaagggtaatttttcttccacttctctgagatcaaaaacactctcttacaaataaaaatgtttctcctggagtattttcagcttcactgagaagtcatttttaaccatagttacatagtgaaagctgacagcaaaaaagatcaaacgttgcaccagatgtgctttcgtcactagatttttttctagtgctaaatccatccagatgtgtcaaagaatgtgatgggacacagtgtatttgcgtagcagcctggtctttctggtatttgcaaagacatgttcatttattgttgtccccttcttcccaccaccagtatccctaattggtggggagatggggacagcaagaaataaaatgggaaaagagggatagatttaattttggagaatgaaaacactgtgtgggcagagacttgtgttgctttgtatctgccataacttcagagattataataagtctagtacagtgcctggtgatagtaggtatacagtaaatgtttgttgagcaaatagacgcagggcccagtcatttcaaaattgtatgtaatttcagggaggcttaatactgtcttcttcctcacactcctgaaggtcacacgttgcagagagctgtcttcctattgatattggtagggcaagcctaggagatctcactctgggtgcctggattctggtcaggaaccagcctaactcacaggcagctctaggaacagtcaaaagtgcatgctgctcttccttagccatcccgaggttttttgtttgtttgtttgtttgtttgtttgtttgtgacagctctgtggcccaggctggagtgcaatggcatgatcatagctcactgcagccttggcctcctgggctcaagtgatcctcctgcctccgcctcccaaagtgccaggattacaggcatgagccaccacacccggccctgtcctggctttgatgaagtcctttagacttaaggctggaggaaaagatgagccttgaggattgattccacctttcttttgcttctgttttccttggccttggcttctcctggctcagagtagggttgttaaactagattgcaattaatattaatgaggactttgaaataagacaaatattcctgcagccaacagagatgtatccctcccgtgacaaggagtgagcatgaaaggataggggaggactggtgggcaatgtgctctgcttccccccgcttcccccgctagccatcaggaggaagtaaactccccgagttccttcaggagcctgggaaggtggctttctggtgaagggcctttggttgtagcctgacatgcggtgccctgaggtttgatctttgtctccacctccattcttttaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcgttcagagactgcccttctcacgggctctatgcctgcactgggaaggaaacaaatgtgtataaactgctgtcaataaatgacacccagaccttccggctcagccatgggttggttttttgtttgtgggagccgtgggatcagaacagagtgttctagcagtttttgtgtgtacatgtttgcattgccagctgggacagagtctccagtaaggcagaaaatgctttgttttcagaaaacactttgtgttgtgttccagatccatccccaacccgaagggaatctctgtggtagcaggtgaggtttgtcatgggataggcagtgaaggtaggtggagggcagttaacttgttctgtgtgttttggtgccactactcactgggagttacaggcctgcccgccaactgccagcaacaccttcccccaatgctagggaagtggttgacgtaaataatgtgtccggtagccctcagttagatggcttggggcactctgcagtaggtttttttttttctcttgttttcttttcctttctttctttttttcttttcttttttttttttttttttttttttttttgaggcagggtcacactttgttgcccaggctagagtgcagtggcatgaacatggctcactgcagccttgacctcctgggctcaagtgatcctcctgccctagcttcctgagtatctgggactacatgtgtgtgccactatgcttggctaattttgtattttttataagagaccaggtctcaccatgttacccaggctgattttgaactcctgggctcaagtgatccagccttggcctcccaaagtgctgggattacaggcgtgagccactgcgcccagccagtgggtttgtattgcttattctgctttgctttgacaatagggaaattggaaatgccttggcatttgaggggagctgagtttgtgcattttggatgatggggagggaaagcccaccgcaggttgagaaatgaactgtgtcaatcacccaccccaaatccttctaggaacagagtggaaacagcatgcagtgagtggacagcactgactgtgctttaaatctgctcttcatttaatccccaggctcaccacctggccacagagaggggtctttaagaagactccacaggctgctctctgacctggattccacatttcctcccccagagtgatcgggccaccacctgtcagctggggaagagggagacccgatgcacagatttgggatggagccagggattgagttctcccaatccctgcatcctgcacccctcccagggcctcccagcagccatcccgggagcagaccacagtgtgtggtgggctcctgaccctcagctgcacctcaaacctccctcccgtgagcctccccgcatccagcccatctccctgccgcctccccagcatcatttatctcaggcctcaggatatctcttcccactttggctcttttgctgtaagaataggctttcgaatgatgaggtgcctgaactcaaagcgcattaaagattggagcagaaagagcctaattcctaaataagttccagaccagcttccactctgcgcccttcctccttttcctgctgtttattgctttggacacccttttgggggtgggaggacaggaggctcctctctctttcccaggctctttttaaaagagcagttgtgtttcctgcatttggcgggagattgggtttcatcctccaggtgtctgtaggggagccctgagctgcaaagctgccttgcactgctttgaggttgctagtgccttcaggtcagccctttcagtggcaggagggccaggtttcctgctggctttgccattagcctccctgccagggatggcaaaggcatatcccagtggcagcccaggggcctcattttgccttgacttccgccaagtaattcttttcacaaatgttcaagggctgttaaccagcttcttagcccctgatggcctctgggtttctccagaaactgccacaatgggcctttatcagctcgggattctctgggccttggatcaaaaaccatgtcctgtcctggccagggaagggagagcaggaagtgtcttcctccctctccc

SEQ ID NO: 14182 - DNA, 422592 bp, Human
  misc_feature (1)...(422592): n = A,T,C or G
tccctcgctcagcagctcccggtcgcacaactcccagcagccggcgctggggaggtggtagggggtgcgggtggaggtgcccagttagcttctcgtgggtggccaacctggggctcccattctcctgtgcaccctggagtggagctcccgctatcagccacaggggctgaggatccgcactgggggcgtcgtgggcatcgggcttcagcttcccccctcttgtctagcccccctgggcgcataggggggcttgtgagcactgcagactgcagccttcccctcaaccctccctcccctcgttggtgggctgaccctgcctctccttctctcctccgccccgttagagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacaggtacgtcccagagggagatcagggctccttgggccggggaggagggagactcgaccggagggagagcgggagagggatcaggctagagagggagagggaaagcgggagggagcccagcggcgaagtgcaggaggggcaccagggggcgctgcggctccgcgctccgcggcgcttacccaggaacgtcgaggcctcttggagttcgcctcaacttcccccggctccagcagcgtccgtcccgagaggcgcgcgtcagggcacgcgtgcacgaccgtgctggtatttgcaggtacgcagggctgtgcacctgccgcagttcatgcgtgtgcaccacctgaggacatgtgaggactccggctggccgtgggcaccgctacagcagtctgaggaagtgcgcagaaaagcgcgcgtgcctatgagcgtgtgcggcccactgcccacgtgcacctaggacttggcaacagcgcccgcagtagaaaggctagggaggggctgtacagtccacgtccgtctgggagcttcttgggagcctacctttccccctacgcacgttctttgccagctcctacgcgctggcccgcggggggacgcgcctactctccagaattcagcattgcacacggcgcgcgtgagagagggtgtgtgtgtgtgaacatgtgtgtgtgcgtgtgtgtgtgcacgtgtgtgtgcacgcgcgcgtgtaggggtgaaggactctccacggccccttggctcgaggtggggcgagccccaagttccccaggcacagcggagcctgggcccaccaggcagcgtcctcactcccaagcacttggggtgtactctgactgagaggagccgggtctgtagttggggctgggcgtagagcaaagtgtgtggtgcacacgacgggctcgtagggggcggggtcagccaactagctgagctctcaagctgggacgcggggtctgggtgccgcctccgcacgccctgcggggtctgtagttcgctccgcgccagcagggggcggggttgataacttggtcctctctatcccaggtgggaggggttggatggagggtttattctgtgcacctaggagcttggtggggtacagaacacgcgcggcgcttagggtctgtggcccgcggcgaacttggggaatgcggtgggggatatggacagagatggggatggggaagtgcctggagacaggggatgaggaagctggatgcgagaaggggctgggggatggagaattagctcgaattggagttgtggatagagttagagatggatcgagggatgtggatggcgtcggggactcggaatggagtccgtgatcccagcagcctatcctgctgctgagttccatgcctggctcctagagcaggaagccaagttggtaatccctttcttctggtcgccttgctcaccgcggccctgcctctcactcttcaccttgcagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggtaaggccggaaactgatgccctgccaggacctgggaagccaccagctgcatggcagctgctgcaggtcttcggacgcccctagaatctgtcttgatgtgaagtgggggtgggggtgggagggtcgtggccactggccctggtgagaaccaggtcttgcctctccaacccagaaatgaatggaaatgccttttgccttgtttctgaaaatggtgtacacaggagcactttggtgtgtgtgtgccaggaagcgctcagaaaactgagaagtaggctgtggggtggtggtggtggcggtggtggcatgtttggagatttacgagtaccatggggcacagaggtgggcccaggagcactggagacatatgcttcctattttcacaatgccagttttacctgattgttttgtgggaaaatgtccattttttcctcttatggtaagtgactaaaactatttctaaaaattattaaatgtgggtaggttctggaagaaaatgcaaagtttttaggtaaagcacaaaagggcagaaaaaatgtcatgcttcctctgactctgcagttagaggaacagaggtggggagtttgagaagccctgggccagaggagcggaggagagacccgttcctcaaggggagtgggtgggagtggaaagaattaactccaaacccagagcatggagggcctggcattttccttacgtgttctttgtctggggctccaaggccctcagatgaaggagttggctcctgaacaaagatgggtcttggtactaaagttggagagtctcaaaatgcaagaaagagtgtacaaaaatcagttggctctgaatgagagggagggtcttttttgtggacagcctgggagctttggtttggagaagaagggagagagatttgaagatttgaaggcgatgttatgacagcctggtttgggaattacacagaagtggagggaaggaagaaggctggaatgaagaagtaaagtgaggaatgagaaaaaagggaaagattggagttgtgtgtgtactgtcctctaagtcctgagaaaagattgggagttcagaaggcgaggaaagagtaagtgtacttgtgtgccatagcctctagccctgagaccttcttggagagtgttccttagatggcaggagatattctagtggagtgagcagacattcactgtagcgctttccttttgatgctctcaaagcacttttatattcatcacatcagcttttgcttctgtttcagcgattcctaccagctcctttggtaaccgtattaattctttcaggtctcctgggctgcagcacattcagctgtagcacacaattgatgcagtgtcttattaaacattcattttaaatgatttgcaggctagcagaattcctgtgtgtagctgagcattttcccagtcacttctcagttttggggggctcctgtctgggaagaagagagtagggactagccatgctctgccaccactgacaatttcagaactggagagcatcttagggtttcttggagcatgctgtaactttcagatgaagtgactgagccataggggagttaagggaatttgccaagaccacatagtggctgatgtagctaggtagctgaatttctgatcccaaggtgtgatcttccattccactaaatcaagcccatactttaatgatgtcatccatcttcaggagggacaagggatcagtttcattttgtgggaggggctgagcatggagagctatgatgaatcacagcctagagggcttttgtatgggaggggccaatcttctaaagaaggcattgagggagaagaacagccagtttccagccacgccttggagtatgattttgggatttaaatattaccacggatcccttcttccttcttgagtttttctaaaggagtgatagactggaaacagtaaccatactgaaagtgaaatttctggatccatgagggtttggcacaacccaatggagaaatctgggaaaagctgaattggaaaaggtggtgtgagactgggaggttccgggtaggctttggctcttacttctaagtctcagtcgataggtgtgtggctcaggctgtcatgtgactcattcatccgaacgtaggcagagagaagccggaagagtgtagggtcatggaagggaacccccttgataggcagtgaccctgcctgctagtgaatcttgacccagtgaatggcaggttgtgaccaactagaccagcaactgttcttcccttgaagggggcattagaaagaaagttttgagaagtccagggagtatgggtggaaacattcttctctcctttgggatgaaactgcgttttggggatgtggaccaaaatgtgacctcacttaagagtaagaagagaaaaggaatcaggaaagggcaagaggaagatgagaaaagacatttccagagaaataaagaatagagacttaagaggggttggagagaagaagaatgaaagggtccattggttcaaaaatggaggaggggattcgatactcctgattgttgttgggactttcagagttggtcttggagacattggccactctctgtgattctggtggaactgtagggagatgaggcaaggtggcagggaagcaaagagctcagtggaggtaacatcggggtatatgtctggtccccatgtggaacggtgatattgagaggagttgggtgataccaagagaagttggtttaaaaggtcgtattttgagaaactggggatgtatttagaaaggagattgtctgagaggtgaacagcccttccttccattagtaacatatatagatggcttgtgcttctgccacatgtttcatttagagctgaacattgagtttatttgtctccaaagaaacagtcacggtgcattgtttaaaactctgccttgcctcgcttgcaaatggtattatgactacagcctcaaccttcctagattgacaaggcctctgcctcctgttaaaatgatgttgatttggtaaagtcatccagaacacacgtgtgttatatttacttctacattggcaacatgatagtgcccctgctggtaagaatagtagtcaatttggttatcagttaaaatgaacacacacacacacatttttttaactttttttatttttatttttatttttactttaagttctagggtatatgtgcacaacgtgcaggtttgttacatatgtatacatgtgccatgttggtgtgctgcacccattaactcgtcatttacattaggtatatctcctagtgctatccatcccccctccccccaccccatgacaggccccagtgtgtgatgttccccttcctgtgtccaagtgttctcattgttcaattcccacctatgagtgagaacatgcggtgtttggttttttgtccttgcgttagtttgctgagaatgatggtttccagcttcatccgtgtccctacaaaggacatgaactcatccttttttatggctgcatagtattccatggtgtgtatgtgccacattttccttctgtctgtctacttgaccattgaagaaaataacaaagccttataacaattgaaatgtcatgcaaatgtggtggatttttgtggtgttaatttaatttacaatggaggtgctaatgttttgctcgcatcattgggtagtcttgcaatataactaaattagaggtgaaaataaggctgagcgaggtggttcacacctgtaatcctagcactttgggaggccaaggcgggtggatcacctgaggtcaggagttcaagaccagcctggccaacatgctgaaaccccatctctacaaaaatacaaaaatcagctggatgtggtggcaggcccctgtaatcccagctactcaggaggctgaggcagggagaattgcatgaacctgggaggtggaggttgcagcaagccaacatcatgccactgcgctctagcctgggtgacagagtgagactttgtctcaaaaaaaaaaaaaaaaaaagaaggaaaattaaaatcaataaataagaggtgaaaataatgctcgatgtagatgaagttctaatcttatcttggcttggccattttgaccctgtctaagtgaaatacactccagctgcagtaatagtccctggtaagcccagaatatgggctagatctttacacttctgctcagtgtccttaaccctctcaccccccatcacttctccccatattcctaattgctccatgcaggaaaagacgaggctcagattttagctatatccatccatgccagttatcacttgggtttcgttttctatgttattcctatgcaagcctcatgtcttctgccagagtgtaagtcgtttgagggcagattttttaaaaaactgtttatctgtatatgtgtatttgacatgacaaatgcttctctcctccgcagacatataaaaataatgccttttcattgtagagcacttaggaaatacattgaaatttaaagaagataaaaatctctctccaaatcctatcaccatgggtaaacattactgacactttggtgtatttccttttatctatttagttgcatgctcaggattttatagtatatatggtttttcttattgtgctttgccctctgtggactttcttagaggattcaagattttctttaattctggagaaaatctcagccgctatctgttggattctttctttccatcattctttctattctctccttctgaatatacatgcatatgtatagtcatgcgttgcttcatggtgggacacgttctgagaaatggatcgttaggtgatttaatcgtgtgaacatcacagagtgcacttacacaaacctaggtggtatagtctgttacacacctaggctatgagctataggctcttgctcctaggctacaagcctctacagcatactctactgtatgaatgctatactaaatattgtaagcaactgtaatacattggtgagtatttgtgtatctaaacatatctaagcacagaaaaggtacagcaaaaacttagaatataatcttatgggaccagcattgtgtacttgtggtccattgttgacctaaacctccttatgcagcacatgactgtactatatatatatatgtaatttctcagtcaattctccatgtatcttgtttttttttttttccagttctctgtttgtgctgtgtttgggaaggtttcttcaattctatactccagttaactacatcatttcatttgtgtctggtctattattttattttagaaagaaacagcatggatggtctattattttgactatctgttgagttatagatttcaacaaggatatactttatttccaagataataattggttcctctttacacctccctgtttttttgtgttataaataatgaaaaactcttctcactttgtgcatgtaactccctcccctgtcccttcaaagactaaaaaatatgtattataaagttcttctctgattgctctagcatctttccttcttcagttgtgaagtccttcatttgtagagtcagttagttggatgttcacatatgttctttaatttttgtttgtgaacttattttcaaggcaactttatgatttcttatgccctgtgtctgtgagggtgtgtattttaagccagagcccatgtcagcagctcaggtttgtactctcttcccattctacgtggcctgtggtacaggcttaggagtccatctcatgtaggtgacttcattttggctccttgacacagatagggtcctgctttttggctgtgactaatggtggatggtgcagatgttccagcaccatccacagctagcagcctgattctaggtccagttcttcccctttttccctggatggacattgacacctctgttctcatggctcatattggacctatcctccatggattatgtggctttgattcctacttgaaaccctagagtcccgtctttcagttcatttatttttagggattactctctatttttgatctgtgattctcttttcttatttgcaagcaatactatgtaaatttaaaaataactaaaggtttctttaaaaattctatgtcttaggagcagaaaaggaaggttactgagtgtgttcactcggattttgaccccgttttatttcacaacctgcttttatatatttttttaaacttgattatgtattcttggaattttcctttatcactacatagacttcttaaacttgattttcaatggctgcagagtgttcagttcataccacaattattttaacaatttctctctttttccaccattaataatattcatttgtgctccataggggcatccttttcagtacctcacacttgtcctgccctttgcgtttgttacacggtaaatgtttgttgattgaatgaatctagtcattggctccgatgccagcttgttggagcttccggatgaacatatcacaatatggttcagggcattcgtgcagtgtttgttccctcaatgctgactgatttcataggtgtttgccaatttttctcttctctctagtgggcagataattaccagccatcctgaggattagcataaattggggggttacatacgaaaggcctgtagagaactgctgagtaacagctcatcagcaggaggtggaagttggtgctcttgtaacctggcagctccagagtttggatgcgagtgatgggccttcccattaaacactgagagctctcgaaaagggcagacgcacagatcggaatgttggtggagcccactcagctcctgctaaagaggcatcaggtagttcctgggagagtggggagacctatctttagtcttttccatgaggcatgtcagatgcgatcatcaacacctcctcacttaagtcatcagagaccaacaggcgtcctcccggtagcgtgactcacactccaagtagccctcaggggttgctgacaatcgtttgggccctgaagagctgtggtctggtgggtttgcagcggtgtttatcttctttctcatagcctcagatggaaaatgctactgtaggcagagtgagtggggaaagagagagaaagagggctgtgcagaagagaaacaggaactgaatctctggtttgtaatagagagttggtagcctctgataagtcatcacataaatgagacattataaggttattaattggtgtcttttgtttgtcctgcatcccccacccttgatctttcaacttctaattctttgccaacattttaaagttggaagacatcccattgaaaagaaaatccaaacttcatgctgctttgaaacagtcagaaggcctggccatactggccccgattccccctatggcaacagttggctggagatgaatctcatcccccaaccccacctgccacgatccctgccctcccactgccatcctgggacaggacaggtgcccctcctttcttaaattccccaaagtcacttcacttcacttcacttcactcatttatgttacatacacagtatcctgaaggcacttggctgtgaggcctatgatgtaggtgagggaagtagctcttccaggggctgctcctggataagacggcagatctatggcatgtatgcaaccatggatgccatgttcactgctgccatcattaatctcctataacacctggccctgttgagcccactggccttaaggccttctcaacacagtactccaggcagccatgatgaatcaacttgagttggaagatccaagaaaaccttggacaaagagtctgaagaatgaaattcaattttcaaaaatacctgtgtgaccttagaaaaggcccttcacctgtctgaacctctggttctcctgcaaaatgaggatttgggacaaaattatcactaagatctcttccagctctgaaaattttgtgcctcatcaaggaaagactggcaacaaacataccaaaatatgaatagcagttatctttggggtggtagactcatggctgctttaatcttttaaagaatgtcattatcaagtggttaatgtattgtactttgagttagattgcctgaatttaaattcagggattccacctcttactggctgggtgatcatggggaagttcttaatatcttgagcctcaatgtcttcatctctaaaatgggaacaataatagcatccactttgtagagttgtgagatttaaatgacatcatggatattagtccatgtctcagtgcctaccttataataaatgcttattacaggaatgctattgttattgtgtctgcattttttagtttttatttttctccagtgtacatgtactttttaataaccagaaagagtgattaaggatgatgtggttacatgagggtatgctctgaaagaaactgggagtgaatcccacagaactgtcagaagtggagggtctaacatgaaatgatttgtattttcttaactgagacaatcagaagcttcctttgcctttgtaggacttgctgagagctttatcctggcaaacggaagctaaatgtggccagcatgaaagtgatcgtaggagaagactatctcattgacctttgcactaaatgactccaccaactggaccatatgtttgcacgaggcttagggatttagagtgtggacatatatagtttctcattttatctctgccaaggattaataactcagtgatagcctggggaacctggcagctccaacggtatttgtttaaagaatctctattttcagatgaggaaataaaggatctgggagttgcagtaatttgtgcattgttcaaagctgtaactagaacctagggctttgggttcttattcttttgctcttattttattaccctttcaagttaatgactacgaatacatttgatttagggaaggggctcagatgcaagacaaataacagattttgatgttcatattttggttgtcttgactaaaaggattaagatgttggatgatggaattaaaattcaaaacttcagattgaagtgatggagtcactctaaagactgcactggaggttccccccataccgcactcagctttaatgaggttaactgacaaagaaaaattgtatatattaaaggtgtacaacacaatttttttttttttttttttaaagaaaacagtgtttcactctgttgcccaggctggagtgcagtggcatgatcatagttcactgcagcctcaacctcctgggcttaggtgatcctctcatctcagcctcccaagtagctaggaacacaggcgtgtgccatgatatccggctaatttttaaatttttggtagagacgggggtctcaccatgttgcccaggctggtcttgaactcctggactcaagcaatcctcttcccttggcctcccaaagtgctggtattacaggcataagccaccgtccccagccccaaatgatattctgatatacaagtaaatgtgagatgattgtcaccatcaaactaattaacatatccattacctcacatggttacatttattgtgtgatgagattacttaagatgtggtatcttagcaaattgcctgtatacaatatatttttgtattgtcaccatgctatcaccagtcaccatgctatacattaggtctctagaacctatttaccttacaagtggaagttggtgccttttgaccaacctctctcaatagtttgaagaagaattttcactattgcagaaagggggatgtgagactttgcaactcacttagtcataatgtggctgcctctgttccaactatcacatccaactcacttgggaatggtttttgcaagggtcatgaaccggtgtactgcacgctgaatctggctcatagatgcattttgtttcaccagtacagcatttttaaatgcttgaattttaatgtctttagacagcatgcattttcaaattcactacagctgtccccactctgttatcccatatctagggtgattcatacatttatgttaatgatatggtttctgtgagtatttgagatcatggtgctcaaatacagactttttatttgtttgtttgtttattttgtattgaccagaagctcagcagatcctaagtggggatatgtggaggccacatatctagaaatatatgtggaggccacatacgttgtggccttataaaaagtggaggccacatttatagaaatataatgtttaaatcaagggaggtgatagctccattatacctcttctgttgtttggagtgctttcaggtgcaagtaacagagtctttgaccaacagtgtcttaaaccattaaagacattcagttttttgcttagtaaggagcctcagatctagcttagtgacttaatgtcacattgaggactcagatccttcccattcttctactttgccttcctcagctgctggtttatctgagtcacaatatggctgcttctgttccagccatcacaccttcacctcctagcattcaaaactggaaaaaaagggagagaaaaataagccttcttctagggcctctatcctttcattggagtagacttcctcttacatgtcagtggccagaactgggtcacattcccactgctcaaacaacaatgatagagatccaggattcctctctgagaatgggtaattgccactgagcaaaattgcttctgttagcaagggtgtggggtgatgcttcagtggtacaactggtgatgtctccagcaacactaacaccattatatgtagcattgcacttagttccgaggagtgatatctaaagatggacgttgaaaaattgcaatgcatgcagaaaaagggcctttaggattgcgtagactctaaatgaaatatattaagagtttcagaagaagtatttagggatgtttagcctggagaagggaaatctcagaggggatatgggagaagtgttcagatactccatgggctgttacaaggtagaaggttaagtcttaattttgttattgttctggggacagacataagagtgaaattattattattattattattattattattattattattattattgttattatttgagacagagttttgctcttgtcgcccaggctggagttcaatggcacgatcttggtttactgcaacctctgccgcctgggttcaagtgatgctcctgcctcagcctcctgagtagctgggattacaggcacctgccaccaccatcagctaactttgtatttttagtagagatggggttttaccatgttggccaggctggtcttgaactcctgacctcaggtgatccacccgctttggcctcctaaagtgctggactacaggcgttagccacggcacctggccaagagtgaaactataaggagtaaagtttcatcttgatatgaggaataagcttcggcaattaggtctctaacagaagactgtgaggattcatggaataggaaggctatatcaggatatgattgagctaacagtgactgtctgtccctcaggaatgaggtggaaaattgggcttgcaaggttgggttgggtcacctctgaggctctttcttattcaaacactctgtacctctcaaatccttgatttttaaaaaaagatctccaagccttggtgctttaggccaagcatttggctgaaaaccaacatcctcactttttccaagtgtgtgagtaattcagtataaatttgcctggcatggaggaggaatttataatccctgcatcatcacctcaagttcccaaaagactttacattatcctgaaggtagaagatatttgaaaagcagacaacctatgtatatatcaactcacacacacatatataaataaaaacataagtaggtcagccggcctcatatttactagtgaaaatgtttttggctaagaagctcatctacagaagacaatgtttagaataattgccaatgatctcgaaatggggtgtttttgcacttgtatcaggttaatcattattacttaataaagtatattcagcttgttttgcacatcttactgtagtaatatgtttgtattctaaagagccagccagactcctctctggtttttcagttgacaaattattctttttagtcagttgtattctcctgcatttggaacatctgcttatggcagaaaatactctagatactattctgttgtttatccacttctcctattcccccacatccccccaaagaaaaacgaacctgaaattgctttccaaatgctttcactttctgttcaaattttggaactttccatgggatggcaattgatatattgtctccattttttaaactttgaaatagatgttgatgtacagagcgaaaaaacctaaataatacaatagagcattcagagaaagaatatttgctccattaatgcatcgtagatcttcgaactcaggttcccttccatggaggtggctatgttacccatttcaggagggaaaatattaattggaatggaaatttctttctgtttgtgatttttttttgctgaagtcggcatatggaaaggatcttctcttaaactacaatccctgacttgaaaactacaatccctgacttgaaaaaggttaattgtttccattggtccctaacagtgactcttttgccaaaacaaaaataaactcactctaaaatgtaagttgtgatttccaaaaatcactgacaccttgaagcttggctcacaaactcactcaaagaatttaagataatttggggtgattttggggggagttggggaccactttaaaatctaatgaaggctacggacccttccagaggagtgcgtgttcataaacatgcagtcaaaattatgtgcaatttcaggggatcacagaccctctgaaaccctttcatagacttccttggatttgatttatttattggtttattaaacacagttgatccttgaataatgcaggcgctagttgcattaacccccatgcagtttaaaatccatgtataacttttgattcccataaactatagcccactgttgatcagaagccttaccaataacatagacagtcaattaatacaaattttctatgctatatgtattatatagtagattcttaagtaagccatagaaaagaagatcataaggaaaatcgtaaggaagaaaatatgtttgctattcaagtggatgtgggtcatcataaaggtcttcatccttgtctttacattgaggaggctgaggaggaggaggaagaggaggggttggtcttgctgcctcaggggttggcagagggagaagaaatttgcgtataggtagacgcatgcagtgtgttgttcacaggtcaaatgtatgttcattcttcatacatttcttggctttgtccttggaccaaaatgctttgtggatgcatctgttatcaatttgtttcagaatctagctggagagactcataatgcaagtgcagtatgattgtattcacgggaccatgggaatgcagaggagggacagcttcatccacaggtctgagggtagggatctggggtcaaattggagagctggtctggaagaggcttgtgtcctgggtgcctgcccctacaggttgtcatcccccacagctgaagatgagctgtagagggaaggctggctcatggaggagcagaattgagttcacaatctaagccttcctctcctcttaacctgttcctcaaggctgccagtcttgagtggtcttgaaagcttccaaattctcctctggatggcatttcttaccatcaaacattgagctttttgcagatttccgttttgttgtcacaaatggctgaatgtctcctgctctatcttgtctcttcaaattaggaatacctgcccaggaagagtgagtggcatttgaaatccatatcgtcttgctagtctgctgtcctaggggtgaaagaaaaagacatattttcctggcgaattgttttaatgctaagatatctgtaggactgaggaaatgtagtattaactgacttgggtgagtagactcagaacgatgtgaagaagctgtggagctgtggaaaaaggcaggcttgctgtagttctggtgttagggtgtgtgcatggcttccatgaatgggattttgaaaatggcaggccttgggtgaagaccttcatggtcaaatttgcactttagttaaaaacaaatttgctattggttttgccttggttaattgatactagtttttcctcttctcttctcctctcttctttttctcttccctcccctcccttctccactcctctcttctcttctcctctcccctcccctcctttctcccctcccctcctttctcccctcccctcctttctcccctcccctcccctcccctctcctcttctctctctctctgtctctgtctctctcctgtttagcagcattgaaagaaatatttttatcatggacccactgctggatcattttaaagcaaatccaagacatcattgtgttcatcagtaaatatgtcagtatatatatatacatatatatatatatatgtatatatatatcaaaaatataagaactttaagaactgttgaaaaaaatcacagctaatatacaagtaatctatacatatgtattttagaggattttgtgagaatcagggcagtataaagaaaataaaaatcacctttactctcagcatccacagacaactgctattaacattttggtttatttccctctagtctgttttcctataccttatttacaaatacacactatataattttatagatagcttttaatttgcttaacattttatcatgaggctttcagattacttgtaaacatttttatcttctatgttttctattctgtggatatctcatgatttacttgataatttagattttccccaattttttgccatgaaaaccaataccttgtttaacatctttgtaatgaaatgtctacatcacagattattggcttttaatagaatccattactgaaattaaagaattttaaaactatcaatacagaaccaattaaggttccgttaatttgttcccagaaagattgaatcactggacacttctaataactatgtcttaaagtatctctgtcacttaactctggctggctcttgaaacagaaatttttctgattggctagacaaaaatattaactcattgttataatttgcatctcttttaagacacctgccatggaatatattttaatttaagcatcgcttttatattccctaggtattgcatattttaactgctttgatatttctcattgtgtaaatggaaaacctcagacaatgatggcttccaatataacatacagtggagtaatttgaatttctaaaaaataataaatattttgaagcctggcggggagttctatgattattcattcttcatcaccaggcattgctcacccattgtctctgtatcagtgttgtttcaatcattgctttaatatgtaaaatttctcagcagaaaatcattctgtgggaccccactgttatgatttgccaggagtctaggtagagactcacgtccaattgggctggagtcatgttcgtgtcccaggctttgtggggaacggtagggatgggaagcccttgtttgttcctttctctaaaaaagcagaggcagggtgaggttttgcggggtccgtcccgcagaccctgacccaatgacagatgaataaagttccctgacgcacagatattctgctttgccagtctagctgagtgtccgtgccacttacagacaccaaggaaggttctgtacagagtcagtggccacggcctcgacttgccagtgagactcacatttattcagtaaatattaattgacaaaggttgtgagtaaacacattggtgggtaattaacctggttgcccctaccccggagagagccatcatgcactcaagaatgatcaaatattggtcttaagaccacgtgagtaaacaagctagttagataaactgctctgccttcctttgtacccacttcaagctatttacttaaggtaaggattaggttgccttaagccataaacttattctcagacttttgcaaaaaccttcaggccttccaagaaggtttgtggctattctctataaccaaaatttttcccaccagtctgattgaatccccacaaggttgtaacaagaactgccttgtgataggaaagggatattgcccaggtggcagggggcagtaaaatgagttttaaacaaaagtgggagagatttatgtttgatattaacagctgtgaggaatactcaaaatatttaaccactacagcattatcacagctgaatcagaatagacactcactttgtagaattctggagcacctgttatgtgaggtgttaatcctttagtggctggttatggggaggtagggggttcccaagggaggggctgagtggcagggggcacttggggttcctggaagatgtggctattcacaagcaaaacggaagcatttcagcctttaaataaccagttctgctgcaccagtgcacaccagccaggatatcagcgagatctcacgtgtcatttatgccaacgtgtatgcagaagttttctcagggaactgtttagaaaaggacacaggatggctgtctcctctgccatatattaaccatgccctgaaaaagggaggtagggctgagagcattttgaagatctctttcctaaaatatgaaaacagaaatgtgcttccttctaaccttccaccttctgagcctggtgctttggcttgtctcttgtgggttaattttctagctgtctatcataagcctgcctttctcccatgaaaagcacaggagctgaagccagctgtccatgccaccgcccactccccactcccatgttccctgtcttctagggcaagagattcccaaacaattcctgttttcattggggttgaatgaagagggctgttttagtctctggttttggggtgtgatgtgctcatttgcagaagcataaaaataatcttttaactcaccaaaaaatactccacagcctaaattaactttgttaaagatcaactttcaaaagagagccttggatgtgccttcgtgggatcatgtgcttagtttacttgtagagtctgtggcttccttccctcctccgaaataggaaatcctccatccctgtcctggttcatggaggttttcaaatgggcttcaggagaaagaagcacgtctctggtttcatccgagggtaggagaaccctctgatatgttgtttattgttgagaatgcactgaattgtatctccctaaaagtcatatattgggtcctaacccctagtatctctgaatgtgacactttggagctggagtctttaagagtaattatggtaaaatgagggcatataggtaagccttaacccaacatgactggtgtccttataagaacaggaaattaagacacaacataaacacacaaagggaggaccatgtgaagacacagggagaggatggccatctgtatgccaaggagacagttttcagaggagcaatcctgcagctcccttgtcttagacttctagctttgagaactgtgaacaaattacatttctgttgtttaaaccatctttgctgtaataaagactgtgatcctttgttacagcagcctgggaaaatgaatacagagaggttgggaggtagttagagcttaattccaaggcttctcctcactcctcttctgtaactgagcctcagtggagtcaagacacctcagctcagaacccagacctccacctgctctaacactgactttgttcttctcatgtgggctccctttctggacactaggctcctgctttgaggaactgagtccctgtcttagaatccttcctaaaacccttctaggacttctaggttcaatgcttctcaggaatttttactcaaatagtcctagggggtgtggtaggcagaatcatgtccccaccaccccctcttccccacccaaagacatccacattctaattcctggaacctgtgaatactaaccttatatggctaaagggactttgcaaatataattaaattaaggatcttgaaatggagagactgttctggattagcctaggtgagtccaatttataatcattccttatgaaagggaggcagggaggtgagagtcagagaagcagatgtggcaacagaagcagagattggagtgatgcactttgaagatggaggaaggggctgtaatccaaggaatgccagcatcctccagaagctggagaaggcaaggagataggtcctcctctagggcctctggaaggaatgccaccctgccagctgcttgacccacttcagactttggacctctggagccataagagaaagaatctgtgctgcttagagccactaaattggtggtaatttgttagaacagcaataggaagccaatacagggacagcgtctgataaacacacgctctgcacatcaggctgtgccctttgtggccttttctctgaatttgatcttaaaaattcatgcagattttggttcctacctcataatgtaactatgttggtactaaggcgaaataatttaaaatgacttaaaagataagtgtgtccatttttcccttcatcaaatagttaagttgtattagttcgttctcacactgctaatgaagacgtacccaagactgggtaatttataaaggaaaaaggtttaattgactcacagttcagtgtggctgggaggcctccggaaatttacaatcatggcagaaggggaagccaacatgtacttcttcatatggcagcagcaaggagaagtgtgagcaaaagggggaaaagcccctaataagaccatcagatcttgtgagaactcactcactatcatgagaacagcatgggggtaaccattctcatgattaaattacctcccaccaggtccctcccacaacacgtgaggatgatgggaactacaattcaagatgagatttgtgtggggacacagccaaaccatatcacaagtaaaagcaatgctctaggaagttctactgtatttgtgctctgcacgtgtgttctgctgggctgtgtgtgcctctgtttgagaaccctggggtggtatgcactttgaaacccgaaaccccaaaacctggctccacgaacgtgcctctgcgaaattcttcccaagcaaagtttccttatcatttttgtgcctggaggggagaagagacaagaaattcaggatagctggagaatacagaaggaggaagagcaaattaacagtgagctttctgttcgattgagcatttgtccacaatatattgagatcaagttttgtttcttaaacaaatctgttaacttttacggtcaatttggggcggtgcaaccggttagaagaattcattaaaacagccaaaatctctggctccgctgaatgtgggaaagtctctgatgccctccaagcagttgtatgaaaaagatgaatcatcaacaatgcagagatgacatgagagatgcagatggggctttgatccttcttgttaccaaaatcctacttagaatgtgttgtcatgaggtccccacttcatgctgccatatcgtggttcctaaagccaggtctggggtacttgctggggtggaatttagaagctagaaacgaacttgctcaagtctacatcccatccacagttcacatgcccttggtccacgcccacttgtgctgtgtgctcctgttctcttggtttggggagaccatatcccgcttgtattgatgacttcatcattctatacttccagcactcagaacattgttttgagggagagtaggtacttagtagatgttcaaacaaaatagtgagttaggagaaggggctaggtccaggattgtattagtttactacagctgctgtaataaattatcatcacaaacatggtggctgaaggaaacgcacttttaccctcttacagccctggagggcagaagtctgaaatcaggttccctgcaccaaaatgaaggtgtcagcaaagctgtgctccctctggagactctggggaagagtctgtttcctttcctttactagcttccagaactgcattccttgacttgcggcaaactctgaaattcagtttctcctgcaagtaagaaagttgggctaaatgctcttacagctttaatatctggccttctttgggtgggttccacataatgagaacgatagtttgtattgcaaaaatgtggagctttgagttaggcgatctgggatggaatttgagctttgatattctctctcacaaagaataatatatttgtgtatcatttagctatctataaaataatatatattatctatctaaaataatacctttatagtgtatcttcttccttcctctctcccttctggaccttacctttcctcatctgtaaaatgggattgggctaaggtccactccttgacagactccgctgcttcttggaagtcaggagtcactccagcctcattgatgatgatctgccttttgcatgcttgggggacctacacctctgtacaggcgagagccctccaagcatcccatcagctcctcttctctagatatagtccttagtagttggagctttgcagatgcctccacaatctacagttgtagcctcaacctcttgccctgggttcctgacctgttcccctaggtgcttggtgggcttctctccttgacatggccatgggtgcctcacactgaacctgcccaggcctgtcctctttgattcatgcttattctggatttcttctctctgtcaatggtattcctgttgtccaagccttccttgcttggaaggaacatgagggacggatgtatattgagctccctgatgtgcaggcagagtgttgcaggcagggatccgaggaccaccaccctcattgtagagaggaggaaagtgaagcccagggaatcacagaagcttatttttggtgacactgctggtaggcaggtaacagagctgggccctgaactcaggtctcctgactccacaacctctgtttttttgatcagaagaatttcttaagttttgtttccttccatggcaccttcacaacattttggccactttgactaattttttattgtgatataatacacataacatagaatctgccattctaaacattttaaagtgaacaattcagtggcgtttagtacgttcacaatgttgtgtgaccagcacctccatctaggtccagaacatcatcactccaaaaggagaccagtaaccatcaagcagttacgatctatttccccacccctccagctcctggaaacctttaatctgctttctgtatctgtggatttactcgttctagatgggatgggatcgtctgttatgtgaccttttgcatctggcatctttcacttagcataatgttttcaaggtccatccatgtcgtagcatgaatcagtactttattccttttcatggctgaataatattccattgtatggatatactatatttaatttatctattcaaccattgatgggcatttgtgctgtttccatctgttagctattgtgaatggtgctgctataaacatttatgtacaagtttttgtttgaacacctgttttcaattcttttggatttatacccaagagtgaaactgctgggtcacatggtaatactatgcttgacttattgaggatagatatccccctactcccaccaccagaatacttttctttacatcttaaaataaaatgatgccagatacagtggctcacgcctgtaatcctagcactttgggaggctgagacgggtggatctcttgagcccaggagtctgggactagcctcggcaatatggtggaatcctgtctctacaaaaaatatgaaaattagccgggtgtgttggcacatgcctgtggtcccagctgctcgagaggctgaagtagtaggatcacctgagcccaggaggttgaggctgcagtgggctgtgattgggccactgtactccagccttggtgacagagtgagatcctgtctcaaaaaataaataaataaataaataaaaataaatatagtttaaaagagaatggtatatcactgccaataatgaaaaccagtttcacttatgataagcagaagataacagcaaactaacaatcaaataaacaaacaaaatcttgccactagtaaaaaaaccaaaaataaagattacagtagtaatattaaaatataacaaactactgttcctgccaagtctcacttagcatatgatatggtttggctctgtgtcctcatccaaatctcatctcgaattgcaatccccaagtgttgaagaagggaagtgattgatcgtgggggctgtttcccccatgctgttctcatgatagtgagtgagtgaattctcatgagatctgatagttttatagatggtagtctttcctgcatgctcacactctttcctgtctccccgtgaagaaggtatttgcttccccttcatcttctgccatgattgtaagttttctgaggcctccccagccatgcagaactgtgagtcaattaaacctcttcctctataaattacccgtctctggtagtatttttatagcagtgtgagaatggactaatacagtatattattgtctcctttaaataattagcaagtgttagaaaggtgttgaagacctattagcaccaagatgagacttcctcactgactaattagaaggattgaaagataatcagagttttatcctgcatacttttaatattattttgtgtctcatctaagtaagacataaaacaatctctgacactatacctggccctctggtgttttccattcttccactgcccaactcttggttcgtctccatccctggcacctggtccttatcaccttccacctgaactttgattccagtcttctgagtttcctgcttatacgggaagctctcctactcaaggggcgcattggacatgttactctccactcttaaagctttggtgatatcaacattatattcagggtaaattctaaacccttagccaggcatccaagaatcacctcagtctgccccccatcaccaccaggctctgtctcccacagtgcacccatcaggtgaattagataacttgttctttctttcacgtgcccatagttctagctccatcgctgagttcttcctcccacctccatctttacttttggaaagcacagttgaaatctacctctcagggttcttattaggatcgaatgaaataaggtgtatgaaaaccctgaaaactgtaagaagaaatacaagtgtgaaacatgtcattgttagtcccgctttgcctttaagtcctttaagttttaagtgtcaagttctccaaggtgccttttccatttcttaggcttgaagcaatcgccttctgcctcctatgcactcagtctttttttatgccagaagacagacagaatggcctccccacatgactgtgaatttattcctcttctatacccttgctgtagccattttcatcttcctcccctcagtgcccagtatacgtgggttgaaagagcaaatctgtgcctacttgcaggagaaaccatcttgtcgtcaatcagaagtggagaaagctatagccacactgcctctgtcaaacatactttctttccttatttctcttccctcattagttgcatcttggaatgtgctttgtctaataggaagtgacagtttaatcgtttgggtttttaaaatttatattctgctacacagctgaccacatgcgatgatcaggcagcccagcattatggcatgagtccattccacttttgcatcagaagatttgggtggagccatgaaatggctgacctcatgcatagcaagagagttgaaaatcactgtgggggacaggagctcttctagggagaaagaagtcaggtatgcgtgcaggtgcagagtgggcagatgggcaggaagcctgacagttttcctggaccctgggctagatcacccttttcatcgtccagggtccctcctaccacttaaaatggatttctgtgcgattatttattcttgccccttcttttgaagtcctttgagcctttgaacttgatatggtttggctgtgtccccacctaaatctcaccttgaattgtagcttccataatcctcatgtgtcctgggagggattcagtgggaggtaattgaatcatgggggcaggtctttcccgtgctgttttcgtgatagtgaataagtctcacaagatctgatggttttataaatgggagttcccctgcacatgctctcttgccatgtaagatgtgaccttgcttctcatttgccttctgccatgattgtgaggcctccccagccatgtggaactgtgagtccattaaacctctttcccttataagttaccagtctccgatatgtctttattatcagtgtgagaacagactaatacagagctctttcagtggaaaagataatacattaaatcgttataccaaacgttataatcatggatggtattgcagtcacattatctgccaggagaattggcagggactgtagaagggatgtccactatttaacttgaaccatcatacagatgtgaaatatgaggctcagagaggctcagggacttgctgagggacacactgcttcctgagtaccagtcccatgggtctcctggcccatcagatgttgattactggtgctgatgaaaagaccaacaaggatattcattttctgtgatgggggatggtaataaaacttcttcctgcaaactcaccatgtgcactgcattgccttcagataaaatgtaaactcctggctgcacaaatccctgatttctgacccctgctgaccttttgagcttcaactcagttctctcctcattttgcagtttgctctagactttcccaaagagggctctgaggaatatgaccctacagaaaaaagtttaagccaaaataaatttaagagatgctgtacatcatgggatcctcagatatttacaatgcacatgagcctcttcaaagctctgagaagtcctgcgctacagacacggtttaaacttatttcctgctgtttgaacgaatgtttcccaaatctatttgatcagaagactccccttctgttttttatacaacacttgttcttgttggcttgataaaatatgacaaaaaccattgccctgattgctaaaatataacaaaaacccacattgctctaaatgtgcctctttcacattttctggcacttgtctgtgctgctatttctgtctgtctcatatccttcaaaactcatctcagaagccatgccctctgagaaaccttggactgctgtcccccacaggattaggtgccgttcctatacttttgtagctcctgcattctgataatttatttgttgatttagcttcccagctgtcctcagtgaggacaggaacagtgtcttatgtgttaatgtgttcagtgagtcattccataaacatgtactgagcctcctctacccaggcacacagttcagggcactgaggatgctgggggaacaatgtccctgcccttatcaaacttatattccaggggatggggacaaaatataaacacggtaaatatataatgttagattgcattaagtgccacaggcaaagcagggtaaagagactgaaagtgacaggagatgccctttaagatagggtttcaggaaagctggatcagctaggatggatgaggccctgctgcacaaacagcccctgtatcttaatggcttataacaataaaggcttatttctcgttcatgcaacgtgcccaccgagggttggctacgacttctgcgccatatcgcctcacttgtgggaccagatggagcatggctggttgttgtggtgtaggtggggagggggatgtggtgagtcatacgctggctcttaagggcttcagctcacatttgattgccacaactgattcaaggggccaggaaagggctctcctgccatgtgcctggaacgagaggaaaactggactgtggggtggacagcattaatgaatgcacaggaaccctctctgacatgaggacttttgcacagagaccttaatgcagaaaggaggggagccttgtgaatacgtgggaggagggtggaggaaacagcacttgcgaagaccccgatgcccctccagcattcagcacggggtttgacatgaagtaggtgaccaggcagtgtttgttgaatgaatatcttgaattccaggacatgctgcattaaggagatctttccgtctcagttgtccaagtggcaggtctagatgaggtgagtgttcatttgtaagagtggaaaattctaaccagcccaaacaaagattgtttggtattggagtctcaattataggacttagagtcagtatactgaacttagctctggctacaaaatttattttgacttgtcctctgactcaaggccaggatcttatgttctagcacaagaaacaaggcagaaatatgtaaaatcaccctaactatagtagagtgtttagaaaaatgtttataaaatacctataaaaatgaaaattagcttttctccttgtgtatacctgatgggtttatcatatttgaaatgacttcatcactgtccagattccctgctaaactccacctgggcaggagcatatccccttcatagagtccccccagcacctagatactgcctggcaagtgatggatggccaatatatccagtacttgtggactggttggcagagggagggaaagctatgcagcatttttcagactttatttttaagagcagtcttaggttcacagcaaaattgaacagaatgtacagagatatcccaaataccccctgccctacacatgaatagccatccctgtgatccacatcccccaccagaatagtaccaacttgtaacaatattaattgttacaactgataggcctacatggacacaaaattatcgcctaaagtccatagtatacattaaaattcacccttggtgttgtacattctatgggtttgaacaaatgcataatgacttgtatccaccactatagtgacatacagagtaatttcatgaaaaaaaatcatctatgttctacctatttattcttccctaagcccctacctcctggcaaccactgatcttttcactgtctccatagttttgccttttccagaatgtcatatagttggaatcatacagtatgtaaccttttcagattggcttctttcacttagaaatgtgcatttaaggtccctcaatgtcttttcacggcttgatgtcacacttcctttttgcgttgaataatattctattgtctggatgtaccatcttttagggtatggctatggggagagttctgacctcagcactattgcttgtcaagaaggtgacatggatttaactagcggaagagtgggtttatcaataaaggcaatggtgaactgaacatgaaaccaagaagggtgatcaagctagagaaaaatcagctgaggctcctggagaatgaaccaggtcagagtgagtgatggttggggggaaaacggactggactcagtggatgtatagaatttcaatagtggagctgggggaagattggcacatgggatccatggagttgaaccatcattatgtccacgttaaatgctaactttggcaaaaataaaccatttccatgagcttctccagccggagaaaacagcatgaataaagacacgtaggtggccaagtacatggtgcgtatggacagccatatgcagatcgctttggttggagcatggggtgtttgtattttaaccctgactcttcctaactttgatgctaattttgagcaaatggaaatggcactagccacattcttggatctgtctggtatctggatttttgggttacactgcttgatttttttgcgcagtcctaggtcctcccttactgagaccactattgtactggcttccctggtggctgctgccaggggcagggtgtctgagatgggctccttcaggcacactgtgtctccttctcaggacgaaggacaagagcagcatctctgtagacatggtgctaagtcagcagaaggttctgattgtgcagattcagcatttctcttcctgctggtttgaatgaatatctcacctgcagctgccttgggaaaagctgtagtgtcagatgaggagggtcggaggtcagacagaggctgggctgttttggtgactcagattctttcgtttataacacgctggtaattccacttggggagcctttaatgcctcgaactcggaggccttggtagagactaagttaatggatttgaaatttctttgaaaagctgaaattactggacaaacacaagatggtagtggttgttatagtaattatgataaaaatgagaggaaacttttaattttccagcctgatatgatttgaaggatgcaaaaattgaatctgatgttggtcaagcattgatcttgcagaaaatgtcctgttttcctatagcaaagagatgtcctaaaaatggccctgtaacttttgaattgagtccctagggaaccatggagttttagggtaatatgtttgcaccttgaaggaacatttgattttcatgccccattgtttcccatcgcttcatgcttcaatgccttggtgcaagttgttacctctgtctagaatgcacctccccacctaactggcaatgtcagaaacagttcttcacttgtaagcaccagacacattctctggctagctaaagttgaaaaggaaaagagggggaactcacaaacttgagaggttgaggggactaggcaggactctgagggcatgctactcaaaattaaaaagcctgttggacacagcttgcatgttgcatctcagctctcgatcaagcaagtgcatttaatagactcatcaagatggcggacaggaagagtgagcattccccgagggcattgatggcagtagtggttgctatgcagccaaagaaattaacacatgcctgtttcatcattgtttagtccccagctcaacagtcatctcctcgggaaactttctttgacttcttctgggtagggtcattcaacatgcatgatattcaacagatatattagtatctaccatgtgtcaggcatgttcagggcacaggttgcagccataaacaagatggacatgatctctaccatcaggaagtttacctttcagagaagcaagatgataaacagaatgaagaagcatataagttaattttaggtagtgttaagtactagacagggaaataaagcagggagaggtaagacagagagtgctgtggatggataaaggtggagtatttaagagaggctgagcaggaaaggtctctctgaggaggtgaggaagtgagccgtgtggagtataggcagcaggtgactgcaagtgtctagacgctgggtgggtaggggagggtgggcttgccatgtctggggaatagtaagaagactaggatggctgcaggagagtgatcagataggaagtgggaggaaacaggttctgagaggtagagagagggcagctctcatgggacttggccatgaaaagactttaaaaacaaatagatcttaaaatagacctggttttgtttttctcctgaaaacaggagataccaggtcaagaaggttccttctactctaacccttataaaaaataacctgaagcccttgttcccaccttataaaacccactgctatttcctagtgggatttgaaaccaaatagtgacagagtgatgccagtgcctaaagttttggtcagtctctcaactgagaggttgatcaaaagggggaattattaagtttagcgaaaagctgcctctttacatactttaaaggtttctccataagtagtgaactgcaacctaactggatgtgtaaacagactgtaacccactgttgtccaaacaaccgagtttcagccaatcaagggggaccaactgttcaaactgggctcaagtagggcaaatgccaagctgtaatggatccagctgtttctgcacctcgcttccattttctgtctgccactttccttctctgtccataaattttctttgtggtagaaatggagcctcttcacacctgttctggttcgagatctgtacaattcttgaatcattctttgttcaattaaacacaattaaactttttaaaagagcagtttgggttttatttcaactgtgatggaaaaccactggaggggtctgaacaaaggattgacctaactttatttatgtctttaaaaaatactactctggatgctgcatggatagtaggagttctggagtgaggaggggatagggggcaccagggaggccagttaggaggatattacaataatccaggtggagacaggacaggatggttacttgggtgaggaggtactggtggaggtggtgaaactgaccagtttggggatgtgcttggaaagtggactgctctgtacttgctgatggatttgatgtgaggagtaacagaaagaaaagaatgagagagaaagaatgattcttagggcttttatttaatcaactttaaaatttgaggataattttagagttgtagaaaagttgcaaaattagtacagagaatttcagtatatgcttcacccaggttgccccactgggcaaagtcctagagttctttcttaaatttttaaaattgttaattattgtgcatacatagtaggtgtatatatttgttaggtatatgggatattttgacagaggcatgcaaatgtgctataatcatatcagggtaaatgtgatatccatcacctcaagcatttgtcctttgtgtgacaaacaatccaattatactcttttacttacttaaaaatatacaattaagttgttattaactacagtcactctcttgtgcattcaaataccatatcttattcgttctttctattttttgaacccattaaccatccctattccctgccctcacacccccaataccctttccagcctctggtaaccattgcactactctctctgtctgtgggttcaactgttttcatttttagctcccacagatgggtgagaacatgtgaagtttgtctatctgtgtctggctttttccacttaacgtcatgacttccagttctatccatgttgttccaaatgacaggatcttattctttttatggctgattagtactccattgtgtatatataccacattttctttattcatctgttggtagacacttaggttgtttccaaattttggctattgtgaatagtgctgcaataaacataggagtgcagatatctctttgatatactgatttcctttcttttggatatgtgcctagcagtaggattgctgggtcatatgttagctttatttttagttagagttttaatatggtatagttaacgtgctggatggagttgacatttgttgagatggggaagacgcagagaagagggagatatctctagctctgctctggccatgtcagcaaatcatttcacattcaagtggaagcagatatcaaacaggttggctagatctgtgaacacggagctcaggagagagcctgggttgtgggtgcagctgtcggcatttagatagtatttaaggtcacagaatgctccactcttttatatttggtaattttcgtaataaaaaattcatttaaaatggagtcagtttaaggaaatatgattaactgataacttaggtcatacttttctacaaatggccagtagaaaatgttttaggctttgcaggccataggatctgttgcaactactcaactctgccgttttagcacaaaaggagctctagataatgcatcaatgaatgggcatggctgggttataatgaaactctatgtacaaaaactgggtggtggactggatttggctcacaggctgtagtttgccaattcctgggctctacaatgttgagaggttgggaaggtgatgacaaaccatcaaggaggctgacagggagcaaccagtagggtagcaagaaaaccagggcagtgggaagctcaggaaggcaagtccaggaaaggaattctccattatgtctgatgctggtaggacaaggaatgagaattgtcctgtggatttgacaacacagaggttgcaggatacctttcagtagcaccgtcgtggccacacctgaccagagttcgtagaggaaagaatagcacagaagtaggcagggtggttatagccaactctctagatcatttttgctataaaagggaacagagagaaatggagaattatctacagagggacacgaggtcacataagggttttcatttctgtttttaaggtagaagctacgcttgtattttggggtgatcctcctcatgattttgctatggttggaccctgtatacacttcttcttcttcttcttttttttttttttttgagacagggcctcactgtgttacccaggctggagagcagcggtgcaatctcagctcactgcaagctctgccctaccaggctcaagagatcctcccacctcaggctcctgagtagctggggccacaggtgtgtaccaccatgcctgcatgcctggctattttttttttttttttttttttttgtatttttagtagagacggtgtttcaccatgttgcccaagcctggtctcgaactcctgagctcaaatgatctgcttacctcggcctcccaaagtgctgggattacagtacacttctacaattaattctttcacattatcatttctttaaaatctgtgtcttcttttagcagggtttctcagtctttgaacgtgacgttatgggccagacaattatttgctggggggagggcaaaattgctgctcgttaagctcctagagtgtgggactagatttactcttcttgttctccctggtctttaatactatgcctggcatacacagggggtgccataagtattttgctgagtgagttggtgaatagatgtgttcctttacaaagtactgttttgatcatctcataagaaagtcacatggtacctgggtggcctgagggaaaagcaaggcaggtctccagggttgagtttagcatgcctgatctttgctgagattcaggatttccaattgcactggagaggattgtgtaggtagtagcaagagggtggctacatttagctgacgtttctcatgcggcttctggactatcaaggtctcttgcttcatgcctcctcatctgcttgggaatgttgcttatgtagtttctccaaaagcaagtggacatgagggatggggaagctctttatctcaagcatgattattacacgtggattccattatttaggcaaatgctgtctacagacgctccaggagccacctcccaacacctgtctttcacctcttgccagagactcaaagatgagtgggctttcagagtcataacaataataatattaatagctgtcactctgaaatagacatggcaatttatactctgtgggggagtctttagtccctcactggctaagcacagtggaagggcacctgtatgtgaggtgatctcagtgggagatgaagatggtgaggaataggctaagtacctccctccccttgtaccaccctctgatgcaaacatgacctccacctttaggggattctataaaatgttgttgaatgggctgggcgtggtggctcatgcactgtgggaggccgaggtgggcggatcacctgaggtcaggagtttgagaccagcctggccaacatggtaaaaccctgtgtctgctaaaaatataaaaattagtcgggcgtggtagcacacgcctgtaatcccagctactcaggaggctgaggcaggagaattgcttgaacccgggaggtggaggttgcagtgagccgagatcgcaccactgcactccagtctgggcgacagagcgagactccatctcaaaaaaaaaatgttgaataaatggatgagtggatatgcatccgtgctcccatcttgttcctgtcttccttttatttgtgtttctacctggcaccaagggtgtcctatagctgtctctgagtaagactgaattcataagaatttattaatttctctaaagagaggagactcagggtcccagtaactgaatgctgttcttctttcagtctttcctgtatcaccttcctggattttgccatatcaaggtatcacctactttacggatctataaactatggcctgccacctgtctttgtaaataaagttttattagaacagaattgcacccatctgtagatgtgctttctatgggtgctttcgtattacaacagcggagttaagcagttgctatggcgaccatatggctcacaaatcctaaaacatttactatctggccctttacagaaaagcatgctggcccttgaagtacattattatttaatcaatttttctttaaattgactcagtttcagaataaacttattgctatggagattagcaaacatacaagaatagagagaatgtgtaatgaacactcatgtaccctcaattcagcttcaactcatggtcaattttttttttttaaaaacagctgcattgacatctaaataatattaaaaactgcgtgtgtttaatatacataatttgatgagtttggatgtatgcatgtgcctgtgaaaccatggccacaatcaaggtaatagatatatctttcacttcaacagtttccttgtgtctctttgttttgtttttgttgttgttgtagtgagaacacctgagatgagatctctcttaagaacattttaagggcagaatacagtttgttaactatagacactatgttgtccagcagatctccagaacttattcatcctgcataactaaaactttattgaacagcagctccccatttccctatgcccccaacccttggcaaccaccattctattctctgcttctatgagtctattttagatatcctgtatgggtggaatcatgcagtttttgtcctctgtaatggtcttatttcacatagcagaatggtccaggtttttccatgttactgcaaatagcggacttttttttctttttttttttaggttgaacaattttccattgtataaatatgtcacattttctttattcattcatctctcttttttttttttttttttttttgagacagggtcttgctctgtcgcccaggctggagtacagtggcacgatctcagctcactgcagtctccgcctcctgggtacaagcaattctcccacctcagcctcctgagtagttgggattacaggggtgtgccaccacacctggctcatttttgcacttttagtagagaccaggtttcaccatgttggccaggctccattcatctcttgatggacatttaggttatttccgtatcttggctgttctgaataatgctgcaatgaaacttctgcgaagcaaaggaaacaatcaacagaatgaaaaggtatcctatagaatgggagaaaatatttgcaaattatatatctgataaggggctaatatccaaaatatataagaaattcctatgactcagtagtgaaaattattaaatggacaattaaaaaatggacaaaggacttgaaatatatgattcttcaaagaagacatgcaaatggccaacaggcattaaaaaggttctcaacatcattaatcatcagggagatgcaacacaaaaccacaacgagtgactgtgaaattatctcacacctgttaggatggctattataaaaatgaccaaagataacaagtgttggcaaggatgtggggacattggaacccttgtacactgttggtgctaatgtaaaataatgcagctgatatgaaaaacagtatggcggctcctcgaaaaatttttaaatttttattatcggttggtgcaaaagtaattgtggtttttgcaattaaaagtaatagcaccagcgtaatggaactatcttatgatccagcaatcccacttctgggtacatatcccaaagaattgaaatcaggatctcaaagaaatatctgtaccctcatgttcactcatgttcattatggcattatccaagagagccatgttggggacaatcttatttaaaaaaaaaatttttttttgagacagagtctcactctgttgcccaggctggaatacagtggcgtgatagtggctcactgtaacctccatctcctgagctcaagcaatcctcctgcctcagcctccctagtagttggtactacaggtgtgtgccaccatgcctggctcatttttgtgtttttctgtagagatggggtttcaccattttgcccaggctggtctcaaactcctgggctcaagagatccacttgccttggtctcccaaaatgctgagattaaaggcatgagccatcgcaccctgcccaatcttgttttcttaatactccctcctccctaataccttaccaaccccctgattattttaatgcaaatctcagaacttatatcattttaatttaaagtttcagtaagtatattaaaagaactcctgtattgactataaatacaattttattattcctcttaattaataattccttaatatcatcaactatccttaaataactcaaggtttttaaacataaatacctacttaagcttcatttcaagcaataatttgcttgaaattatggttcagatatgctatttatattttttaatatagtagaatggctcctgaatttttgaaaatttaagaggaaaatgtatccctgcaccatctaaaatgatcttgtacaccatcagtataccacacactggaatacaccacgttaaggaggcccttagcggaaggcgttgtccactttcttctttgaatggtatgaaaggtcttacagtgtccttgttttcacaacccagacagagttagtcagtgcctggagcaaacaccagcgacatgcataccaaccatgaaatctgaaggaacaacaacttcatagtcatcttcaccagctcaacacaatttatagtacaattaagaccggcaaatctaattggataaacagaaaatagaattaaggtaatctatcctaagtataccaaattcctataatgagttgctttcagcagttgtggaaacatataattaccaaacaaattacatgttatttttatctaagaagctaattaagtgttctgtgtaaattattatgtggtggcaccaggatcagagttgtattaaatacctaattggaaaagggatgagacccgagaattttacatgggaatgtgactgagagagatcatagcaagagggtctgattcagagacagggacttgagagaagctaggtggaaatgggagagggttagggtgtctttggttggtttaaatttgtttgtgtttttagagacagagtcttgctctattgcccatactagagtacagtggcatgatctcagctcactgcagccttgaactcctgggctcaagcaatcttccctcttcagcctcctgagtagcagagactatactcaccaccgcacaccaccatgcccgggtaatttttaaatgttttgtagagacagggtcttgctgtgttgcccaggctggtcttgaacttgtggccttgatcctcctgccttgacctcccaaagtgttgggattacaggcatgagccactatgcctggtcactttcgttggtttaacttgagcctggatggttgaggttaagtcagggctctgacgtgtatggagccttagtctttttaatttatctgttctttaaacttattcgtctccctaaatgtaagctgcaagtctctgtgtgctgcagctaaccttaaccctgggttttttgagtgtgtgtgtgtgtgacccttatataacttccttactttgctctcatttcctcatttccctgtggctcagtaaatcttccaatatcttcttgtgggttcgtgctcttttgcaccctggaatggtaggacatgggcgctttgggatatttcctataactcagaacaggtagcctggaagaattttgcaatgaagctttgagctggcatcagcctcaagaaacatatccctgttgagtgtgataggagaggcagaggcttctcctaagttgaggcaggtgaggattgaagttgctgcatttccaccaggttagacatagtgctgtggtggaaagcactctcagctggagtcataagaccagatttattgtccctgtcctgctgttggtgagcagtgtgacctttggcaatgcatcattcccttctgagctctggtatctcatttgtaaaatgtggaaaatagcccttggcctatttacctcacagaggtgccctgaggatggcatgccatagtgtaaatgaacatcatctgtaaaatctcaatttttacaacagaaatatatgaaaaggtctggcattatggttgtttttaaccaatggcagctgtaggaagtcagacaaggtgggtgatgtaactgaaaagagcaggaatcttccagcctggctagatccaggtgtcatttggatttggtctctcctgcttttccccttgattcttctctgtattcattgtgtttttattttattttatttcatttttttagatggagtctcgctctgttgcccaggctggagtgcagcggcatgatctcggctcactgcaacctctgcctcccgggctcaagcaatacttttgccttagcctcctgagtagctgggactacaggcacataccaccatgcctggctatttttgtatttttattagagacagggtttcaccatatttgccacgttggtctcgaactcctgacctcatgatccgcccaccttatcctcccaaagtgctgggattacaggagtgagccactgtgcctggcctattttttatttttttgagacagtgtcttgctctgtctcctaagatggagtgcagtggcacgatctggctcactccagcctcaccctccggggttcaagcgatcctcccacctcagcctcctgagtagcttggactacaggtgcataccaccatgcctggttgcttatttttatttttgaagagatggggtctcactatgttgcccaggctggtctcaaactcctgggctcaagcagtcctcccaccttggcctccaaaatttctgggattacaggcaggagccaccacacccagcctgtactgactttattcagggaatgtctccccaccccaactcccagtgtggcaagacagtcactagcagaagtgttgcatctttattctgtcagttaagtgacttaggggaaacagagtgcagagtccacttcctggtcgcttcatcagaagtcccagggctaactctgattggactcctcttcctcacttgcccataaatcaaccaatcacattgttcaggataggaatacactgactgaccaggctggtcatgtgcatatcctgagagctggagatgctgaagttgccccacttgagctacatggaatgaaaagtggggacagttggttccccaaaagtgccagaagaaagagtgttttctggactagagaaaaccaaagatctcattctcccataggctacctatttgaattataatagaaaaatttactagattgagagtcagggaagacttggattctagtcttgactgtgtcactatcactccgaccctggatgtgtcaactctctttttgggaacccagtttccaaatctttgaaagagatttgggcctgaattcttctgaagttcctcaccttttcttcaccagggactcttcttatcctgcggctttttatcgtcatggtatactgtgtgttttgccggcaaaacaaaatacattaattaagtactaatcgattttatttaaaaaaatgaattaacagcatacaatcaattgccacttagaaatgcagatcaacagaacataaggtaaccagtggaactacactgagttatatatattccagcccaaagcaaataaacttaaatatttctttaatcttgcctgtgttgcctgggacagcctgattacagggcagaatttgaattatgccaggccttatgaaatgttcagcagggctatagattcctatttctcatttactggatctcaggtgcctgtaatcccagctactctggagactgaggcatgaggatcactttaacctgggaggcggaggttgcagggagccaagattgcgccactgtgctccagcctgggggatagagtgagactcccttcaaaaaaataaaaattatttatctcatctctctgggttctgcacatatttgaatttgctgcacctgatacagaccaaatcagtgtttcctaaacctctctgatattaaaaataacctgtgagctctttaaacttacaacctcttgggtattccccccaccccactttgattcagtatgtttgggtaaggttgcatacttgcctttttaacaaggtatccccaggtgattcttatcgtaaagaaagtctggaaacactggactaagtaacatccaaggccttactactctaagtgtgagcagccacatctgtatcccctgggatgtcttgtttaaattgcacaggccaaaccctacagacagacaactggaatctggattttaacaatggaagcagattggcttttgtttttaattggcttttaatttgatctattttctgttttcattgtaatgaggctttcagctgcccctcttgccctaggcctcttcagaagagacatttccctctcctctccctgcctccccacagggtataataaacacctgttggggtttggtggggaagctcaccctgacctcccatcactgagacacgaggtgcaaaagtgttctgcacacagcctgagatcttgcctctcaaagcagacttgacccccaagcttccacccctaggtctcaggaagaaatggcctcagcagattccaggcctccagggctgtctgtttcatgctctcaatttttacttggcttgatccgtgctgtctccatccggtgttctgaggcatttcacacacgactggtcttcggcaactgggccaagcctgttctgttctttttcagttttcttaattgcaaggctttttgtttccccactggagaactcccataccaagaattctgaaatctaggtactcagaccttagtggatgatgttctctcagcacttaattcactcatcattcaataaactatcctcaagcaattctatattcaaaacattctgataatgatggcatagtaataatgataatgataatagttggcatgtattgaaattttattatgtgcaagaaactatgccaggtactttaaatatctcatttaatcctcacagtaagtctgggatgctggcactattcttacccctgcttgacagatgggaaaactgaggctcatagaaggaaacagagtgcacagtgtctctgatatggtttggctctgcgtccccacccaaatctcatctcaaattgtaatccccacgtgtcagggaggggcctggtgggaggtgattggataacgggggcggattttccccttgctgttctcgtgatagtaagcgagttctcacgagatctgatggtttaaaagtgtgtgtcaattgcttcttttctacccatccccatccttccgctgtgtgagatgttcctcgcttcctcttcgtcttccaccatgattgtaagtttcctgaggtctccttccccagccatgccaagcggtgagtcaattaaacctctgttccttataaattacccagtctcagatagttctttacattgtgaaaatgaaccaatacagtctcacagttgaatagtgatcgaatgtggtttcaaactcagccctctctgacttctgagtcttcagtgttaaccatctcacacacttatatgatttaggcttgatggaaacagcccacttttcatgaagcattatctacagagcctttaatttctactaatgccaagaggaaagtgccatgcccaccttggtgatgacagaactagggtctaggagtggattcatatggtcagagtctcatggccagggattggtaaaatccaaatttggaatctggcttctggctataagcccaaggttctttctgtcatcccagactgtacagcccattatctcaaggagctggcccctcagaggcagagagatcatgttcagtatctaggagtttatgacaagtactatgtggtgcatcccaggctctgaggataaagtcatgactcttgggtgagctcataatgcgggcttgcattgcttcagcccttactttgtgctaagcatgtcacactctctcatttaatgctcttaaccctacaattacccccattttacagaggaggaaactatagtgtctcacacagaataggtgcacagtgaatttttattgaaaagaagaaaaatggcacgtgagttgaattaaggaaatgtaggccagggctggggcaggaaggcatacagtggccatacagccagctgacgggaataatcgagtgcctgaatatggagtttgaacttcgtcctccgttttgtaagtagctaaggaagggaaatgaaattgtccatagtgtgcaggaaggactggaggcaggtgaaagcattaggtcattgcagacctccaggtgtgggtgatatggctcaaactaagatggagaaaataggaacacctgtcagcatgtgtagggggcaagaatgtgactttagagtcaggcctgctttcaatccagcctcctcatttaagcaagttactttatcttctctgagcctcatttttgttctccttttaaatgagggtggtaccacctacttattagggttatgtagcatgtgctgttggggctttcccatatgcccccagtccttgcctccatatactgaagcttgctcactgtgaacccctccgactctgtcttttctggctttggaagcaggtttagcccacctgcagggggagtgaaggtgctggaagcagccaacggtagggatttgtggataagcactccagtcctttgtcttgtaggcaggataactgtgatgtagagtagatatttcatgctatatcccagatgtctctagtgatcttaaggcccagttgccttaagcagtcacttaatttaaaatttaccatttattgtttccttttacttccctgtctcacttctctttcctcttaccagtgtttcctgggatcatttctcaaaccactgggagctcaaattctttttcagggcctcaggtcataataatgataaaacgaaacattgtatgttaagtgcttagcacagtcgtgaggcccaaggtcagttccccgataaatggtagctgctataaacatcatcatcattaccatccttgtgaaggtggagtgaacttattctttcaagacatttccactgacagataaattcatccaaaatatgaagaaaaatgggggaggaaaaggtcacctagaatatgcagagcaaaatattgcaatgatttctttttttaatgagatagtttattaattattaatcagtatctttaacctttagtccttgtttaacaccatggataacaggtctacaattgagtataattagccaaatgcctcttgcatcctaaattggctattctgagttacacagtttgattttcttggaaggaggacctggtttcattagcacctagttgcaaatgaatctcctccttgaagttcttgttgctatttgagcttgtttttagctggagatttactcttggattttagttgttttcgccttcatctgttgaagaggtgggatgatattgcgtgtgtgtgtgtttgtgtgtgctggaagttatgcttccaatatttacaatattggctttccaaagcagaagatgatgggctttctgggagggtggttcaataggaaaccttcagaaccagtggggttggatggtggagcagagtgtaaaagggagagtgatgaaaagtagagtgattgaaaggataagcgcatctgcttttagacttgctcacttaacttatatgtgcttatctggaccttggccccaggggaggagatagaggaatgcgtgagaagctgtcttgagtgttagggacggagtatgatgaatgcaacaactgtcagttctgtgtcaacttggatggggctacagtctgtactcagtcaaactctaatgtaggtgggttgtgaaggtgttttgtaggtgtgattaaagcttataatcagttgactttaagggaggttatcttagataatctgggtgggcctgattcaatcagtcagatgccttaagagtagagctgaggcttctctgaagagtaaattccacctgaggagagaaggtttagctcatgcccagaagttccagcctgccctgtggatattggacttacctacccattccccacaatcatgtaagccaattccttgtcatgtatttcttaatatatgtctcccgctcatctgttcctttaattgaaccctcaataatacagattttggtgccaagaatagggctctgttgtaacaaataccttaaaaagtggcagtggtcttggaattgtgtgttgggcagaggctagaataatttggagacacatcagagaaaaagactagacatccttcaacagactgtgagtggaaatacgaatgctaacagttctgtttctggggactcagaagtaagaaacatgttagagaaggcatacatcattttagagactacctaaatcatcatgaacagacttttggtggaaatatggacgttaaaagcattaccagggagggctacctacgaaggaaatgttattgaaaactggaggaaaggacatccttgttatatagtggcagagcatttatctgaattatatgctacagttgtgtggaaatctgaacttgcaagcaatgaacttggtaaagtgttgaaggggcagcctggtttcttcttgctccttttagtaaaatgtgagaggaaagagattgaagcaagaactgttaagcaaaaagcaagcaagatttgatgacttgggaaattctcagcctatctggattgcaaaagatgctaaaattaggagatttactatcaggaaagcatgttaggaaagggtatggctgaacagttttttttgctagttcgttggaaagataaaaagtcccagtattcagccacacagagtgctctttgaagagattaggtatgagactcatgtaccccttggccatcaaatcagaagcaaagaatagatattaggattatctaggaaagaactgtgaagaaccattttttgtctgatggagtgaatccccatgacatactcaggagacccataaggtttttgaaatttcctaccagcataaacattggcaatttggacagaagggaacagagaagataaaatgaaggaaggccattacactccctaaattctttttttattattattatactcgaagttctagggtacatgtgcacaatgtgcaggtttgttacataggtatacatgtcccctgttggtttgctgcacccatcaactcatcatttacattaagtatttctcctaatgctatccctcccccagccccctaccccctgacaggccccggtgtgtgatattccccgccttctgtccaagtgttctcattgttcaattatcacctatgatatactccccaaattctacaggcaggaaatgacggttaaaactcttaggctggaaacacatattacccttcatgagaaaggactggttactcagagggtagagcctcaagctcaaaggacagagatgggagaggattatttctaggctttgaagcctaatgtttgcctaactgaatctctcctctcctttttttttttttttttttttctggaaacagtgtctcaccctgaaggccagactggagtgtggtgatgtgatcactcactgcaccttcgacttcctggtctcaagtgattctcccacctcagcctcctgagtaggttggactacaggcatgcaccaccatacccagctaatctgtttttgtattttttttttcttttttagaggtggggtttcaccacgttgtccaggttggtctccaatgtctgggctcaagcattccaaccaccttggcctcccatagtgttaggattacagggattagccactgcatccggactgcctaactgaattccaaaattgtttggatgtggtaacttgttttttcttttcattgattccttttttgatcaaaaacccctgtaactgatatcccatgcctgttccacaattgcatctggggagcagataatccgttttctagttttacaggtccacagttggagagaaactttgacccaggagggatcatgctcagattcttataagtacttgacttaggtgattgagataagattttagacatctgagctcatgagatttatttatttatttataattattattttttttgagactgaatctcactctgtcaacccaggctggagtgcagtggcatgatattggctcactgcaacctccacctcccgggttcaagcgcttctcgtgcctcagccttcagagtagctgggattatgggtgcacagcaccgtgcctggctaatttttgtatttttagtagagactggtttcatcatgttggccaggctggtctcgaactcctgacctcaggtgatccacccgccttggcctcccaaaatgctgggattacaggcatgagtcactgtgcctggtctgatgagattttgatgaaaattttggactttgacactatcgtgagttagttttggggagatggagtgaatctttgggagcaagatggtggcctggcaggcagaactacgacctctcaaagatgttcaccttctaaactctgactcctgtataaatgttatgatttatggcaaaagggattttgaagatgtgattaagttatggatccgtcttgagatgagagcctcatccaaaattatctggtgggcccaatataattgtgactgtacttataagaggcgggcatggaagagtcagagaaggagatgtgaccatggaaacagagttagagtgatgtggccatgagctaaggaatgtgggcagactctacaaactggaaaaggtaagaaatggattctcctctaaagccttagaaggaagcactaggaaggcctgctggtccattttaggtttctgacctccaggactttaatacattttacatcactctaagccactaactttatggcaatttgttacagcagcaatgggaaacttataatctgttaagtgccaggtcttctgctacactgcttagacgtattattttgcttctttctgcagtcctttaggacatacgtactaaattcccattttgtggttgtggaaaccgaggcaatgaaagttcagatagcttgcttaaaatgacagatctagttagtggtggctctgggatttaaccccatgcccgaatgattccaatgcctatggactagctcttgcatgataaatgtcaagggacatgaggagttaggtcagaaagccatcacgacatagctcaatgtgtggctttacatttgacgtaggatgacctagtggtaagtggtatagcacctgtttaggtgcactggagacatgttgcatggccccaaatccagctttgccacccattactggctgagtttactttggacaagttatttcacatcttttttttttttttttttgagacggtgtcttgttctgctcattctgttgcccaggctggagtgcagtggcacaatctcagctcgctgcaacctctgcctcccgggttcaagcgattctcctgcctcaggttcctgagtagctaggattacaggcatgcaccaccacgcccggctaatttttgtatttttagaagagatgggatttcactatgttggccaggctggccttgaattcctgacttcaagtgatctgcctgcctgagtctcccaaagtgctgggattacaggcgcgagccaccaagcccagactatttcacatctctgaacctcagtttccttacttataaatggggattataatacttttttttagggatatggagcttagaggagaataatggtggtaaaatgcttagtgcagtgcctgacacatcataagcgctcataagtaaaataataacagtagtagtaataataacaataataacatgctaataataatggcgaattactcttcctgttttgccactctaggcagagggatattagtgaagagaatacaagatccatggtgggtcaggggcacaagtgtgttacaagcaaaaagaacagcaggcactcaggccattgcctatgaaatgttcttccccacctcttaaactggctaatcccattcaaaagccatgtctcccaggaagtcttccctgaccttcttggctgaaacagacgccctttctctgagggcctatcacagaaggtactttcctactctagtcttgtcaatgcatttgaagcctctctcagtagcctggaaactccgagagcagaggtgctctctgtccctctcttatttattgttataccctgagcattaaaaaaaaaaaaaatgggataagtggtgagaagagactggagcggcaggccttggccatgctaggagggaccctttagcttccaacttcccgatgaatttccccccgagttggtttgctttgtctttgtaactgagaacagcctagggagaagcatggacatgggggacctgcaggcatgagactggttgcttagcatctccatggcccctcactactacagcccactctacatgctgttctgggcctcattaaaacctgttctccactagcctcggtgtttaatatttatcgatcacccacagcatgcaagctggtcaataagtgttttcagaagcctcactccatgccatcttgatcagcccctgccgctattttccatcatgccagctcttgaaatcttgtggatgtgccttgaattttttaagtgcttttctaacaaaagtcccgactgcagagatgcagaagcttaagttccatttcatttgcctcctgaaccttgagggcactggtttttatattgctgcctctgtccctcttagtcctcagtccccacacttctcaggatagctgaagagatgagtctgtgtttggctctgagttccagctccctggcagctatggattatatgttagcacaatccattttactcccccagctgtttactttcctggggacctgcttgagtcaggctgctcccgaactcccttaatgaagacatgacagtgggtggctggagacgagaagttgcaggagaagcgagaaggagagagagagtcccctgggttatatccctgttactcaacattgttgaattagatcctcaacattccatcatgtgatgtttggatgctgggaggggagttaaatatagaattcctccttttggcatttcagaaggtttatataatgtcctgttccttttgacagtggggagaaagtgaataggatggcttggaagatgggtctgtgtccggagctccatttaaagtctactcagcagcctgacccatctgcctactcaggggatgttcggtgaatcatgtttgcaaaggcacagatgcccttttgagcccaaagatctgctcagctcgaaaattctattaattctaagattctacaagtagccttcacaagagtggatgctgaaaatagatcagccacgtggtatgccctgaatttgcctggattactgatttgattttcccctcaatgtttccctgaacctggcctggaaattcagcttgctttaccatttgaaccctgccgtggagtcccagggaccagcgttccaagtctgcctctatcatttcccagccatgtaaccttgaatgagtctcttggcttttctgagtctcattgtctttagcatgtccccatacctatctctccttcttactttcttgtcttagtaaatgacctcattttccatctagctgttcaaactacaaacctacaagtcacctttgatttctctctccctcttacctgctatgtagaaaccatcagcaagggcttctagctctgcccttaacacagatccatgaaacatgcttctaccttcactgcaactccttatgaaatctgcattcagtgacagcagcatcttctaaactggtatcttcttccagctttgacatcctatgatcaatgcatgacctcgctggtcgagtgagtaagaacgatgacaaaacccatatcttgaatcacatgcatctttattaaaatcttcctccagctttccattttacctagaattaaaatcaattgcttgctgtggcctagaaggagcaccataatctcctgcttatatctcagaccaaatcctgctctcttttcccttggtcctttatctttctggaacattcctcacactcacctttgcacgtgttgttccgtttgcttgggaatttcttcccctggacctttctgtggttgtcttgttctcaccattcaagtttcgtctcaaacattgctgactgtgacaggctgttcatgatcatccaagttcaagtagcctccactctagccattagcccattactcagcttcattttctcctatagcttagctctatctaagtattatatggttagtgttttgttttttttaatcaaactcctcccattaaagcatgtgtcctttgaaagcagggacattagtcatttctatatcttaagagagttatcaccagcctgggcaacacagagagactttgtctctactaaaaactaaaatgacttcaccaggtgtcatggcttacacctgcagtcccagctacataggaagctgaggtaggacgatcacttgagcccagaaatttgaggctgcagtgagctctgatcgtgccactgcattccagcctgggcaacagagcgagaccctgttttaaaaaagtaagtcacgcacgtagtaggtgcttaaaaaaaaaagtgatgcacatagtaggtgcttaataaatatctgttaaatgaataaagattggttacggggatgaaataagagcgtgctcaggtatgcacagacacactcatgcacatatgtgcattgaaactgccatggtaagaaatactattgttaatagctgggagccagaatttctatgactctccagttgcatcaggcctcccttgactgtattatgctcctaagaaacttttcttgccttttgttgaattaaaattctttaacttctcagctatctcatggatctttgcatctgttttgcatctgtttcttagcagcctagcttggcgcatggtgctttatagagacatttagcatgtaaagatatttataaaggagggattctcttctatttttgcccagtcatctgttggagagagggggagcagcaagcaggcacacatgattcatgctcttgcctggagggtgctgcccacctctagcctagaagagtggggtggcaggagccctctgcattccaaggctggttccagtgaatggagcatctacagtggtggtttggccaatctcaacattctgtaatggcctcttctttacagttcacacttcccagataggttaatattacagctccttccatcagaatgtccttaagtgtgtagctgcaaagttgaggggtacagttcataaaacgatcatttctgacatcacttggaagattgagggctgccaagaccacccttatctttgataattcactggaaactcacaaaactcgctgcaagctgttgcacccacggctatggcttgttatagctgaaggatacagactaaaatcagccaaaagagggacacataggcagaatcatgaaaggtccaaccgtgagctgccagtggtgatcttcctacggaatcatggacagtgccaccttctcagcaacaacggatgaaaataagcatgggacgttgccaacaagggaagctcactgagccttggcgtgcagagtcttttttggggtctgctgttgagttcttatatgggtgaccttggcttccaggtcctctggaggttgagctcatgctatgtgattctaagcccccactctaaatcacactgttagactctctggtgtgacccaaggcccccacaagcaaaaaaacactcctatccaggcatgacattcccagggcttagtaagacaccaagggtaaagaccagacttctttttgggcgaggtttaattctttactatggaagagctcaacttgatactcttggtatggatgacttacgtagatagcggtggtgctggcccttttcttgcttccagtgcctgaattcatccatcaattccacaaatatttattgattgtgagctaggtgccaggctctgtgctagttgctagggatacagtggtgaaggacatagttcatgctataaaaaggctggggagacagataaacaggcaattattcttatatataaatataccatgatgctagaaatgatactaaaggctcttggtgcacaagggtgcctggcacagttgctggtgaagacttcccagggcggtggtagttaggctaagattggaaaaatgattagaagttggccaaccagggtggagtatgggggtagggaggtagtgtttaggtggaggaatatcacatgcagaggttgagtggtgagaaagttcttgaggatggtaaggagctccacattttcatggatgccacagctcacaggtgattcatcttgaacatacagccaataaacacccaaagactttcccatcttgtaccaaggcaggtggatttttttttttttcaagactgaatctctgttgccaggctggagtgcagtggcacgatctctgctcactgcaatctctacctcccaggttcaagcgtttctcccaaggcaagtggattttgaaatcaagaaaatggggttcatgagagaaattcttggcccctgttgctgtcaggaaggcttttagactaaaaagaatggagctaatgaaagcagttggatagggcaagcgtatgagcattggctttcactggcttagggcagctccaactcccccagaaaaggctctttgtttatggtgaggtcaggacttcagagtgtgactcagaaggtcctcagagctggtaaaaagtgtagactggtgctgtaggccaaaagacaaggtttataaaagcagaaggatttctgagacatcttggacatgtgagcaggtgactcacagacgttctagaaaccatatttcaaagacaatatttttggcagaatcaaatggttgctttgtggtcgtttcagggagttccagcaataacataaagaaaattaacagaaaccaacaaatggtagggaaaaacgttggtgatacgtgccaaagggttactatctttaacgcacaaagatgacttacaaattaagaaaaagacaaaacaccctaaaagaaaaatggaagagaaatgagtaacatgtgattagagaataaaaactcaatggctaatagatgcccaagaaaatagtaaaccctgccaatactgcaaaatatttgaaatacggtaatgaaactggctgggcactggctcttgcctctatttctagtgctttgggaggcagtggcaggagtgttgcttgaggccaggagtttgagaccagtctgggtaacatagcgagacccccctctctacaaaaaataatttttttaaatgagccaggtgtggtggtgcacgcctgtagtctgtttcttggaagcctgaggcaggaggatcacttgagcctaggaatttgaggctgcagtgagctctgattgtgccactgcattccagcctgggcgacagagcgagatcctatctcaaaaaaaaaaaatatatatatataaagaaatccatcaactcacacaaaaatgttgttgatgggactttgcattattcttataattaagaaaagcaaaatgaaaattcagtaagcaaaacagtgcagttggaaggagctctaagcctccctacttcattctggtgaaggcagggagtcaggaaggagtctggggctcctcctgtctgtgtcctcattttgtctcccacctcctggcccccagttttcctgcaggtgtgagtgtgtcagacctccttctgctctgagtgggagagaactcgctgtactctagggagctgagtttggggaaagactggcccttaagcatcctcccacccagcctttacccccagctctctctccctgtaggacgcctgattttcttggcagaggaagaagctaccctccatccactttcccagggtaggcaaggcagcctcttcccctgggccatccagcctcctgtaggcctggggcttagcaaaacagccagggagggggagactcggaacagtctttttttttttttttttcctcccaccatgagcagtatgaggatgatgccttagctccattgctttgctctcagccttcagacttgctgtaggagaatctctgctgtaccctgtcatgtcttagatttgtgtaattgagggaggcctcccaggcaatttaagtagggatttacttattccttgggagtgctgagcttgtagtggaggaatggtctactcactagtgtatttactcgacttctcctaacaagggtctttccacttggggttgttctgtccagcatcccttgggacttccagggaaagccaaatattctttgctgcccctgcttcttcgacaataaatgcaaaaagtttgaaaaaatcccgtactggtgttgtgtcaccagggtcaaagaccttgaatctctagtaagaagtagaaggcgtcaagaggtcaagttctgactccatagtttcaggacattgtgggacttgattgctgcagtgtgaaatttatggttttgtaagacagatttaaaaccctttcatggcatcttgtagcctttggaataaaatccaacatcctcaccatggcctatgaagagaccctgcatgatttgggcactaggtgcttttttggggctttgtttgctgtcattttcctccttgttctttccaaccctaggggctttgtcctcatggttccctatgcctggaatgctcttcccactattctgcactggttgacgatgacttcttcacaacttggcttttggggcatttcctttgagagggcttcgtgacagtcctgctaaccttttccataggagccctcatgtcattagctgtaccacaactttaacttgtatgtgttcatttacatgtttctgtctcttctgtgaaatggttgctccttgagagtggggcctctgctctgtcttgtacaacacctgacacacgggccaacttataaatatcatgaatgaatgaatgaatggatagctctctagttatcaattgtgactgtatctttccctgccatctcccagctccgtctcacctggaccacctggaaaaacctcttgtaccccataatttcagtgcccctgtctgtatctgaggctatggaaaagctctctacccaagcaccaaggaatcctgcccttttccgcttgcccggataaacaaagagttatcaaggctaagttgccagttatgttggcttcttctcctgtttgctcttgggaggataggattttgattacaagcataacagcctccagttattgagcatctactgcatacagggcaggcactttgcatacatgatccctgatcttcatagtatccctacatggtaggttttattatcccaatgttgtaagtaagcaaacgaaggatctcacaggtcagtttgctccctgggccacctgacctgtgctcttttttccctatacatcgtggcctaggttttggaacacacaagggcacgcacacggcccttctcagactatgacaatatagtgcactgcaagacctcgcttttttaacaacctaagctgatgggttgagttgtgagagtcagaagcttgcaatttcacttcatctgtctctggagactattctggctttctactgcctggaaagaaggtgggaacaagggctctgtgagggatgattacaccagggcagaaacagctcacctcttgagtgctcatgtgccatacactgtgccgagtgatttatacatatagctttctgtaacccacggagcagctctatttgtactgttattttgagcactattctgcaaatgtggaagctgaggcacacagtaagaaagggtaaacagtggaggctggatgcaaacccaggtagtctgattacagagtttgaaagctcagccaccaggtacctaccaaccagctaaacagatctcatcattcaaagtgtggtccatgcaccagcagctttgacatcctctgggaacctgaatgcagaatctcaggtcccatccagactgaccgagctagaatctgcctcttaacaagatccctcggcgattcacgtgcatgttaaagtttgagaagaactgccccagaaattctatgaatataaagtaagtgccattttcctgaagtcaaaagctggagatttagagcatcagtgttcttagaaacaacgtgcgacttcagtatcttgcaaactatggcatcaacgaggagctgttcctttgcttgagggaattagtgatgacaaatgaatttagtattttcaacaaaaataaaagcaagttgagcttgcatagttgatccaaggctttaaaaaaaagaggctgcttcagcctgcaggatgttgttgacatagtattacatctaagtacgcagggagccccgagccagggttgctggagtgtccctattgcaagggaagttttggcaaacacaatctagggattgaaaaggtaactccttcattagatctgcctggaatttacacatctgcaaatgtgagaggacaaaaaggacttttgatccaagagagatcggccccatctccctgtgctgggaaaaaactttgattttcttctttgatgtgaaacattgccattgctagctatatatttgatcatagtcactggacaacttattcagctctagttctttattaggtcctcatggctgctttcttagacatcggaatccttaaaaaagagaattttattttattttttaacctttcccagcttataaatgccccagggacctggaaatgtccacgtgggctttaccaatgatgtatgtcgttctgtttgagtcaaaataatgagtggttgcatagacgatgattgatattgtgtatttccgagtcgcctcattttggggaaggaatatgctgatcgtgcgtcaatttccctcaggttggctctccagcagggggcccaagaaggtctgcacccttttcatgtttctttgctgcttcctttcatcttgccaagttacatttagcaggatattcatctaattccttttttaaaattttaatgctccccatttttttggggggtgggggacaaaaagagccttttaggaaataagcatcaggaactaactaatcaaagtgaaactttctgggagacatctgacagccgcatgcctctaatgaccttcaaaaagatcacgtgctccaggcaattacaggatttgggagaaaatagctcattctgaatagccgaacctgctgcaatgttcatcactttgcagccgtgcccctacctccccgcttttgtagcttccttaccccgaagcctcctgaaagagagttcacttggattaaaactcctccagctttaacaaactgcaaaggggacagctgatgctaaaaaaggggatcttgtgcacagtgccaggtttctcctgtagccagagtttttttggctctggctacagaaggtgcctaatacattctgactcatggccaaatattatcaggggactttgttggtcaagctcttgaatatgggtgcagctggaaaaataacctatttgtcaataggttaccagtttcacagctggtagtgcccagaagggcgctgaataaacttcagtgggatccctgctgcttggtgcttgaagttcatctgacgtgaagcctttgtgaaaagagtattcaggaacccagtagcaatcttttcctttattttaattagaccatgcttctctcttgtttgcagggttttttgagattttatgcaaacttttaatgtttttgcctgtcagtgtttccattatttgaaatctttcatattaagtaaaattagccacggccagtgctatattaaagtatcaaaacttttagcatttgctcaccctcctttcctggggagaacaggtttctctacacgattgcctgtatgctttgctatgagtcatagtttagagaaaacccccacgttcctgtgcaatgaaagaagcagcataatgatctcaactcaggcagaatggcctggaaagtcacgatatgtggctgcacccagtcggtacctttgctttgcttgtgttggaggtctcttgcattagtgttgtgaaaatagatgatgagctcgtgcctctgtgactttgtttcttgagacctgcctgatttccatggtcacaagaacacagagaaagatgtgtgggctcccgggggctctgcctgacactgttgagagcgattccagaggagaaggtatctgtggggtaatctttggatgttattctgaaaagccccaacatcttcctcataacagcttctaagcttgaggaccaagagttatcctctaaaaaggtgtccccaaacaaggtaggtgactttcccccagtatttccaggggtgtgagccaagacatggggcaaaatgattaggggacctcctgggtcttggaagtggtttaatccttcctgtagctcaatgtagctgtctgtggttgatgtcactcggagtcggggtaggagtgtgtgtgatacagtgtagcagagatgccaatctttgtggttgccccgcccttcttgctgtggattgctgctttgaccaagagtgttggaccgatgaaagtatatccagtcctcagtctgaaatttgacgtctgtggctgggtttgaaaggatgagcttgaatgtgggcttttgaattagaaatagaataggatttttcagttagcatcgtggatacaggggctgaaaagatgccacaatgagctgaagttaggaaggaacaggggacagctgtgggaggaggacagtgtggggatgactggaggggagtggaaataggggaccatggggcaggggagtggggagagaatatgaaggcttctggtagcaatctgcatgtgtccttacaataaacagtttctcttgaactaactggagtgggtctctttccttgaccatgcggaagacctaatataagaaaggaaacaaagagattgcaggtgtcttccagagagaagatctgttttcctgtgtgttttaatgtggagtctctttctggtctgcttacccactccttgccccctgcatccaccccccttgtatatttttcccttaatgaaaagaaaatagagatcattttaatacagaggtaaaattctagggcctccccagaaaactgtttcatgaatgaggaagctaagaaaaagggccactggctttaaagcccagtaggttaaataggagaatggagaaagttataaaatgattaattggtcaagttgggatgggaaccttaggttataatatcaagctttaaccttggcactatggacattttgagcaggagaattctttgctgtgggaggggctgttctgtgcattgtaagatatatagcaacatccctggactctacccactaaatgcaggtagcagtccatagttgtgacaacaaatgtctccagccatagacaaacatttcctggtggtaaaaatctcccccagttgaatgtaaatttgttcagccattgtggaaagcagtgtgatgattcctaaaagaacttaaaacagaattaccaatcaacccagcaatctcattatggagtatatccccaaaggaatataaataattatataaagatatatgcatacatatgtattctgcagccctattcacaatagcaaatacatggaatccacctaaacgcccatcagtggtagactggataaagaaaatctggtacatatacagcatggagtactacacagccataaaaagaatgaactcatgtacttcacagcaacatggatggagccagaggccagtatccttagcaaactaacgcaggaacagaaaaccaaatactacatgttcttacttataagtgggagctaaacagtgcgaacacagggacatagggaggggaacaacagacaaatagttctaatcgagggcggagggtgggaggagggagaggataaaaaactacctgtcaggtactatgtgcatattacctgtgtgacaaaataatctgtaccaaatgtgggtaccaaatccctgtgacacacagtttacctatataacctgcacatgtacccctgaacctaaaatgaaagttaaaaaataatctttccctgttgagaaccatggggctagacaaaaagccgccttccttcctttcttgaatgaagcttttgtttgtttgaatctgctgtttatgaagggctgtggaggctacagagatgactaaggcacagtctcttacctgtatgaattaacagatttctggaaaatattaagctgatatttatttatcaatttattcatcaaataaagctggaaaataccttcctcttggctttgagtaacagcaaagatatccacctgtgtcaaatgggtaacgctcattctaagtgtaatgaggatctaacctgaggttcccacccaacttgattactttataactttctccatcttcctcctcctactgaactctgctgggttttaaagccaatgggctttttttcccttagcttcgtaattcaaaggataatggtagatgctataacaaataagccctcaaatatcagtggtataacatagtagaagtttgcttcctgctgatgtaatggtgttcctggttggtgaacagctttcctatggccatgcagtgattcagggacctagatttctgccatattgtggctcttccagtcccctaaatctcactgtcttttctttccaatcagcagaaaaataagtgaggagaaaacacgcccctttcttaagagtcctggcctgaatgtgactttgtttatgctgatcttccattagaaaggacaattggactactgatgatttccgatcaagtagaataaatcaatattgaatggctcatcttggctaaaattctgtgacagtctctggttatgaaaatttaccatcaggatcctgttcacataggacactttattcagcagtggggagagtttagcagaattctctttctgcacagtttaagatggagctgggaaaagaacccaagtttttagatacagcagtctgtctgctacttgaatcttttcttctccgccataccaggactggaagacatagattgtgcccaatttctatatcctaattacctaccagaggattgggcatgtaaaatattttcagaggggatgaatggatgagaaatattgttcacaggcttagaggtatacactcaaggaagattttacttgttaacctgaaaattgcaaaacaggtgcttgtagagctgtacccacagcagtacattgatgtcgcaagtatcggggcgggaaaaactacaattgctgcgtggggtggggtgggggtgaccatagttccctttattagccagagatataagtgacaggagtctaaatgagaacctgaagccaaacaggaacatttatttgatcaggtaactaaaaagttcagggtatctggcttccagcacggctgaatacagatatataacaatgtcttcgagaacgtcttcctgtacctgggctccgctttcctctgtcagactcagtctttggcagattctccttaagtgatggcaaagataacaccagccacaacagatgttcatccttcaacttggccacctcagaaggaagaggggctccagagaatgccccaagattatcattggctggtccagtgccatgtgctcatctctgcacccatcaccagggtctccctctcattgttcagaccaagtcacttgtgcaccattagcacaaggggtgcccagtccacagggataaaggggcaagcagggacaattcttcagtaaaaaactagaatggatgcttgatgaggaaagatattctatgtccactatatttctattgtcattatggaatgaacctgtgtattttttatcttaacactcatttccattcttctggtaattgtatgtaatcaatctctgttaagccctctccccagctgtagcccctgagctttttgtagagattcctcctggtgcagagatggagcatatggttcagtgctggaacaatgtggtcattatatgctcctggtccctgtgaacagttcggggatggttatctggtccaggaagacccagtgaggtgaaatgagactttacctcaaacttgagtaaaagagattcttttttcaaaattaactttttattatgatgattttccaaaatgcatgaaaatagaggtaactctaatcataagcagagataactctcctatactcaccatccagcttcagcatttatcaactcatggacaatcttaattcattttattgccacccacagtagattattttggagcaaattcccaacatcctatcatttcatctctatacttttcaatatgcgtctctaaagataagagctcctgggggaaaagacttggtattttctattaaaagtgaacctgaaaagatgtagggaataaaatcactgctaccatcttgcttccacttggagccaacaattggagccaacaactagagccaactgtgtggcagcagaacagcaagaaggaggaacacgaaatccagatgacagattttgggtcctgaattcacctgtgcatggagtaagcttagctactttttttttttttttcagtcacttgagctagaatattccctgtagctatgttgttgatgccccactcatatcctcttggcccaccctgagggtcacctgaagcttagatggacagttcccaacacagtgatggcttctcacctcaagcacaggcatctctctgcctaagaatgttctctggccatacgattgtgtttggctcctgcatatggcagacctgaagtggcaggggataaataaatgccccccagaactgtctttaatgatgagggatagaagttggcataccctggcttctttgctgctcagggagacagtaatgaggtgtgtcctacactgttattggagggcccttgtggggttaaatccctgttatccccagaagtaaccttcccatgaatttccctgctgctggcttcttttcctttcctgtcttatttttctacttcctcaccacacttcctgtgatcaccttccaactaaaccatgtccccccagtttcttgctttagcatctgctctaaagtaaaacttaactgaagtaattcccctttgcttcattttgcttaagcttccatggttctatttcctttttaaaaatttctatttaattttaagttctgggatacatgtacagaacataggtttgttacctaggtagacatttgccataatggattgctgcacctctcaacctatcacctaggtattaagccccatatgcattagctatttatcctgatgctctcccttccccaccaccaacagactctggtgtgtgttcccctccctgtgtccatgtgttctcattgttcagctctcacttatgagtgagaacatgtggtttttggttttctgttcctgtgttggtttgttgaggatgatggcttccagcttcatccatgtccctgcaaaggacgtgatctcattcctttttatggctggatagtattccataatatgtatgtaccacattttctttatccagtctatcattgatgggcatttgggttaattccatgtctttgctattgtggatagtgctaaaataaacatacgtgtgcatgtatctttatgacggaatggtttatattcctttaagtatataccctgtaacgggattgctgggtcaaatggtatttctggttctagatcttagaagaatcactacactgtcttccacaatggttgaactaatttacattcccaccaaaagtgttcatggttctatttctggtcattcttaaaacaaaaaaaaagtcctgagtaattatgctccatatttccatccccagtatttgcttgagaaatgaaataatgaaggcttctgagaaacagtgtccccacgcccccataccccattcacacaaaatgttttcagcttgagaatacagttgcggaagccaagttgggtctcaggaatatctggtttgcactaaatttcacctgcagaattataaaattcaggtgctgttgccttgggcacaactgctgggctctgataagtagagtgggtgtcccagcagcctgtcctgttggttcagataatgatttatgggggggcgcaggccccagggtgtgcacatggatggatgctctgcttatcctcctccagataggtttctggcatctaagacaagagaggagtggggtcaacaaggagagcttctgtctcttcctgtttaagcatctctcctactacctacaaatgaaaacatacaaatactatgttgatggtatagcaagtaactttaaagaaggcccccagaaatacttcactaattggagaccagttctccagcattttgaaaccataaggaaattacaaagtaagctgaaaaaaaaaaacttagatcatgcaaaagagtggtcaacaaagtccatgtattctacacaaaggagagccgtcttaagactgtctctccaggctagtttacttttactttatacacaattgcaacagagcattgaaagcagcacattttaagcagggaaggaacatgcacagcaagggctgcaaactcaaaaaattaaatgaaccagagaataattttaaacaagtgaaagaggccagttgatggattaatgccatgtggggacgtgggtccagtgttgacagttcttccatgttttcaggaagaaactgaaaattggaattttaagtgaaataaccttagttttacatagaaaatatctaaacaaaaaatttttaaaacagcatgcagacctggcacatcgggggcgtgactttgccccattaaatgaagcataaattctctattttgccagtgttcctatttggctcatataggacactttaatttgtgattctttggttattagatcactagctttttaagcacaggctttgggctctgtttgccttcttgggaaatactgtcagaaatcagtgggttcataaccttttgaagaagtcactcttattttggttgagtgggcagtgttcttagctacccaaaacaaactagctattcacttcctgggatcgctgggaccggtgcctgcgggtttctggggacacagaagatacatcttcctcctccctctcctgtgtttacacaatctgctttgaaaggttatgattcttctgtgggcgactggcctacagcatctgcctgctttgcttgatttggttcatttcacccaggctggcatcttcgagtctggggtccttttggctttacccgcacataatctcttgggtggatcaaaacctcttcaactctctcttgagtttccaagcaggctcccctgtggggcttttctaagagtgtttagcattggcattgctgcagagcacagtctcactgtgtggttttatgaaggatttgttttttaaaatttattttctatttttgtgtctttagaggcagggtcttgctctgttgcccaggctggagtgcagtggcatgatcatagctcactgcagcgttgaactcaggctcaggcaatttttcttgcctcagcctccagagtagctggcactacaggcacacaccaccatgcatggctaattaaatctttttttttcttttttttttaagaacgagggtctttgttatccaggttggtcttgaactctgccctagccttctgagtagctgggattacatgtgtgagccaccatgcccaactaaggttaaaaatcttaagatgcccttcaagactctactcctcaaggtcatgaaatagtcttttaaatttgttaaaaataatgctgagtgtattttattttcaactcaataacgctgtcacacatattaaacaataatggcattttcccatttatttccttctgcatatatatgtgtgcattgatgtgcatgtgtatgtatgtatctgtatttatacaagtacataagatataaatatatccatacctatttgtaattgcacacaatttatacatgcagtagtgtataagctgcatgtttcacttactatcaaaatctctgtaagcataatttttatttattctgattatttaatacacagtgatgtaactgtgatcccaaaatgtgcaaagttaaagccttcaactgcagctgaggagagggcaggaatggtatatggggacggtggtgagtcacgaatgatgggcaggcggccatgagcagggcagcctcctccccggggccagggacaggggaatggcctaaggagccaggacccaagggtagcccaggaccggggaagggggcagagacctccccttggcctaggtcaggagctcagaagtgccacatggctgagggggcagcggcccgggaagagccagaggcagagccaggaaagcaccatttcctgggggggctgggggcagggaggtaccctacaggagaagccaggtggggcctcctgtccctggggtgggggccatgctggagcatgctgcagcaagaaagacctgaggcaggcgcagggcctgagagcctggctggctgggctggggggcgcccccaggcagcctggcccagggagcaggcccgactctgtaggggatgctcagcgaggggctgcagagccctcaggacctctcctcctctctccctggaaaggagctggggaacccgtagtgcaaatctgtggaccactcagttatggagagaggttgtgcccgaaggtggacactggggtatgctccctccaccacctcatcctccactgctatcctcagtacagctgcttctggtaagcgtgcaggccatggacgccaccctcgatctgggctgacatggtccacttctcaaatttgagctctcctgagtacatcatggagccatgctggttactcgctatgaggtagggcacaaacttctgaatggaccctttgtcctggatggaggccgagacaccctgcacaatattcaccttttccccctcgctgaagtatcgtttctggctgctgctgctcttctccatggcatctagcgagcccatgccccagtacttcttgagctgcaccctgtctgagaagaagtactcgccgctgggcctccgtggtggtggccagcagggagcccatcatcactgtggaggctccaagggccagggccttgaccacgtgccccacggtctggatgccacatcggctatgatggacacaccaaagtgctgagcgtacttggccaccttgtacacagcagtgccctggggctgaccgcaggccatcacttcctgggtgatgcagatagagctgcagcccataactacatgcagtccatccacaccagtgtcaatcaggttcttagcctgggctgctgtcaccacattcctcccaatcacctggaggtggaggtacttctgtttgatgtaatgcaccatggtgatttgatacaccgagttcccttgggaggagtccaagactatgacgttgatgcctacccaggtgagcaggtccaggcagtatttgtcatcctcatgggtgcccacagctgccctgcacagcagctgcttgtgggaatccttggaggccagaatgtagtctcgattcttcttcaggttggtgtgggagacgatggccactagctcatggcgatcattgaccataggcagcttcccttgctaggctgaaggatctcatttgcctgtttcaatgtcatgcctgctggagccaccatcagcttgatccttggcgtcatcacctcactgaggagggtggtgtggtccttctcagcaagaaagttgatgtctcgggaggagatgatgcccaccaacttgctccccatggtgcccatctcagtgatgaggatgcaagagaagccatgccggatcttggcctccagcacatcacccacagtgtgtgaggggctcagcaccacggggtccgtgatgaagccctgttcaaacttcttgaccttatgcacctcgttggcctggaactctggggtgcagttgtggtgaatgaaaccaatacctcccatcagagccatcgcgatggccatgtcggcctctgtctcagtgtccataggggaagagatcagtggtgtcttcagcatgatcttccgggtcagggctgaagttaggtctacctcatcagctatgaaatctatgaaccatgggagaatcaggaagttgttgtgggtgcggcagttggcgccgaggaagagctgctgcacggtgagccagtcctggggcacgtagccggtgccgccactgatcagatggtccgccatgctgccgcaaggccccgcgaagcgacaaacacccgcgcggccgcctgccgctgctgccgctgctgctgacgctgtgggcctgggaactgtaagcataatttttaatgcccatagtggtggttatttaaccacttagtgttgggtgccttggtcattttcatggaaacttttgctaatataaatgccactgataaacatctctgtgcataaacctttatatttactgttattttctcagtatagattccttttagaaatggaattgaacaaatcccttgaaagcctccaaactgtctcatttcaatcagttcttttaagagctgaagtaagagtattcttagctccacttaattggtcgagctgatatactagctttttcttgatttttgtctgaagtaattaggttaagaaaagttagtttaacacatacatccctgaatagcagaaactgaatccaccacagatgtacttcttactcgtctgaagtcaaatgtggatgtttgtattcagagggcggccctctgacaagtgacgattcaggggctcagctcctttcatcttttggttctgccaccttcaacatatggcttctaaggccactgacatcatctgtgttgagctgtgaaaggagtggagcctgggaagttttttatggactaaatattcccaggaggaaaacggagtaggatttatgatcacttatccagaacctgctacaagatttctccttatctcatacttgcagtctgtcagcaaatcctgttggttttatctttgaaatatcccttgacttacccacttttctcccttgcccatgcaccccccagtcctggctggcgccatcactcccctggatcactccaatagcttcctcattggtatctctcttccactttgcccccttgccacttgcttctccatattctgttaagaaatctttattaaaacaaacagttccacgacattccccaggtaaaaaccatgtaatagcgtccattagaatttattaaaaaatccaaactatttaccttgatgaggtcctgtgtgatctagccttgtctattctccagtctcatccattaccacgttcccctaactcgttaaatgctattccaaatggtttccattcaacttttcaaatttgccaagctctttcttaccctgtagcctctgcgtgtgccactccctttgcccagaactttcttgttgttcttcacttgacaggttatttctgtttttatttaaaattctttttatttaataacaatgagaacacatggacacaggaaggggaacatcacactctggggactgttgtggggtggggggatgggggagggatagcattaggagatatagctaatgctagatgacgagttaatggatgcagcacaccagcatggcacatgtatacatatgtaactaacctgcacattgtgcacatgtaccctaaaacttaaagtataataataataaaattaaaaaaaaatttattttttttgtgggtacatagtaggtgtatatatttatggggtacatgagatgttttaatacaggcatgcaatgtgaaataatcacatcatggaaaatgaggtctccatccccttgagcatttatcctttgtgttacaaacgatccaattatatattttttgttatttaaaaatgttcaattattgactatagtcaccctgttgtgctatttattaaatggtaggtcttattcattcttcctattttttttttttttgtaatctgattatttcttgttctttggatttcagcctaccttcatggtgtgaacgtacttggttataatgcattgccttttgttacatttttctatttgatctgctcatattttgtggggcacttttgcatgtatgtttgcgaggaaggttggtctagagtttccttataatggcttcctctggttttggaatcagggtaatactatcctcataacatgaattgggaagtattgccttctgaacactagtttctgaaataatttgtgtaggactcttttttttttttccttaaatgttttatagagtgcagcagagaagacatctgggcctgaagtttactttgtgggagggttttaaactatgggttcaatttctttaattgatacagggttggtgaaggtttctatttctttttgaaaaagctttggtaatttgtatctttccaggaatttgtccatttcatctaggttgtcaaatttataggcataagggttttttaatccttttaatatctgaaagtctgtagtaatgcaccagactttatttctgatagtctcttttcttcttgatcagtctacctaggtttatcaattttgtttttttttttttttttaaagagaatcagctttgggtttcattagttttctctgttatttcttaattagcttctcagcctaaatgttttctcagaaaggatgtttcctgaccattctacctaaggtggcttcacctttctcttgccttctcctctgattatttgttttctacctcaggtctatgtgtaattattttatgtgttatgtgctttttttgcttctatgttacttgcagatattgcagaatagtaataagtctgcctaacatggtaatgtgcttggtgaatttccaagaacatatatggtggtttccaagtatgctagcacagcagtatctatagtggttaagagactagggtctagagttggctcatctcagctttaaccccggctacatcgtacactaagtgtgtgaccctgaacacgtgtaaccgtgaacacaaattctgattccttctgagatgagggttgtgcaacatggcagctgtgatcaggaggcctggggtttgagttctggctctgttacctgtcagctgtgtgattcttgaggcaattacttctctgagacccaatgatatggtttggctgtgtccccactcaaatctcatcttgaattttaactcccacaattcccacatgttgtgggagggacccagtgggaggtaactgaatcatgggggtggatctttcttatgctgttctcacaatagtgaataaggtctcatgagatccaatggtttcaaaaagaggaattctcctgcacaagctctctgtctttgcctgctgccatccatgtaagacttgacttgcaccttcttgctttccaccatgattgtgaggccttcccagccatgtggaactgtaagtccattaaacctctttttcttcccagtttcagttatgtctttatcagcagcatgaaaatggactaatacactcaattttctcttctttaaaatgatttgatgcaaggagtacctaatcttgggattattgggaggaactggatgagacatacatgagtaggatctagcccagggttggccttttgcatatgaggcattccctcaaactgtactttcccagaacttcagctctccccaccagagggtaagcatcactgtagcaggcactttgcacgttttgtgcacctctgtaccctcactgccttgatcagtgtggtcagacaggcactgaaaaatgcctgtgaaatggattcttctttttgttgcttatgaaatctgcaactgtgagttgagtgtcctgaagctcagcagggcaacgatggcttcaacaatctggcccttgcttgtctcaggtgagctgctcctttccctttcaggaatcttctaaactgctgggattcccagggggaggacgggacctttagggatcttgcaaaccccagcagaatatcagttttcttcacagaagcgtgtctaacttccttcagccctggtctgcaaattccagacatgaaactgtgctatttgctagcttggcctggcaggtatttattcaaaggctgcaggactccatgatagagagtagcaacagagccagcaggatcctgtaagtactcctcatgcaactacctgcagtggatttaaagtcagctcagggcagtttcaacaccagagttggaggaaagaggttgtgtgtacattgtcctctggggactgctgctgtttatgccttgtggtttcctttgggggagacagatccaccctgctttcctcatccatcttcctacatggatatatcttgttatctagtgctgaaatggcatggacacaggggctgggactagtgctgagatcttccgcttagctcttccaaatacagaaagaacttccctgtgtatggttaggattgaagtacatgtgcttggttcaacattccttcaatcagcaggaaatccagtcatcatcctagccctccatttcattctttgtcttgcttcatgatgtcccttaggggtaaagatttctgaattcaaagccagctgagctgggttcaaatctccacatgtccatttatgagatgaacatcatgtcttctgtctgattcatttgtcttagtttcttcctctgaaaatggaggtaatggcaatgtctattctggcatgttctcgggaggctgaaataacacccaggcttgctgcttattgcacagcccagcttccctgccttccttctctcccttcatgaatccctccatgtcctgctctacctgttgcctttctgttcataagagtattttgaattcctgccttattctccttttttctctagaagtgaaggagccaacttccccaaagtccgtggaatgccattttactttgttaggaaaaaaatcactttttcttatgtgcattctcatctatccattcaacagacgtcatcggagtgccttctgggggtcaggccacttccaggtaccagggattcagagacaaactagtcacgctccctatcttcaagggacttagaatcatccccagagaaggatgctgtgaacaacctcacgtgtgatggtgtggccactttggttgtactagagtggtgggatttgggagttttttcttatttttatttatttattgtaaatttttttaaattaaaacaattttaaatagagacagggtctcaatatattgcccaggttggtctcgaattcctggtctcaagcagtcctccctctcagtctcccaaagtgctaggattacagatgtgagccactgtgccagaccactttttcttatgtgtaaattaaaaaagaatttgaacaggaatgaaagataaaaagaaaaaaaaaaacacttccccaaacaaaaaaaaaaaactctttcacttataagaatggtcatcatcttggctatttcagatggggaagtacgcatgcctcattttatccaagtttctcacagttctataagtcttttttcacacacagttccatacacaaaaggtggctttgcaaaaaacttcttttaacatagctggcaggctatactgtacatatatctatacacatgtatgcatgtatgtgcatatacatatacctttgcatatatatgtttatgcatacattttattttgctttatttagaattattatttttggagatagagtcttgccttgtcaccgaggctggcgtgcagtggcacgatcttagctgtctgcaacccccacctcctgggttcaagccattctcctgcctcagcctcccaagtagctgggattacgtgtgcgcaccaccatgcccagctaatttttgtatttttagcagagatggggtttcaccgtgttggccaggctgatctcaaactcctaacctcaggagatctgcccacctcaactcagcctccttaagcgctggaattacaagcatgaaccaccatgcccagccttatttagaatttcatagggaattcttatgttattaaaactaagggttataagggcttccaaatcgctgtcatatggctggtctcaaatgcatttaaacaccccctcccccattgattttttttttttacatggttttcttatgtttgaaaatttgtagtttctctattaaacattgggtcagctgattctactgcccaggagacccaggcaacacctcaaaagtccacaactctcttggccagatgtgactgttctatttcccagctcatttttctgtgtctgcagaaagacacagtgcaaactgttaaatttggaggtttttggcagcttcattaaagggcaaggattttcctctttgggggtgggcttcatgttttaatggtcgtggtcagcattgctgggtgaggatccttaggctttttgtcaggggttcagggccttctggcttccccaggcttctccaggcttctccaggcttccatctctagagaagactcgggatgaactctgaattcttctagaccccagctaccagttcggctccagacccagagtggcactgctttaatctcggcaaagaagactaaagacttttttgtgtaacgaattaaaagtttgcttcaggcttcttttattttatgcctctgctgcactctcgtaacatttagcacctccccctgttgtcatatcatttatcatatcgtggagtttcaggtgtcttattttggttttcctgtcaatcttcctcctacactctgcgctcacaagggacatggaaacctgtcctgtttctcctcataccctgccgtcgactgcggcccctgcacacagtggggtctacgatgttcatgggagccaagggattgttgtactgattttttaaggctggatatttatttttcggtatgctttgcactttttgcctagggaatcaggactcagtacagaaacttgtctctgtcatgtgcgcaccctggagaatccaatcattggaaaaaataaaaatacacatagagaacaccattccttcccataaccacgtaaaattgtgctcgtgcaagctttccatatgcaagagtgcttttgatctaatcagatggaaagccagaagcagaggggaatgaatgtaacttacatactgattattaagtcattcattctagtagtatttattggactcctatgatattccttcttcaaactggtcctcctccagggcatggcaccaccatcctcccagatgcccaggctcaacttcttgctgccaccatttccctcacacccctcaccctgtgactacaccttctacatagtgttcatatccatccacttttctcttttctctgctggccagaatcctctaatcttttaccttgaaaggttcaataacagatgaatgaacagatgacagaatgaatacgtcgaatagtttcttcaaactggtttgtgttaagagaaatagcatttatatttttatttagtcctagagaaaaaataacaaccctttgcctctgcctactctcgttttcacagtcccttcacaaatattgtatcttcggttatgctcatgtgtgagttctgtattttaagaaggacattgataaactgagcttgttaaaaggaacatgactaagggaggtacaggctgctggaagtggttcctgaataacatcaacaaaaggataaatgtttgcatttctgagagtggagagaaatgaggaagtgagaggggtgagtagattgctatacccaattatttgaagggctttcatcttgaacatagagcagatacattccatggtgctctagaatctaagggaagaagtagagcccatagagacaaaatctacctccaaaaagtatgtggaagagctatgagctggctaattaagtctagagttctgtcactggaggtagtcagcagagtaaacatgtcaggggcagggattccggcatacatatggactctcttgttttgtagattttctgaggttattaggacttctggcgatattcttatctatagataggtattgcttcagctgcctaaacccatatctccctgtacccccaaaacactcaagagccatagccataaaacttcaagaagatgaaatattttgggggttagtaatacccttgatggttagagttatatgtggctgagattcttcttgtatctattctggtctcatttaagatggctgaaatgattgatcactgcccttcagagactcatatattttctgctctgcaaaatgtctgcaaattgcatcccagcttgtgcaaggagagccactcccccatccccaagtgtgttgtttctttcagtgatggtgattcagaggctgtgatacatcggcttagctgttttgggtttcagctttctcatgactagatgtatgtctttggacaagtttacattttcccatatttactttctttgtccttaaaaaaaaagttgctgttgctgctgatagtatctattcctcatagttgcgagtgggtctcctattagagaaaataaaaggaattgctatattagtatctttccagctagtctttgagcttcttgatgtcaaggatcattcattcttttcgtcccagtgcctaccataggggatggcacagagcagacaatagatgcttgttaaatgatgcagcaaccgaggcatccactccatgtctgtgagtgggatacgtctctcagagcaagagtgccccagtgcaagagtgatctagaacagtggaggaagggaggataaatgtagtctttgattttggagagacctaagtttgaatcctagctctacctcttgctagctctgtggtcttagacaagttacctaacctctctgagcccatgttagtccattcttgtgttgctataaagaaacacccaaggcagcctggcatggtggtgcgtgcctgtaatcccagctacttgggaggctgaggcacaagaattgcttgaacctaggaggcgaaggttgcagtgagcagagatcacaacactgcactacagcctgggcaatagagtgagactctgtcccccccaataaaaaagaaaagaaaaaaaagaaaaaaagaagaaagaaatacccaacattaggtaatttgtaaagaagagaggtttaattggctcacggttctgcaggctatacaggaagcatggtgctggcttcagcttggcttctggtgaggcctcaggaggcttccaatcatggtggaaggtgaaaggggggtagcatatcgcatggtgaaagacagagcaagagagaaaggggatcagtgccacactcttttaaacaaccaaatctcatgtgaactaagagcgagagctcactcattaccagggttatggtgctaggctgttcatgagggatctgcccccatgatctaatggcctcccgccaggccctacctccaacactggaggtgacatttcaacatgagtttggagggaacaaacacccaaaccatatcagaacctctgtgtccttattgaaatagttggtgaaaatagcaccaatgtctaggagttcgtgtgatgattagatgagctgattctgtaaaaaatacccctctcaatctacaaacatactcattgctccataaatactgctattactattatctctaggattaccaccatgttttcagcttttcctgtcacccttgcctacacaaaagtggctcgatgttctagaaattgagactaaactaaactttgaatagattttcccaaacctgccaaaatatcccccaaattatagcaataaccattccctcctagagtggggctatctctccagcggaagatctgaaggttgtgtgagggatgctttttctcttgtctccctctactttcttgtagcctgagatatatagcaatttccaaggcagggattggtaaagtagactgacagcccaggttttccttgctgggagattaggctcttgtcccaagtttataattggtatcccaaataatggattgagaggtgttggccagaggggagaagaactggcaacatcaccacctaaatgaccccagggattctggccaaaagcagagagcaatctttctcgaagccccaacatctgctgttgctcagaaagcttcctggcagtttgagccaacttaatcagactgttctcttccacggcgctcggaggttttcatcctttgggacaagagatagctctgagttacttaacttacctggttcttgtatacgcttcatgttgtggcttttagtttctgttctctccaaggtgagccagttggatcttccaggaaacagatgctgagatggagttaggggcacaagaagtttattgagagggcataagtacctgggaaaaaataaaatagggaaggcaggaagtagaattgtgcaagggagagcttcagaccaccatgcagaccagacagtctctgccaacctaacagaaagctttggagaagaggttgcccatgaaaggagccccatgttgggcagaagttgccaggccccatgtccccctcatgccctgtcactggctgaggactgctctggcagaatgtgacctcagctcaaaagtggaagtgaatcctgagggctctgaagccagaggatgtcagtaacctgcacccccagtggctgaatgacacattcttttttgaaggcagatcggatccaagtgtctcctccatggaagtcacacctggagaatcacaccttgaaaaacattggccagcacgtctgtgatggattaactccagtggttagggagcctggctgagtgccaccatctgggccattcaaatcagttttctccacaaatatttacttacactttctgggcgctaatcatcctggtgggagaactgattgttataaagtgaatccagcaggggggcactatgccttcaaataacataaagctgcacagatggagtgaacagtgtggacagacaatcatttaaaaagatgtgaactgaaaagcatcttacaagagttacaaagatcatcactataacaacgactatcgtttattgaatcatcaggatgtgccaggtgctttctacatgccatctcatttcactgggaggtgagtgggcttattactcccagtttacagatgaggaaatggaggtgcagaaagaagtaacttgaccaacatcagtcgaaatacatctccccatttccatcaccagctctgtgatccaacactcaacatctcttgccaggactaccaaaggtcttcgaattactctcctttgcacaagcatctttgcttcttgctcaaaatctatcctctctactgaagccagtgggatctttcaaaatgcaaacccgatcatgttgtttctctgctgaaaacggtttcatggcttcccgttgctatggtgataggaataaaatttgtctctgtggccttccaagcacttcatggctgacctcggctacctctggagccccacctctcacctgctccttgcaaaagtaatattggccttcttgcagttgccctcatgtccccccttcacctgtctgacatgggccctttgcacctgctgttcattctgctgatacttcttgactagtaaattgttttcatgtacttaaatagcactcgctacaatttgtgatgttgctttacttttgtgattattgactaactcctgcctccctgagctccctcaatgaagctccgtaagaatggagaattatccatcttcactgttatatccccagcactcggcacctcaggaacttcacggaatgagcagacgtttcagtactggtgtttggaataacaaacattctgacttcaataccatgttgaaaaagcagagttccttctatttgggagtgaaggagggtcctgaaggtatcttctaggaagtagcatttgaatctagcctttgaagtgagttacctttattctgtttctgactccagtaaacaagccagcaaatcaaacccttagagatggcaagactaccttaacagagcaggtgcagatctcttctgacccgtcctactctcagaggacagcagctccagatagtatcatccttgtgaaaaaccaccaacttccacattttctttgagccaggggaacactagttagctgaggaagggggtgcaagggagggagacaggatggcattctctttccttctctcagttatttgcttctcccagtgctgaatctaggcactccagagacagggccctgaattctgagctctggtgatttgcatttaattactaagaatgttttatttttctcttgtaaaattgtaatgctgcttgcagcattaaaaggagtttcttctggaatgaaaacaccaagcttttgagtaagtatcttttatgctgaacatggggagtcatccaaaatagggagttgattttcataatggttttgcagttactcataatgatgccctttgtaagcctttaaggtcaaggaaaaaaatcataggtcagatgcacaaggtatggggaatgttagaaatttctttgctgtgatctaaattcctctagatgagtggtttttttgagcattttctaaattatttttaacaactatttggagaacacaaactgaaataacccaaatcaatactagttttatttatttatttttccttttctaaaatttccataggtttttttttggggggggaggggggacagtaggtatttggttacatgagtagttcagtgatgatttctgagattttggtgcacccatcacccgagcagtatacatttaatccaatttgtagtcttttattcctcaccaccctttcccctgaatttccagcgtccattgtgtcattcttatgcctttgcattctcatagcttagctctcacttacaagtgagaacatacaatgtttggttctccattcctgagttactttacttagaataatagtcttcagttccattcaggttggtgcagatgccattaattcattcctttttaaggctgagttttattccatcgtgtatatatacataccacaatttgtttagccacttgtcgattaatgggcatttgggctgattccatatttttgcatttgtgaattgtgctgctgtaaacatgtgtgtgcaaatgtctttttggtataatgacttcttttcctctgggtagatacccagtagtgggattgctgtgccaaatggtagttctccttttagttatttaagctatctccacactgttttccatagtggttgtactagtttacattcccaccagcagtgcagaagtgtttccttttcaccacatccatgccaatgtctatttttttaattttttgattatggccattcttgcaggaataaagtggtattgcattgtggtttgatttgcatttccctgatcattactgatgttgagcatttgttcatatgtttgttggccatttgtacgtcttcttttgagaactatctgttcatgcccttagcccacttttgtttgggcttgctaatttgtttgctaattgtttttttttcttgctaatttgtttgagttccttgtagattctagatattagtcctttggatgtatggttgtgaagattttctcacactctgtgggttgtgtatttagtctgctgactgttcttttggctgtgcagaagctctttagtttaattaagtaccgcctatttgtctttgtttttgttgcatttgctttgggttcttggtcatgaaatctttgcctaatccaatgtctagaagggattttcccgtgttaccttctagaatttttatggttttaggtcttagatttaagtccttgatccaccttgagttgatttttgcttaaggtgagagatgaggatccactttagttctcctacatgttagatgaagggtcttaagaaagaaagtgcaggagggtcggatgcagtttagggatctgcccacatttatcagccatccctgtccccaccactgcccacctctggctcactaggatctaggatatgccaatagctgcagatttggttaggatccctttccagtccctgggtttcaggaaggcttagggaccaggaggaagagcaaaagtgttctctgccagcccctctaatgaaactgctgatccaatctcactggagactccattcctttcctgttgcttcatagatgagatcatggtaggatgcagtctccaagacaccaaaatgatatatgtagggtgaagatttcacagggaagaagcccgggtcctcattctctgttttccaacttcaaacatctctacgattatttgtttagtgtgtgctttaaaccacttgcattttaatttaagcacatttatttttaaaaagcaacttggcatcacagccagaaatggaaaaccagtatcacttcccacaaatagaaagtaagttgcaaaaatatataccacgaagaccaaacagctcagagactgctgcctaaggctcagagcctgaggcctgatctcgctgttaaaaagggagattagcgagtgttgtagggtgtttgggactttttccctgatgttttcagaagagttgaaacagacttgaaagggagcaacttttgcaccatgtgacttgatgttatttaattcagtctccttgtaccacctaaaaattatcacagctaacacccgtgctatagcctcacacctgggaaagggatctggtctttttcagtaaattgttaattccacattggttcttagtctcctgggcaggctcagagaatgtggcttgagagtgatggagaggacaggttagtctcaaggagttagttgtggttgtagcaggtctatgtgtgggggactgaccagtaggggaagtacaaggagaatggggtatgtggcacaggtaaggaggagggcagggaaatgagaccaccagcaagaaagaactgatagttagaacagtggagtaaaatccacactttcactgttgtgtctggactttgccccttggaagacatttgggaaaggtgatgtggggctggaagtctatgctgaccggccaagagagtaaagtgtgtgtgtgtgtgtgtgtgtgtgtgtgtgtgtgttttaccacaatttaaaaaaaattgaaaaagaagaacactattagttacctgagaatcaatatagaccatggttctcacactttagtgaacatcagaaaccccgagatgcctgattaaagcacaggttgccggtacaccaccgaagtgtcagattcagtaggtctgggtgaggcccaagaatctgcatttgttacaagtctccgggtggttaggtgctgctgctggttgggaactgctgtaaaccatttactttggtacccacaggtccagagaatgtcagaatgtcactatcctctgagtcccgtaggggctgtcaacctaggaggcacattagaatcacccaaggagcctaaaaaacaaacatagaaacaaaaacatggatgcctgggccctaaacccccagtgaatctgattttattagtctggggtggggcttgggctcatatgttttttaaactgtatatgcatttagatatattttctttttttaactttttatttcaggggtacatgtgcaggtttgttacacaggtaaacttgtgtcatgagtagatatattttcaagcttacagaaaagttgaaagaatagtagaaagaactcctatattctctttattcagattcaccagttgcttacattttgccctatttctttcacactttttttttgtaggaatatcactgaagtgatattgtgtccttcttggtgcattgtatcaagagatgatgtccgttggtcttgatattggtgatattaattttgactccgtggttaaggtagtatctgcagtctctactgtaaagttgctatttcctctttgtaattaacaagtaacttgtagggagttctgatgctgggttctgatgcttcctgcttagaaacctgcactaggaagacgggatacactttcaatgtagctcctatattattaggcagatacattgagactatataaatatcctattccttatcatgtttttactcaccagctttagcatccattgatgttttctaactccatcattccttctctttactagtgttctgctataaggaagaacatttatttttacttttatactttatattagcatgggctcaagattcttaattttacagtgggttataatccattactgtcgttatttatatttatgcttaaattgtctcagattttatcggtcagcacctcaacctggctcttgtattcttttgacacattcttgtcttagtgagctcaggcttccatgacaaaatatcatagactgggtgtcttaaacaacaaaaatttatttttttcatggttctaaaagctggaagtccaagatcagggagctggcgtggttgggtttgagtaagggctctcttactggtttgcagacagctgtcttctctctgtgtgctcatatggccttttctcagtgcatgctggtggagagagagagagagagaaatctctcttcttcctctacttacaagttcaccagtcctatcaaactggggtcctactcttatgacctcatttaaccttagttacctcctaaaagccctatctccaaatatagtcaatggcaggttaaggcttcaatatatgaatttgtaggggacaaaattccatccctagaagtcctcattttttttttttttttttttttttggtgcacattcccttactttctggaacaataagatgctcttggttcattttatacttttcctgcttcaaccctggaatcagcaatcagtcatttctccaagggtctgggttcctcttttaaaaaatgctttctgggccaggcacagtggctcatgcctataatcccagcactttgggaggttgaggcgggcagatcactggaggtaaggagtttgagaccagcctggccaacgtggtgaaaccctgtctctactaaaaatacaaaaatcagccaggcattgtggtgggtgcctgtactcccagctactcaggaggctgaggcaggagaatcgcttgaacccaagaggtggaggttgcagtgagctgagattgtgccattgcaccccagcctgggcaataagagcgagattccatctcaaaaaaaaaaaactgttttcttggtgagaataatatgcagtcagaactgagaactagagttctaaaaaaatcccctcatgtatacccacattctatagatgaagaagctgttattaagagatagggaatgaccagctcaaagtcacacagcaggcgagtggcagaactgagcctgtaactctcacctttcctcagtccagcactttttaaaaattacagcctcctgagccctcaccattttgtttgcaagtgtcttgttgattcactccattacagatttaggacattataaccagggacccagtcattttccttattggtatctcctctgtacacgtggcttagtgctgagcagagagtaactgctccatgaaaccttggggcctcagattatttttctgacagccaggttctgatgcttcctgtttagaaacctggagtaggaggacaggagacatgggtttcactgtagctcctatattcactcactgggtgatgcatcagttctctttgggtttcattctcattgatacaaggagagaaaccacactacgtgggctctctggtgatgtcttgggcagagtttcccagacaatctcttccctacggtcttagacaccctgggcaaaagccaaaaccggcacactggcacgtctccctcacgtaattggccaaactaagtcacgtgatcaaactcaaagtcaagaggtgaggaactgtatcctggttcttaagtggcagggaccacagaatcacgtgacagtgacatgtttccagtaagagatgaagaattgggccagttgtgcaatcatgcaatctactgcaaaaggttttttgtttttttttttcactttgttgcccgggtattccctaaaacacccagagactgtagctcttaaatataaggctgattaaagctgatcgatgccacctgactataatactgtcacttgagtgaaggtgccaatgctacgcagcaaatgtaggagagatgctgtagattaactgtatgtttttagaagctatggaggcccagcccctcctacaagtcagggctgaacctagtggtctagtaagatggggaggcctgatgagaagcaggacacacacctgggatgtgcctatgatgattgagatcttctgacagaggctgctccttttggagctaggcaagataaaatgacacaatttcctttgggacctgcaggctgcaagagcaatggtacctaccccatctgttattatgacatacggaccctgcctgcagtgctgagcaactgtgactctgagccccacttgctcttctttcttctgggtttcagaaaggttggccgggcgtggggctcatgcctgtaatcagagcactttgggaggctgaggcgggtggatcacttgagccaggagtttgaggccagcctggccaacatggcgaaaccccacctctactaaaaatacaaaaagttagccaggcatggtggtgggtgcctgtaatcccagctacttgggaggctgaggcaggagaattgcttgaacccaggaggcagaggctgcagtgagccaagattgtggcattgcactccagcctgttaaaaaaaaaaaaaaaagcaacttttcatgctgccttttaccttatcttttatgtataccttgagatttaatgcctctgagtacatgagatggagggcttaagagaagggacttgagttaccgtttagtttgaatcccgtctctactagcttgctgtgtgatcttggacaagtcacttaacccatctgtgctctagtttacttatttgttaaaagggataaaatagaactgacctcatagagttgttatgagcattaaattagttaatatattttatatgtttgaaacagggcatgtcacatagtaaggagtctataagagttacttattataaaaggcaaaatcattgagagaaaaaaataatgcttaattttccttctattcttgagaagagagaaattcaaactcttgaagacaccctgatctctttccactgcaccctcagacctctggaggcaaaggaggtgatgctgtcccctgtattccgactgctaacgtgggaagacctcacacaacattgcatgtctgctgaaatgttaatttataattcagtgtagagactgattttccttggactgtaagaagactccttttctagaacagaaaagatgaaaagtatgtgcatgtaattatggtgtttatgccactctaaaaaaattattcctaaatattgtttgggtagaattatttagagaatgaggctagaaccattccaatcccaaagactcctcatttgactaaactcttctattctttgttgaaaggactagactggaggtatatcaaggcatgcagatgactaaactattgtgtgggctgttagaggattaattattttaatacctttattgatatataatttacttatcataaaatgcactcattgtaaatacataatccaatgatttttaaagtaaagttacagattttgcaaccatcaccccaaataaattttagaacattttcaccagccctaaaaaaattatctcaggcctgtcaatcattgctcctaaccccagccccaagcaagcactgatccactttctgtctctatagattttccttttctggaaatttaatgtaaatggaatcatacaatatatagtctcttgagtctggcttctttcacttagcataatgtctttgaggttaattcatgttgtcacatgtatcagtgttttctacatttctatttccaaataacattccattatctggatatataacattttgtttattttttatttttttgagatggggcctattccccaggctgtggctcactgcagcctctgcctccgaggctcaagcaatcctcccacctcagcctcacgagtagctgggactacaggtatacactaccacacccagctaattttgtgtgtttgtgtgtgtgtgtgtgtgtgtgtgtgtgtgtgtatacacacacatacatacgtatttggtagagatggggtttccatgttgcccaggttgatctcaaactcctggctcaagtgatcacctacctcagcctccaaagttatagatgtgatccactgcgcccagccaacattttgtttatttaccagctcatgggtatttgggttatttctacttcttgtctgttagggataatactcctgtgaatatctatatgccagtctgtgtggatgtatatcttaatttctcttgggttgatacctataagtggaattgctgggccatatagtaagtttacgttttaagtttttaaaaaattgccaaactgttttcacaggtagttgcaccatatcacattgccatcagcaatgtacaagggtttcagtttctgtgaatccttgccaacacttggtgttgtccatattttccattatagtcattctagtgtgtatatggaagtggaatctcattgtggttttaatgttcatttccataatgactaatgatgtttaactccttttcatttcttattggccatgtgtatttcatctttgatgaaataactattgagtatagagttttttagctcatcttatttttgagctgtttgttttattattgagttgtaggagttctttatatatttttgatacagttctttatcatatgtatgatttgcaaatgttttctcctagtctggcttgtctttttattcttaatggtgtctttggagtgcaaaagttttaaattttaatggagatgaatttgcctattttttcatttatgtctagtaaaagaataatgaatggttttgtgtctaagagctttccgcttaacccaaggacatgatggttttctctaatttttttttcaaggagccttatagttttagttgttatatttaggtctaagatctattttgagttaatttttgtgtggtttggagataaggatttaagttcactttttcacatattgatatcaaattttcccagcatcatgtgttgaaaagactatctttttcctatcaaattatcctgtcatgtttgtcaaaaatcaattgacagtgtcagagcttatttctaaacgttcagttttgttccagtgatttgtctctttcccttaataccacactctcttgatttctgtagctttgtaatatgtttgaaatgagggtaatgtaagtccttcaccattgtttttctatttcaaaattattttgcctgggtctattttttttttggctactggaaacccctccctcttgggtctgacagggttggagatagatatggtaaaatagagtataggggacagagaccagtagactgtgtcttggtcaccgttgtgtctttagcacctcatataatgcctggtaggtcctaaatactaaaaaagctgtaaaataaatggataaatgtatcttaagatttttttttatcacatggtatcatctatgtcttgggattagggaaaatttccatgtcaaactaaagagtaaaaattcaccaaggttttgatatgctctgatatgatcactactacttgagcctccccctcatcggttttatttcccacccatcatagctcctggaggaggatggaattaatttcaaggggatttgggaagtaattgtcttgttgttagttataaatttttgagagatgatggaaccttatcaagatagcttgctgttgaaatcttatagtttcccgtttagacctctgttattattatctgattatttgattattattatcaagggttttatatgtctaacagtgttagatattgagaggaccttcctacatgttgcctcttctgtctgaaacagagcccctcaaccctcccggaaagaagcacacataccccaaactctctcataattcttagacattctccagacctcaacctcatcattactccttagaaaaatcgttcctaaaccataacctgtatcaactgccctcctggaacccaccatatgcttctcgttggtaacacttatggtggttacatatttaacattcattgttgtgcttattttataaagctttgaggtatagttgacatacaaaaaattgcacatatttactgtaaacgtttcaatgaatctagacatatgcatacatctgtgataccatcaccaaaatcaaggagtactgaatatatctttaacctccagggtatgtgattaatgtatatttctcctcggggatcatcggcttcgtaggggcaggaactgtattagttttcactcaccgttttgtccctattgattactacagtagttgacaaagtacaactaacattttaccgagcacttactttgtgccaggcattatttaaatgctatggatatattaatatacttaataactacagtggcctcttgggttgttcttattgtcatcccattttttagataaaaaaactgaggcatgaggagagacattatgtaacttgctcaacgtcatacagacaatatgtaatggggcatagagaagggtgtcaataattatttgttaaacaaatgaatggatgaataagagaaagaaagggtgaatgaagctcttcccttgatcctagttggaagcatgtcctctacaagagtgctgacttatcttttcttgcgagatggatgggaatacaaggctatggggatgcccaggagactgttttggactccagtgctgctgactctggagagaggaaaaggtgggggttgggatagtctaggaaatgctggcttcgcacaacacagccgagtgggtgggagccaaaaatagccagtcctttgagtagaaactcctctagggaggaaacatttctttgaaattggacacacaaattagctaatgatatccagacactaaagaactgcatgttccccagacagcccgcggccccaggatcagacgctgatcttgtggagcacagattaagagatgccgcaggtctggggtgggtatagattgttgtgtctgccatcctcactcacagccctgagcacagaggtgaggacgcagccaggggccagcactctccttccatgtgtgccaatccctgcctccctgtatgtcctgggctgtttgtccaggatggaaagtggcactgtggcatttttacctgtttgtgctcagtgacagttgacatgacacagagtctatgttggcagtatttccaggccgaagcttaggaaatcgactttaggatgaatttttcaatctgggagactctaacagaggctctgagcctgggatgtgcaaactacctgcacttatcttcaaaattgtgtccaaatgtgcgtttctcaagggagagggtccaaaggtttcatgagtaaacaacaacaaaagctttcaacaaggtatgggatgtctccaaaagggtgagaatccatgatgatgatactgataatagcaataataaagtaacttttctgagtgcttagaatttgctaaggccaggcgtggtggctcacacctgtaatcctagcactttgggaggccgaggtgggcagattgcttgagcccaggagttcgagaccagcctgggcaacgtggtgaaaccctgtctcaaaaaaaaaaaaaaaaaaaaaattagctgggcatggtggtgcatgcctatagtcccagctacttggaaagctgaggtgggaggatcacttgagcccagatggaggctgcaatgagctgagatcatgctactgcactccagcctgggtcgcagagtaagaccctgttccccaaccctgcccaaaaataaataaaaaagaaaatgccagatatgcattaagtctcttatatagatgatataatttaactgttgtatcagtcagtttaagcaggttcatgctacagtaataagctactgagattttggagttgtttatgaaagttgatttcttgttccagttatatgaggttagttgcagctctgcttcatgtcttagatgcaagagtcagactgacggagggctcctttctaggtcattgctaatctcatggaagagggaaaagagaaggatgtagatgaagagatggatcttaaagattctcctggaagtggcactgtcactcccacttacattccgctggctcccagcccaacattggcgaggattccaattgtccagtagggaggagtcctgtagagaggagggacagcagatatttgaacaataacataatctattacattccttataaaaaccaatgcggtagatatagtagtgattattatcattgtccctttcttacagatgtggaaactgaggctcagagaggttaactttctccccagtgctgtgtatttattaagtgagaggttcaagatttgcatggacttggtcagactctcgagcctacagctttagccactgcattcatcgacttccattgttatagcaggagcttctcctccactccttgttcctcctccccaattcatggtaatccacacacaccagttttcttaaaacttcattcatgctcaagagaaaaccatgtccctatctggatcctgtgtttgcatagtccccagcctctgggctcattctggatcatccagctaggtaggcatttgtttggcaggattcctgcccactaagagcttaccatgagtgtcatggtgggaatgagctgggtatttttagagcttggcagcctagcactgccgcttgctcttccccgaggtctgtggattagcctaggggtagcatatgcctacgctttgcttgcctggtcctggtacatggtcctgtgtactgttaagaaaacagattgtcccaggtagatatgtagccagatatttttttctctgtttcctttttttttttttttttttttggagctgctccaccccctggtatggtgcagcttctcctggggctcctctgtaattttacagcagcttctgagctagtgaagaaggcgggatttgctcacttgcagttaagtctggccagacagctgttagttgttgccacaaacatcttatgtgtttgcaatcttgcctgtcctcctgggtaggcagaatgcacaatctctcctcaggggaagtgagaagatctagaaggcccaaggaataattatttttggcatcattgctcctccatactcattatccacatctgttgagcattcctgtggcccagaagctgatggcagtgtcactgtggcaccctagctttgatgtacttattgtcagaagctctggatagggaccaccaacaatgcactttgctgcataggtgctgtgagtctccatgggaaggaaagctggagatttgcataaaaaagtatttagaatgtccagaagcacaaactcaggtgtcatccaattcaacaaacactttctgagtgcctactgtgtgcaggacataggattttgcttcatgtagaggttataacattcaagaggacacccgtggagcacacaggcacatcccccaatatggccccaggcattacagaatgtgacagacgtgacattttttgtttgttaattaactaattcattctagtgttgtggttaagcgcataaactttggggccagactggttggtttgaatcctagaaataaaaataaaatcctaaaccaccccaactaattaaatggaaccccttcttggccagggggatcccagagaaaccttgaaaactgagttcctagccataaccagacaggagctcagacttaccacattatatcctctcccttgctaaccatcatttggctttctttcctaagggttaaacagaaacaggccatctcaaaagacttgttccatcactgtttccaaccaaccacctgactctgcccctcgctttatacaggtttgacacggccaaccaagcaacattccttcctgataagatttgcacacccagaactagcttctgtttgcatgaagtggttctggtcagtttacgggggctgcacactgagtgccttcatgtcctctaattcaccttttgacacatggggccaaattatagtatacttaaatgttatgttttcaccccaaaatgaacatggcatgtatatgacattcatattaatttactgtgcatttgcgtgcccttcttttgtgaatattcatagctcctcctataacttgagtatgtatacttagccattctgttagcataaattcctgtctcaccttgcctcctttgaagtgcctgcctctggtttctgctggatgctacactccccagcctgcgagatggtcagcttacaggctgcaaccccttataagaaataaagctctcctttctagatgcatgaacctcgtgtttcttcagttgacaaatccttactctgtaactcactggctatataactgaacaagtgaccaaaactctccctgccaagcttctttcttcccaatatgggaatgacaacagtacctagctcagggagttgttgcagggattatatgagttaatatacataaggcccttggaatggttcctggtgcataggaaattgtatcaaagtgttggctgctactaacactattatcatttatgcaatagatatttattgatctatgtgtcagtagactgttgtctactatgtatcaggcactgacctaggtcccagttgtggaacattaagctcactccatatccttttacccttacggagcttgcatttcagaggttggaggcagaaaataaataaataaataaataaataaagtgtcaggtggtgattaagacatgaatgaaaaatcatactagaaaagtcagatgagggagattaattcctaattgagcaaagatgatgaaaaacttccccagaggagatgacaccagctgagaagaggcatggtagtaagaggcaggcacccaacatgcaattccaaaatgagattttgctagagaatgggaatatccttcttgggggtcatattgttacatctttctttttcttgccgcctatgaacaggaattctaaataaggtcagagactggggttgtcttttggtcttagtggccttggtgttggaccccaggttccaggaagtcttttatcccagcagcagtttttcggagagaagactcacttacatgcaagactgacatgaaaaggggtttgctctgtatgaggctgtgagctcagccccatgcttaaagtgctgagtgggaaaaagggcagagactatgcctgttttgtattcaaggggctggcacaacatttggttcttagtaggtgctcagtaaagaatataaatagtcattgagtgtttactgtgtgctgaagacatgtcaccaggttctaagcctttgatatttgtcaacttatttaatttttacaactgaatgccttttgttgttgttgttagacagggtctcactctgttgtccaggctggagtgcagtggcatgatctcggctcactgctgccttgacctcctgggtccaggcgaccctccttcttcaacccccaagtagctgggattataggcatgtgccccatgcctggctcatatttgtatttttttgtagagacagggtttcaccatgttggccaggctgatcttaaactcctgagctttagtgatccacctgccttggcctcccaaagttctgggactacaggcatgagccaccacactcagccctgaatgcctatttttgtccctgttgaaaagatgaggaaactgagcacaggccatgctggggctatctaaggactcttcatagaaagaattcaagaagacttcttagagaaggtgactttataaagcatgtcttgaaagataaattcgtcaggtaggagagtaggggtggggggtgaggtgcagaaaagaacattgtaaagagaagcagctctatgagcgtgtttggtaagttcagtccaggatgcagacaggagtagcaggggaagagggtagagagaggtcagggtgaaagcacgtgggcctcataggccttactcagtgatttagatctttatcttgactgcatcaggtagctatacaagtaattcctgaaaaggaaatgtcctgagatcaaactggctttactcaaaggtcaccatttaaacccagccatgcacagtttagcacttcattaaatattgtgtcctaatggttgctcccttctcccaggggccacacacgtcttctcatgtacataagcactcgtggagtctgcggttggaagaaatcacgcaaggactggttgtgccttgcacacctgtcacagatttgcacacccagaactagctcctgtttgcattgtctctactgtagcttctgcaaatgacaaatgtgggggtttcttcttggatgaagtggtttgaggtttgaggtttgagacttggatgttttctttgaaaattttttatttttttatgtttttgcaaagagaaacttgttcctcttcctatgctcactgagtcctcttttccctaacttctagaggaagtgcatttaatcatgctgtgatcaagtcagccctgggtacccatgttggcttttaattttaaaaaagagaatgacaggaaaagaaaatgggccagttaggttttgaagatttttctattttattattattaaaggaagcccatgtgggagaatgtctggtgctagtttctcatctcggcactgacatcatcactatcttgactgctgtaggtattatttgttcttggcttgtgtatcagctatctattgctgtgtaacaaccgaccaccaacttagcaggtgacacccatttattatctcatgggaaatgaggaggccactcaaagaggcctccttcttcaaaaccagtgatggagagtggaggagggctctgctgcttccagtctctgagcacagggaaggtttaagccttcttttaaagggctcatctgatgaggccaggcccaccttgggtaatctcccttttgattaactcaaagtcagctgattagggaacttaatgatatcttcaaaatcttgtcacttttaccatatgatgtaacataatcacagaagcgatgtcctatcatattcacaggttcacctgtactcaaggggaggagatcacacaaggacatgggtcattggtggtcatcttagaattttgcctactgtggctggtaatccaaaccaaatattcttcctgtggattaagactatcactttgggaacatcttagaattctgcctgctgtgggtggtaatccaaatcaaatattcttcctgatctttgtgttaagactatcacttttggaacagccattttccaaagctctctcataattccatcgtaggcagagatggagtgtggccatacaatgttttggaggctccaaatctaggtaaagtggaaccactggagacagagtgccatcttgtttctggagtcaggcaaagacactgtgtccaggtgggatttgcttggagctgatttctctgttggataaaatagaccagtggcttcataaccctatgaaaaaataagggttctataagttgacacattttggaagtggagctaaacccaaggctgactccaggactacaactatttctacttggagcccttgagcttatttttccagtacataggtctcagctgatcaatctgaaaatggagagtagggacatagggccttggaggttcctacttattttaatcagttccatagcctgaccctggtccagtgagcatcagatttggagactgtgccatttatgaaacaggcaggtattggagagactccaaaaagctcgtctcatgtgtgcttccctgcaaaaacagccagttccagctagaaactttatcttcatgaaaggaaacctctaggcagagagaagttctatttgtttttacaactgtccccagttgtatttgaagatggcaaaatgttgggcttaaggcctgccctgggttcatggagctagctttcttaatgcctcaatcatacttttaatcagaaaaaatttagagcattaatcttcagtgcttgttcttgccatttccagccactcgacactttttcataaacaaagtgacagtttgattgaatgtggtttttaattaagctgccttcacttggaacaactttctgggggcatatgtaaggagcagaacttagaagcacaagctgagactgacttcgcaatagcttcatctccaggcagagtttgagaacaaaggaaaccaggcaagtggaattaaccaggcaccttaatccagggcatcagctcccactccatcctagctggctgtcccttagaataagtgtgggaaggcatagcagtgagtgcagttgcctcatgctaacctcaggacgaagcatgtaagagcctcggaaattgccccatggtagatatttatattaacgacatttgacctgtttatggcatgtcactctcttctgcagttgggactctgcaaacacaaaaggcaaaaagaccactctgattctgccctcaggtacaactcagaattgtatgagcaacagtggattctgcagtacaagatctcagagtctaacagggaggcgaagatattcactggggcagaacattcgagacgggaatgaaggaatgggctacctgagcttggagggtggagatgtggctgggaaacactttgaaagcccttcaaaggctgttcaagtataatagggacagtcatatgacagggctgggcctccttgaggtgggtgtttggatggtaagagggtcccaggcattgtcatctggctgcaatacaaggatctgcaatacaaggtgagggtgatattgctttaagtagcgctcatctgtactccatcgctccctttgtgttctgtggtgtatagatctaccctgataaatagctgctgccgtggagaaatccatcaagccttcagcctctgcatgactcatttccctgtggcaggcgtgttgctcggcttccaagaatagcctagcctgagggatccaagctcggaatcccttccaactttctgggctctgaagtttggcacccacagaggtctatgcttaggtaacggggtgcagatggcttgtcgtttgcagagacagtggctaataaccatctcccttccaccttcgctttctgcaaaagcccagggcctggcagagtcacattgcttgcaaaggaagcctaatcataaaaaggtgccttttggtggcttaaagataaggtaatcaggaaacccattcattgatttatttgctcattcaacaaatatttgatgactgccttgggagtgagaaccacagcaagaaacttaacaggggaccttacagaggcaaatcagatctcagtgctaagccctgaatatactctgctgttgtggcaaccaggcagggagatgataagaacagtaattggcatttattaagcacttactgtatgtggtgtattaagtactttacatgaatcaatttgattaatatgcacaaaagtgccatcaattcagttccatgatcattcttatttgctcgctgagagcagcattgcacagagggtaacttgctcattctcatacaaagtgctcatgcaattcttcatacaggaattgcacccagggttctctgatacaagcacataaaaatcacactgattacaccattgcgttatcatagcaaccttctttctgtcgcttcttcccagcctgtgccaagctctttcctgctttcttagtctgtttgggctgctatagcaaaatgtcataaactgggtagcttgtaagcaacaaacatctatttcttatagttctgtaggctgcttaagtccagggtcaaggcaccagaagattcatgtctggtgagggcctgcttcctttttcatagatggctgtcatcattttgttttgttcttcattggtaatggaaggggccgttgatctctctggagcctcttttatcagggcatgaatatcatttatgagggcttggccctcatgacctaatcacctcccaagggccctacctcctaacaccatcacattgaggattaggttttaacatctgaattttggagggatacagacattcagaccatagtgcctaccccatgggcttagcgttttcctctgcctgaaacatggctgcattgtctccatctcattcttcaggtctccccttaaaggccaactccttaagaggccttccctgactacccagtcagttctctcctattattctctagcttgcactttatttctttcacagcctttatcatactgtgacattaccattttttttggttgttattgtccatatgcccctctcctccattccctactagaaattaagctcccaaaggcacaggccttgtgtatcttatttgtgctaagatggtgcctgacacctagtgagtcctcagtgagtgtggtatgggtggttggaggaaggagctcggaccttcagtcctcacagatgcacaacaaatctcaggtgttgttgcatggctgtttgaatgaatggagctatgagcataaggctgtattgttattgttgtcactgtcatgatcatggctggtgaaaaacagaaagacactggggattcagaatgcacaacagtgtttgcaattgcaatgcagagacggtgatgtggcaggcagtcagtcagccagtcagtcagcgtgctccctttccgggatctgccagtggagtgcactgtgccccatggatgggcttcggagggggtagtggtgacatcagctccccagcagcttctcacctctcttggcctgaagggggctgtgccctttgtttcactgcagctgctgcagacagagaaaggaggagattcccagcctcgagtttgcctcgcagggcagtagcaaccgagggcagagcacagaggagcagctgcattctccatggggacatgactacgtggcctggcttctccttcccccaggggctgggggcctgccaggtgctctgaggattccctattgctcttatctccttccctcctgcatctcaatttgcctccccctggactctgcttttccccccttgtcttgcctaatctgccacaaggacatgctggaaagaggactttctgtgttctagaacattctacatgtgtggctcctgagtctcactttgtccacctgtgaagtgggcattatacccaccgagagtgtggtcacgaggaacagacgaggctgtcatttccccagcacggttccaggcacttggctggtaaagctctgtggtgtttgttcatcacactggaccacagagcaacagtgtctcacatgttatgaagatgtttcaatccgtggactaagcacttcattattgttgttgtcattattattactaacattttctaatttaacagctttattgaggcattgacatgcaataaaccgcacagctggatgagtgctgatgtaggcatatacctgtggaaccatcaccacaatggtattcagcccttaccacaaccgcattttgcagatgaggaaaaagaggcttagagagagaaataccttatcctggttcacgtggatggctaaaagcagagctgtctgatccaggcctgagtttaccttggagacaagaaacgtcagagataaggctgcagtcttaaatatgatgccacggaaggtatcaccaaaaaaaatggtatttggataaagaccctaaagaggcttcaaagggagtgggctacgcagaagagcattccaaggagagaaaatagcatatgcaaaggccctgaggtgggggtgttttccagtgtgtttcagaagcatttaagaggccaagctggcttggggatggaaggagatgagggcagaaaggtaaccggaggccaaactctaaagggccttgtaggactgtgcaaggtcttgcctgaaacaccattgcagggtttggggcagataataaacatggactaatggggccattctggcttcactgttgatactggattgtaagagggcacaggtggaaacagaagtcatccaggtgagaggtggcatggaccaaacttgtagtggcagtggtgagagtgtgggatgtactgggtttactgatggatttgtgcagaatgagagaaagaggagagttggagatgccaccaaaatgtttggcctcagcaacgaagtcaggggctaatgtggctgagatggatgatagacttgagatgcctgttacacatcctattagtattttttccctttgctgctataacaaattacacacagtggcttaaaacacatcaatttataatcctactggtcacccacatctcactgggctaaaatcaaggtgcagtgctgtgttctttctggaggctgcaggggagaatccatttactgggctttccagcttttagaggctgcctgtaccctttggcttgtggtcgcttcctccatctccagtgccagcaacattgcattcctctgtgcctttcttctgaagtcacatctctttctacccaaagccaggaaaggttctgcacttgtgaccctggtgatgatattggccccacgcaggtcatccaggataaattcccctctgaagatctttaactgaatcacatttgccaagtcccctttgctgtgtaaggtaacatgctcacaggttccaggaattagggtgtggaccttgttggggaccagtgctctgcctactacacacatatcctggtggagatgcaaggagagactttgatgtttgagtctggcttttcagaagtgtaggtagctgcagatggaatgttcacagtgctctcgactcttccatatttactttctgcatttgttcagtcgtcatagctctttctcctccagactatgagctgcttgaggtagaacttgggtcttttcctccttgtgtgtctcagagccacaccccagagagtgctctggattgtctgtgacaagaatacagtttgagttcaaatttaaaccaaactcatctcttagatgaggagcatcatacagatcctagtgcgtgggagggccacggacatgtgtctccaccctgccttgcctggtaagagttcatggcagaccctaaccctgctgagctcttgttttagcttttaggtccccaccgtcgccactctggatacaaacttggcattgtggctaggggttttgtgggatggatgcagcagttgttgcctcgtcaacattctcctgtggatggtttttgggtcaaggcccactggatcctgttgtgagttaatttgcaaagcttagctgtacctaatgcaggaaagagggtaaacaaacacaagcagcaggacagactttgcaccagtgactcagaggaaggcctatggggatgggatcctcaacccactttgcttcctgatgtcccaggtgctgggctgggagaatggtctggttagccctatgtccgatcctaaggaacattcacattttgccatgctttttacaggtagcacaatgggcgcatttttcactcttgcagatgggtctcggaatgaacttccttgcattgaaaaagggagtggtttggattttctcactgtctagaagcatagtggctaagggaatttctggagtccctctgtctgggttcagagcccagagttataaacactagttgtaggattttattttttaatttttaattttttagcatattaattatatttaattctctattttggatatttagagcagctagaggcattattttagatattgacgagatgaatgtccttctaacacttgtctgattattttcttatgagaaattcctagtacagaatgtgttagtcaaagggcttatttttaagactttgatatgtgtcatcaaggtgccctgtagggtgactgtcctggatgacactcattttgatggactggttcctttttattgtggtagaatatatataacctaaaatttactattctaaccatttttaagttcagtggcgttaagtacattcacattgttgtgcaatcatcatcagtatccatctccagaacttttccatcgttccaaatcgagtctctgtacttacttgcaatcactctccattccgccccgctgcttggtccctggtaactactattctactttctgtctctataaatttgcctattttaggtatcccatataagtagaggcatacaaatttatctttttgtgatacgggactttagacaagtcacgtcatttctctagggctcagtttcctaatctgatttagtatgactgtgaaactctcaaactcaggatgaaagggaaggagggaggaggacctttaagtgatcaaccaaaatttactaggtgctgactacgcgccaggtactggataccattatattccccgacatgcagatgaggaaactgcataggagaggacccatgcaaagtcccagcaagttcagggctgagattttaacccatgtggcctggcgtcagaaccacattctcaatgcctacactgggctgtcctttgataataatggaaactccttcattggaggattctttgaaggattgagccagaaattttatctatgtataatagcacttaggccagcaaggagaaattggtcaataagtgatacctagtcttacgtttaaatgtttttgagatataattcacataaaatttatcatgttaaagttcacagtccaatgctttttagtatattgactatattgtgcaaccatcaccactccctaattctagaacagttccaaaaccacaaaaagaaacctcatatttttagccgtcactctgtctccctttgtccccagccctagaaaccatggatctactttttgtctctatggatttgcctattctggaaatttcatgtaaatggaattgtataatacatggccttttgcgtctggtttccttcacttagcataatgtcttcaatgcccatccatgttgtagaaggtatcagtacttcattcctttttatgggtgtataacattccattgaatggccatatcatatcttgtttatcccttcattgattgtaggatgtttagattgtttccagtttttggctgctatcagtaatgctgctatgaacacttacatacaagttattgtttgaacatctgttttcagttctcttgggtatatacatacctagaaatggaattgctggatcatataggagttctatgtgtagctttttgaagaactgtcgtactgttttccatagcagctgtaccattttacattctcacaatcagtgtacagggtttcttatttctccacatcctggtcaacatttgttatttccattcttctgaatttagccatcctggtgagtgtgaagtgctatctgattgtgattttgatttgcatttctctaatcactgtttgtattgagcatatttttatgtgcttagtggctgtttgtatgccatcttgtaagaaatgtctattgagaccctttgccttttttaaaaacggagtcgcctttctattgttgagttgtgagtgttctctatgtaccctggatactagacttttatgagatatataatttgcaaatattttctgtgtgtcgtgttttcacttcgtttttttttttttttgtgacgggggtctcactctgtcacacagattggagtgcagtggcacgatctcagctcactcactgcaacctccgcctcccaggctcaagtgattctcctgcctcagcctcctgagtagctgggattacaggcacgtgctactgttgcccggctaattttttttttttttctggatttttagtagagatgcggtttcaccatgttggccaggctggtcgtattttcacttcttaatagtgccctttgatgaataaaagtttttaattttgacaaagggtgaaggatgtctaatattttgtctatgatccatttttcacctctaggcccacttttttgaccctcacacatcacggtagattaggaatttcttaatgctgtactggttttggaggtaaggaagatgggactagcccactttgctttgtcaggctgagagggaagaagtgattccattgagccaggacttcagtggccaaaactacctcccctggcttcagaatcccttccccagaccaaccctgcgtgatatcagcatgtggtaaaacactcctgtgtctttagagactgcagtctataaatgatttttctgtcttccatgggccttgcctgcaagcactttccatctttccctaggtttcaggaatgctcaagaattacgggatcttgactgggcacggtggctcacacctgtaatcccagcattttggtaggccaaggcgagtgaatcatttgaggtcaggagtttgagaccagcttggccaacatggtgaaaccccatctctactaacaatacaaaaactagccagacgtggcggtgggtgcctgtaatcccagctacttgggaggctgagggaggggaatctcttgaactagggaggaggaggttgcagtaagccgagcttgggccactgtactccagcctgggcctgggcaacgaaaagagactctgtctcaaaaaaaaaaaaaaaaaaaaagggggtcttgtcactgagtttcctcatcttgcctctgcctctgagcacatttttccttctgcttctccaccataatgaaaaccagccataggctttgactactctctattctctagtgtcccaaacttcagtgagcacagacaatcacccagataacttgttaaatatgtggattcctgggatattccccagaaatactgaatctaaatttagggatagagcctaggatgcacatgtttaagcagattcccaggtgattctgatgtcagggggtccacagaccacgtctttagaggcactgccttattctagaagcctacccacccaaacttattctgagatcccaagagaggctaagtccagtggttctcaaacttgactgcatactataatcacctaggagaactttacaacttccctccatcctaggacacagtgcagacaaatcaaaacagaaactcagggcatgggaccccagcttcagtagtttttaaagctccttgggtacttccaaattgcagccaaagctgagaggcatcggagccataaaattgtaggtacttgtttctctttgctaagtcctttaacccacacaggtcagctggatttggaagttgatgcttcactcttataaacacatttcaacttgttgtttattctcatgctgcaaatggaaggtacagaattgcaagggatggaatgtgcacgtacctccaatttccctaccagcagggaatgcaacagcctcatgatgcttaaccacaaagggcatcacttgagacatctttgctcactctcacgatggtgaaagattgtcctgggctcattgaaggagctatggatgtttccaagtccccagatagaggtatcatcactttctgatcatgaacctatggtaccaaggtcattctggtgaagaatcttttatgtagtggccaagagtgtgggctttggaatcaggctgcctggtttgaattttagctctatcacttaggtgggcaacctacccacctttctgtgcctccatttccttctctgtgaaatggagataaacaaaagtactgtacctatagggttgtcttaaaaattaaacaagatgatgcatataaacaatttaacccctgcctggtgtcggctcccgtccacttctcctcttgggttgcctttcaagaagtgatagtggcaggcagggctggtgcttgggaccatactggtgatagaagcagcagccaggtactgtgcccaaaatgctctcaagagtacaggctcagtacatccctttcatttaccacctgagccctgtctggtgagactcatcatttgtcctctatacaatgccttcccaaactccactccaatccctttctataggcacagcttttgttaacaaggtatagcttcatcctgggggcataatgcacttgaagtttttctcaatacagtgttattagggtgaagaagggacttacataatcaggacaaccagaagagatacatgcccaaattcttaacaagattcatggctcgtcccgtaagactccttgactctattattgcagttttaagagtacagactctttgtggttttccccttacttcaactggatctgtcagtaattccaattactgacaatgacacattcttctagaaccaataagcttcctacattgcatttctgctaatagaatgttccgaatatttccaggtatatgtgtctgcatgattctacctttataaagcctctaactagaaatcccaaatttccatgcaacagtattcaacattcagccatgtgctaggcatggttcttttatgtaggtattacttaagctggtttatcaattttaacacactagatttccccttctgatcaatactgcctatcggatggcatgaggagagttttggagaaatggtagtcattactctggtgagggcatggactttccatgctctcaggtgaccaaggcactccaagagttgttgggttaatctgactgctctctcaacaaagagaaatagggagaggaggagaggaaaagaggaaagtaggcttcttagagggcaaagtacccatgagaaaagcagacaaaggaaagagggtacttggaacatgtcttctctataagcggtccagatggtctgcgtgtgaggcagtctgcagaactggctaatccaaccgctgaacaattcatagccagtttgcaaaacctgaaaaaggcagcccagaggtccacacaggagtagagggggaagaagggcctgctaaaaacttatcatctggaaaatctgatgatgagaggagtgctcagagaatacgaagggaaaccttataaatatctcagtgtcactaggatctcgggcttcaagcagcccttgaagtttaagaacaaatcatcccaggccacgctggtagcatttttttttaactgtaattacaaataactgacatatggcaatgttgtagatggctggcttctgagctgtggaccagtgattctcaaactttaacacgcatgcacaaatcacctgggatttggttaaaatgcagattccagttcagcaagtctgggctggagcctgagactctgcacttctaagaagctcctgggagatgctgatgctgctggcccatggaccccactgtgagtagcgaggctagaggcgtgcttggtaaacaaagtcaggaggcctaaatggaggtgcttcgaggtggtgcaggagcacctggggcacctagaaaacattgctggcatctcggggacccatgtccagggaagggctccaggacttccccgagttgaggatgaagactcagacttcctggctaccactcaggtagagaagagcagacgttgccactgaagtcccaggtatgaatgaattctagagctgctggagtggggaacattgtcattgagcttagagaaacagaagtaggagggaggggtggataggcaagagggaacccacaggtactgagcatttcttgattgtcttcctcttgctccccacccttaactgttccttcccaggtctttctctctttagtaattgcactcaccatccacctaactgcctaagcccaagacgtgggatctatccttcactgcattgggaaaggtggtcatgcacagcttgctggaccctgtatggctgtatgagtggccttgggcctgaaacatttccttaacaagagatgaagagccctcccagcctgggctgggcatatctctttgcctggaaatatctttccctgttctgggcttgatgtactttgttctgctcaagtgtgtgcatctaatggcccctggccaaacctgctactatatctgtccctggtggaaagggatctgggtccttctactgcagcacgaggtgggtgtgtgcagctgcactgcctgggttgactgcagagcagatccactggctgtgggggactgacgcattgcaagggactgcatcttgtgtagtctgtctcctcttgctctaccacttgagcctggtgtgtgtgttgtctgttctcagcaacctcaaatcgtgtgatggtctcttccctggatgacacttagccttttaaccttggctgcccagcctgaccacccagtgaatggtggaacattctctttctctcatccccaccagagtctagtgcaatgtataattattctccttcaaatgtatatctcagatccttcctcatctccagtgctaccaccatcatcaccatctggagctgtagatgaagcagcctccactggtctccctgcttctacctctactcctcccctacttcatcctttcctttgcagccagggtaaattggatcaggtcacttctcttctgaatagcctttaagggcttctcatgacatcttggtggctagaacctaggtgccttctcatgaactgcggggtccttacccacctgtcttatccctctcctcttgccacctgctccccaccacgcacctgtgctctgtcagttgtcacctgtgctctctgtcagttttgaacataccctgttttctttccttcttagagtctttgtgtatttggttctctctgtctggaaccagcaccaatccccaaaactctgccatccttcaggtctctgcttcaatgtcgcttccccagagacagattccctgatcaccctagattaggtgttagtctctggcctctgtcctttactctcatggcactaaccttagtttggtttgtacattatctattatctgcctctcccaatacattagatgatccatgggggaattgataaggtttggatgtcttgcccaaatcttacgttgaattgtaatctccagtgttggaggtggggcctggtgggaagtgtttggatcatggaggtggatcccttgtgaatggcttgggccacactcttggtactgagtgaactcttgctccgagttactttgagatctggtcatttaaaagtgtatagcacttccccccaagacttactctctcctgctctggccatgtgatgtgcctgctcccccttcaccttccaccatgactgtaagcttcctgaggcctccccagaagccaggcagatgccagtaccatgtttcctgtaaagcctgcagaactgtgagccaattaaacgtcttttctttataaattacccagtctgaggtatttctttatagcaatgcaagaacagactagtacagggtctctgcctttcttatctgttgttgaatatccagcacccagctccaggctcagagtagacactcaatacatgttggttaaagaactgagtgaattagtaaataaatacgctttgggaaagcagaggaccacaaggagagcataaaagggattagcattcatggaaacagctgctatgtgcattgcacatctgccatctcatctcatctatcccacagatggctttcagccatcttgtagcctagagagtttaattaacctgcccaagttccacagccactgagtagcagagctgatctgtactctgcttcatcttagcctggagttgttttagctttggcatcatgacatttgggaccacatcattctttgctgtggggtggagggggtggatataatacgcattgcaggacatgtagcctctacccatgccatgctagtagcaccccctgcccaatttatgacaaccctcatgcatccagacattgccaatgtcccttggggtgggggtgggaatgtgtccccagtatagaaccactggcttagcctgtgggtaatctcagcctcccatctgcttctactccaatccctgcccaccccactcctctcagctgctgtttttctcctggactctttctcaccctgtcttcacgcagtcctccctgggtgtccctccgggcatgcaacacacagatggcaatgttccgagtgttgcaatacacatttgtgtttctggttactttaatatcagccccatgtcctgatgttcgtgtcattggcatggatgctaacaggctgtctagaaaatgtgcaatatattttttattttgcctaaatagcacatctaattgttcagcatgagataaaccagtatgtttacggggagataacttgtcaaaacagacttttgtggctccaccgttggaaaaacctagcctcctcattcagagatggagtgtgaatttttcgtgggtattttatgtggatttaaagcaaattatttcctgctgttttgtggacagaaaaaaatgagggaaaaaacggcttcagaaaaagccccagatgcaagtgtcttttaaagcataggggatgaagaaagagaatagaacagaaaagaggagaaagaaacagcaaaaaagagggaatttgctagagaaaaaatgtgagagagttcacagctgggggatccagttagaggtagggtgctctttttttgctcattcatttattcatccacttaaaatatcgtgagctagggagtgtgctggtgtagcatgtatccgaatgtcctttctttttgaacgctggctaatatttcattgtatgtatttacattttgtttacctgttcttctgtcaatggacatttgggttgttcccacctttggctattgtgaataatgctgctatgatgggctggtcttacatatcagtgttaaaggtgacatttcccaagtgcctactgctgagctgggcaccatgctggcctctgcacacgtggtatctcatttaaccttctcaatctcctgggaggttaaccctctgccatgacatttagcaaacactgggaggggcagcttaagatgcttcagtcactcatcctaaggtctcagagtgatagatcctgggtggaaacatgggtctctttgtaggtcatcatttttataatcagaataagtgattgtgagtgaggtcttactcagtgaggaacatgaaatagcccatagttttgtccctgttgactttgacgccctcttgcatttgtatggaactgctattttgcagcatacatctgtcttcaggtaccatttttactctgcaaacattggttaaccttgaaactctctgctgctccttcctcctctccttttatgacagagataaataagttggtgatgtttccagaaggacacgatgagacagacaggattagactccaggaaggagcccagcggccacttcgtgagctagtgttcaggcaaccctccccagatgtgcagtgtagcagaagtaaaggcccctgagaggcacagagaggaagacgcatcccaaacttcaaaggctggcagcctcccactccaacaccgggggatatgaaattctgccgtgatgaagagcatcgtctgctttctaaagtctgaagaatatttctagtcagttcctaagatgtgctgggggtgagatggactatggaagtgtcaggaggacagataaatgatctcttagttgttggattcatgatgtctaaatccatttccgaaagccctctctcaaggaacactctttaaggtatgggtaggtgactttcagctctctattcgtaagagacccatgtttccacccagtatctatcaccctgagaccgtgggaggaatgaccaaaccatgttaagcgccccccctcccaatgtttgtccaatgtcatgacagagggtcaacctcccatgaaattgagagggttatagtcttggcttgagatggggttggagtaaataatgtatccaatcctcttccagcttagcattcacttggtggccaatgagctcttccataattattaacactactgagcacacgctacaagtcaagaactatgctagatgcccttcatccatgctgtcactgaattcttttaaaaaccttatgaggtaggagctatgattagccctattttagagataagaaaattgaggttcaataacttgcctgaagtcacacagtgagcaaatgacagagatttaaacatgcattaaaacaactttatgaaaggatgaattctgaagatctgaccttagagagatgggtgtaattaacctgaagttgagagactcctgtggcatatgtattgtgctagatagagaaagaaaatcgtggttgtaacaaggaggccgaaatagaatgtcacaagagtagatgctctgggttgcaggtgcattcttttgctaacaagttttttctcacgtgagtaactccacacagcatgctcttggctgggtggcagcaggctaccattttagtgacagttaatcatttaatgatggttaataattctcccaactgatgccaggcaggcgaggtaccttaaaataaagtacagaacttactggcatgtatgaatgcccaattgcatcagagattaattttctgtttgtgttgaatgctgtgtggagagtctatgttatcaccagactttgctaaatttccctgtaattttttgcatggtcctgactctcctctttcatttatctgcatatggattctccacgttacggtgtattctgattttcttaggtaggtgacattgaaaaagtgtaacaattgatgaggcatggggattcgtccgtttggatgaatgcactgaccgtgtgaatgcttgccagccataaacaaccagctgaatatcaatcttgccctgaaacaatggagatttccccatagtctagtccatgggatcaaacagtaatttgcatttcactgaagcacatggagaagtcaaaacagactatgcaagtaagagtcagagaatagcatgtgaagcaaagatttgcacctggggttgttagtagcagggtctattgaactatgacatctcttgatatgttttagtcaccatattaatttctcttgccatttcaaatagcattagaggaaaatgtgaggttaaaaatgtttatcaaggagacctggatcataaaagcttgagaaacatcaatgtagaggcatgaacagtagaaacaagcataggtttgatggagtcgctgggttaacatggagtgaagctgtccatctttttcccgttgataaagtcctagttgaaaatgtttgaggatctctggtgcagggctttgggaatcaggcaagacctcagtccccagggagtgaagatgaggttagaccagtgacaacgttgttctgatgcaccaaaatgggcgaacgaagtgaggtgcctgggacgcattcaccagcattcaagtacctgttgatgcagggcccctgcatgttgctgtggctagttttgggggttgtttgaaaaatagaagagtcagcccctgattctgaaggaatatctgttctcgtggaagaaacaaaacactcaccaacaaagtcagttcaattctatagacatcgattgagaacctaccatgggtaagaaaagctctctgtttgagagtaacttaaggatcattgaaaaatgacacatcagtatgattcgaataaagcagaacagaacaatcctattgttctcaccatactgctgagacataaaatcccagaattctagaagggctctaattaggaaaggcttccaggagacggtgactgtggggtcatgaataaagtggcagcttcctcaggggagcctgggaagagggtatttgctccattatcagcccggcttttggcggtgcaagaaatgaaggctactgtacgtctagaagtttccaatattttcaccacctagtgttcttttttattattttgactcctatggacactgtttttaggaggattttatctactgataaaagtatattgaagcagtggttctgtactaatcaaacctacctgtaacatgtaatttagatcctctgatttgcttgagaattatttattcattcaacaaatattcacgggatactaaatcaattggattcagtttggtggtttatgacagaaaatccagattatcaatggcttaagtaagaattttatttccttctcatgttaaagaaggagagaatagatttttgggtgggaggcttatggttgctgtcataagcatctactagaagccaaataccaggttatgtactagaaatggctaggcggggctcatgcacagtgatttgctatgattctaacccatttttaaattataatttcaacttttattttagatccagtggatacatgtgctgggttgtttcatgggtatattctgtgatgctgaggatatgaatggtcccatcatccaagtagtgagcatagttcacaacaggtagtttttcagccttgctctcctcacgcttatcatcatccccagtgtctattcccatttttatatccatgtatacccagtgtttagctctcacttataagtgagaacatgaagtatttgtttttctgttcctgtgttaatttgcttaggataatgtcctccagctccatccatgttgcggcaaataacatgattttgttcttttttatggctgtgtatattccatggtatatatgtgccaaattttctttatccaatccaccactgatgggcacctaggttgattccatgtcttcgttattgtgaatagtgctgcagcgaacatatgagtgcatgtgtctttttgctaacccaatgtttttcttttcttcttctttttttttttttgaaacagagtcttgctctgtcacccaggctggagtgcagtggcacaatctctgctcacagcaacctctgcctcccaggttcaagcaattcttctaccactgcctcccgagtagccgggattatagacatatgccatcacacgcaactaatttttgtgtttttagtagagatggagttttgccatgttggccaggttgatctcaaactcctgacctcaggtgatacacccacctcggcctcccaaaatgttgggtttacaggggattacaggtgtgagccactgtgcccggcgtgttaacccaatgtttttcaaactttagtgtgtgtcagtcacctggaaagcttgtgaaaacagatttccgaatgttatttctggagtttgtttcattaggtctggaggcaaagagactgacaatttgcatttctagaaaggtctggatgctgttggtctggtgaccagttgaacccagtgacataggtcagggcatggccatctacagcctacaggtcaaatccagctagctatttttgtacataaatttttattggaatgcagccatactttttttgttttctactgtctagggctgctttttactacaacagcaggggtgagtagttgtaatctgaagtgtttcctatttgaccttttacagagaaagcttatcaactcctgccttaggtagaagtggatactcgcaatccataaagaaggtatgtacatcagtggagaagtcagcaagtaccggacctgggtttccatctcatcccagttcagccattcattttttatgtgactttggtccggccattaccctatctgatcctcagttgcctcccctatgtaatggaggcactgagcaaatggtttcaaaaatcccttttagtacttctctgatttcagcagagaagctgacggaatggtttgttgccattgtacaaagtgacaggctctggctgaatacgtcccattttgctgctgagttcgattggcctttatgttctgtttatgaaggtgtcccctctgccacttttggagggaactccctttcttcacttttgattgatatgtgacatttactggagctggcattctttaattcctactctctgagccactttccaacatgttctattcatcactgtgacttttttgttgcctttgccactactaaccttctaagagttcggaaaagaggcacttagagtttataatgacatatataatatcacaccacctctctctgccccagactgacttcactgtgggtttgggagtctttttcagaagcaacaagggagaaaattttgcttttgatggcaccccatcaatcaaagtgagacacacagttgactgtatttaaatcagagtgaatgagtggaaatgagtatgtaaaggaatctcaggaatctctattcattggattttagtattcgggcaggtgcatatattggttaggaattgtgtttgccaataaataagcctggaaatgctaaaacaaaagagaagtttatttccttctcagattaaagcagcctggaggtaggtggttgagggttgccaaggtggcttcatggtgtcctcatagattaagcctcttcctgtatttctgttgtactcttaagcacatggtttgcatcattaaagttgcttcatgatccaagatggctgctggagctccaggcatcacattcacactcaaagcaggaaacaagaataaggaggagaagagcaaaaagggcacactctagctgtatgccccttcttcaagagctcagaaatcctaccccagcatttcagtctattgttggtcatctctgatagggaggaaggctggggaatagaatattttacctagaaacattgtttctgaattaaactggagttctaaaaaggaaaaggagaaccgacattgggtgggaaaccagcagtttctgctctgatgtctttcagaatgaatactttgatcaatatggtaggaagttagatttggggatggtttttggcttgcactgttgtgggtgtgttatgaatggaaggccatatagcttgcactcgtaaagaggaaacgcagctttcattagatatccctggctttgaatctgccatttactagctttgtgacttggggcaagatatttaacttttctgagtctcaatttcctcatctgtaagttgaaaataataatagtagcaaagatgatgataatgaagatggtgctaaaagtaatcatgactttcttgcaggaacaaatgatacattgaagatcaagcactaggaacagtttttagcatgcagttagcatttaatgaacagcagataatcctctttgaagaacaatggatatcagaggaaagactataaattttgggttcctccagacataggtttaggtgccagcttagccactggctagcggaggaaccctaagtaggtttctgaatcttgctgagccttaattttcttatctataagataggtcacagtaggggctaaacagataatgtgtgggacagaactgaggcaacatcagaaaacgtgaagcacagaccccggcatgtggttcgtgcctagtacctattgattttccttctctttctagtatagaggattgggctgtgaggactttgttcccgggtctgctccggtagcctgattgttctcaatcctttctctgacctttcccttctctgttctatatgcaaggacatattttatccaggctataggtgatttctccctcacttcctcttccttgggaatgtccccatctagctcttgatgggcagcctccagggtcccaattcctatcaggtggtccctgctgtgggatttgctactgccaagcgacccagcttctgaactttggtaatgtctcctgcatcccccttttcctccatccctaggatattaatggcttcctcttttccttttctctctgtgtcccagtggctcctatgtaaccaatttcctgtattatctctgttggaaacacctggagtggtttccgtttccctgactgggtcttaactcattcacgaatctaaaattgtataaacacataatgcccaaacattctcttcacttacctcttacctctcaccaccctctaaaaatcttgtttgttttttttttttttttcggtcacgatggtgtgattttatttctttagttccatggcccttcattagctacaggagaaagtcaaaagtccttcctctgttgtttaagacgctctgttgtctgaggcatgggctcctttctaaagttattatttgcttctgaacttcagaaatttttagaacaaatttgattttacctccaaaatatatcatcaacctacccatttctaccaccagtcaaagccaggggtagctgaatcctgcacttgcatggccctgagaatgagttcttccttgaattctgtacccgtagatgcctcagtagccccagccctggatcaagtcaccactctcttacttggatgaatgcaatggcctctaaactggtctcttctatcaattatctttttctttacaatccattctctattcagtgtccaaagaaatcttttaaaacaatataatgtagatctgttattcccctgcatacactgcttccatggctacccactgcacttaaggcacaactaaaacctattcccatagtctgtggggcccagcacatctgcagctgctccatctttgtcgccatttcctctgtctcctattgctatgttcactccagcaacatggactgtcctcctgttcttctgatgcccaagttcttctcctgttacagggcctttgtctgaatccctcttccatgtattatgattccccatcctgctgcataatgtgttcatcatgggtaccaacaccaggtgaacctcccctttccccatatcactctgttgattctttttcacaatctattgttatcacagcctataactatcttgtttatctgcttattgactgtctctgcccactagaatataagctcattagggaagacaccacatctgtctttttggccttgtatattgctagcactaaccatattgtcaggaatgtcagaaacattcagaatttgggggatgaatgagcgagtaaatgaatggacaaatacataaatacctaaacatataaatcacataaacgggcccctaaggggtctgtggatggaactcagtggtctgtaaacttggatggggaaaaattgcttatttttacttacctctaacaaaagttttcattcttttcattttgaattgtagcaagaaatcacagtaatagcagctgtctgattttttttcaccaagagaaattacatatttcttatcacattatcattgttgtagatatttcagaattatttacttttgccaaattattttgaaatcattgtagttagtagacacagcacagatcttgtgatttagcatgttaataccgacataaacataacacaagtttgttttaaaacatcattatgactgtattttgatataatttgttttctttgtaatctagcggtttttttgtttctttgttttttgttttttgtttttttgttttttggtttttttgttttttggttttttttgagacagtgtctagctcttttcaccaggctggagtgcaaggcttgatcatggctcactgcaacctctgcctcccgggttcaagcaattctcccgcctcagcctcccaagtaactagaattacaggtctgcaccaccacgcccagctgatttttgtatttttagtagagacagggtttcaacacgttggtcaggcttgtctcaaactcctgacctcgagtgatccaccctccttggcttcccagagtgttgggattacaggcatgagccaccacacccggccacgtattttattttacttatttgacagctctgttctgagaaggaatttgaaggcttcaccagcctgccaaagtggtcgttggcacataaaagtcaagatctcttaaaatgaacgagtgatgtctgcgcttttgtttattgaggaccacgctaaaaataggtatccctcccattacttaactgtcatttatccttcagtatccaggcagacttttcttcaagaaagctttgcagtcttcagtggactccctgtcctctgagagtgtgtagcacttacccaaagcccaatacttccctgatcgtgtaagcctctttgggaagtgattttttttttttaactacttatgagtttgttttgtttttccaccttacagaggctttctgttactccctaatcataattagtgccctgtcccctgcacccttgttattttctttgtagagctgtatttttttccttcatagaattcaacaaaattgataaatatatatttacttgtatgatttatttattgtctatatatccatttgggaagaggccttggatattttgctcctcatctagtggaggccccagaacatttatattggaagggcctaagtgccaccaacatagttacaagtggcaggaatacctagggaacttaccttgaagttcagtttgcatagcaagcccattgtatttacttagattgtatttattcttgaggtctggtgatattagtggggttattagcatatgtcagaggaagaacccataatatcgtgctactactgttgtcgccattgtacacttagcacacagaacaacacttggcacatagaccctaaataaagtatgtgtgaatggatgaatgatggatggatgggtggatagatggatgcatggttggatggaatgaatggggaattgggtggatggctggatggatgggtggagggatggatgggtagaaggctggaggggtggagggttgtatagttgagaagattactggctgggggttggagagatggagtagttggtaggggaggtggtgtattagtttcctagggctgctcaacaaagtcctgcaaacttcgtggctcaaaaccacaggaatttattatatcacagttctagaggctagatgttcaaaatcaaggttctggcattactgttctctttccaaggatgctaagggaagaccctcccctgcatcttctaacttctggtggttgccatcaacccttggcgttctttggcttgtaggtacatcattctagtctctgtttccatatttatgtggccttctccttgtgtgtgttcctgtgttttctcctcttcaggacaccagtcattggactggggtccaaattcagtatgacctcatattaatttagttgataacatctacaaaggccttcttttcaaatatggtcatattattaggttctgagtgagcatgaatttttgaaggatgctgctcaacccaatacaggtggttagagggttgaagagatggatgtatgaagcaatggaaggtggcttaatgggtaggtgtagaatgggaagggaggaccagcctggctggaaggggaagaggatggattggtaaaggagttgttgtataaagagaagggtgaatgattatttgaatggatgagtggaaagatgtagggttgaatggatcaagggtggaaaggtggatgagtgaaagggtaaatgggtggagggatgaatggttggttgcttggatatatgtatgggtgaatcaattatattattaatttcttcagagtagaaattctggtacatgtatttatcttctctgttattagtatgacactgcatttaggaaatgctcattaagtatttgttgcctggttttctctgcattcagaaatgctgttaactggaatgactgctaccagctgtccagggatatgaacttctagtgggtgagggagtgtatgtgtgaattcatttggtgcaatatccagcctggagctgtctctagcctggagtatgcttagtgaaaccctgagaaagaacttaaatgttgggtataattcctgctgtttagggagtgacaaaaatgtacatgtatagacaccactatttcatatttcaattattatttatttaacattttaaacctgatggcagaaaaatatgcctcagacaggcacaattgcttttattgtttcagattggatgggtaaatgtagcgtgggtgatcctaaatttgggctacattggtttctgttgaagcttttatcttatttgcctaaggaagggcttagttgaatttaaaagcacctattctgatgttgtctattgaagtgactgagtttgccagtgcactgttaatagggagtttgcagcttggtgccagatggattcacttcatcagatgtgacaaaggtcttcccagatgttttgtctgctcagagtatcctttttacattgatctggatatctgcagtgaactaaggagtctcagagaagtcatcctattattgtgtttaaatcttttctttttctctttcaaaaccaggatttatcaatggtggaatatttcagacatgctgataagtacagagaataaaataacaaacaaccatgtactgacaattcagatttaacaaatgttaatatttttgtcacatttatttcagattttaaaaatataaagatgctgctgaagcctgccaccctcatttcattcccttatctccttcctcagaggaaaccactaacctaaagctgataaatgtgtttttctatatgtacatgcaaacctagggtataatggtattagtatgttttatgctttttataaacagtactatatttttccaactactgttttttttttcttttttctttctttctttcttttttcctttttttttttttttttttttttttttttttttttttgagatagagtctcgctctgttgcctgggctggagtgcaatggcgtgatctcagctcactgcaacctccgcctcctgggttcaagcgattctcctgcctccagcttcctgagtagttgggactacagacgcgtgccaccatgtccggctaattttttgtgttcttagtagagatggggttttaccatattagccaggatggtcttgatctcctgacctcatgatccgcccacctcggcctcccaaaatggtaggcttacaggcgtaagccactgcgcctggcccaaattactcttttttactcagtattatgttattgagatttatctgtgtttataaatgtagctttagtggatttattttaactatttatattttaaatatccaccctatggatgtataaaaattttacttatccatgaactgaatgatgggcactttgtcattaaatcaacgaaacacagaacatctttgcacagatgagaaattttcttaatgatatatgcctgtaagtaaaatttctgggtcataggatgtgggcatcttcaacatcaccagagattgccaatttgttctgcaaaaggattgagcctgtttatgttcccacagcaaggaatgaaaagttgcaaccttcttatatctctttaaatctttgtattagtcctgttcatttttgcttatatgatagatgtaaaacggaatctaaccatggtcttcaatttgcatttatcttattaagaagttgaacatattttcacatttattggccatttgggttttcttttctttggtttgtttttcttgaacagtcatgtcagaagattcatttaatgtttttcctctgaagatcagcttatagttttatttggcttcttttttttcgcttggtttacttttggtttctgctttatccacgtaggatattttcctttttttagctttgtttctttattctgttcggttttttaaaattaaattttaacttcttattgtcactccatattcaaatatatccatttatggatgtattagattggtgcaaaagtatttgtggtccttgccattacaaaccacgattacttttgcaccaactaataatacagctcttgtgtggaggtttctgctttatccacgtaggatcttttcctttctttggctttgtttctttattctgttcagttttttaaaattaaattttaacttcttattgtcattccatattcaaatatatccatttatggatgtattagattggtgcaaaagtatttgcggttcttgccattacaaaccacgattacttttgcaccaactaatacagctcttttactgcatttcatgagtgaccctgacaacagaaggacgttgtaacagcaggtggcaggatgtagactaggcaaagtggtctaatcctggctccattttctccccagggcaatccaccttagtgcaacatttgccctcctaaaactcctatgaacttgtcaccacctgctcaaaagataccagtgactctgcttcattcgtcactcacagtccttaagagagacggtgtgtagtggaataattatgggcttcagagaggcacacatttcaggtttaagctccagctcttctcttgctagctggctgactttgggtaatttaaagtgggaatattcatagagggttgttgtgaagaatagacaagattagattctgatctgtggtagatgttcaacaaaatatattatcttccttttagcctgacatttaaggtcctgtagatcaaaccaccttttccataggatcctctgctagtcaactacagaaatcttctgtctcagtcatttgattttcttgctgaatttggaaagtttcagttaaaagctttctgtctccatcctactcttctccattcactgttgtggccctgaacagtggcagaattactagtggggcttgttcaaagttcagattcccaagttttactcagactcactgtctgtatttttttttttttttttgagatggagtcttgctctgttgcccaggctggagtgcaatggcgtgatctctgctcactgcaacctctgtctcccaggatcaagccattctcctgcctcagcctccagagtacctgggactacaggagtgtgccactgtgcctgggtaattgttgtatttttagtagagatgaggtttcaccatgttggccaggctggactcgaactcttgatctcaggtgatctgcccaccttggccttccaaagtgctgggattacaggtgtaagccaccatgcctggcctcactctctgtattctaaggatagggctcaggatctccatttaggagaagctcccagtttgggtggaatttgctctagtgattgaagcttcctgcctcaacagatcttttctttatatccagcacaggacctacattttccgggaggtctttaccgccagccagccctggtcacacttaccctcccagcaacctgaaggcggaatatcttagcccacccctctccctggctagaagcatcattcatgtcccctggggcagatggcgattccttaaggacagggcctaggtcttggggacttgaccgttcctgttggaagttcagtgcatgatatgtaaaaggacttagggtgagcatgggaaggagcacaggctttgtagctgcccaagttcaaacaccagctctgcaaaactggcccacggggctcagtctccttaactgtgaagtgatgatagcacatccaacccacaggtctttaaaggaagattaaatgtgatcagctctttggaaagtcatttgtttttctcttattccagatggagaagagcttgaattatcatgagaatacatctgtcattgggatcatctttgtgttaatttcctcctacagtagaatttaatgacctcttgaatttcctgatgacaatgttttgggcatgtgtgccattgtctactggccactatccttgtctttcagagacatttccttccaggccattataattctgtagtttcccccttgaagtcttcagtaaaagaggtagtttgagatctctcagcacaaacaagactttttagtatgtgacagtgatctgacaaatgaaaatgcattgttatggtgcccacgtaacagtgcaagtgtagtctttacaaaatacctacctaatcccattacccttctgcttaaatgtctgagctggctcctgtggctgacaggagcaggccagcctggcagagaaggcagggtctggccagtctctctgccccatcttctgtaccacctgcacagtattgcactcaccctggcatgctctggtgaccgttcctggtattttctacctccttgctcttgtacatgcagttctctctccctggaataccctttctctttgccaagttgtgtgaattcggcaatattcaattcgaatggtccagtccctgatacaccccctcagacacacacatgcaaggcagaattaattccttccagctttgtatacttggagcactttaaaaactactttgagttactactcattcattcactcaacaaatatttattaagtgcctactatgggtcagccattgatcttggctctggggatactcctgtgaaaaggcaatgccctgcacccatggagtttttcttcccaatgttttattactactcacttacgactgccctttccatcagactctgagacccatgcaggaggtgtcttgttcctgtctgtgcacttttacaactgactgcagttatttgagcttagaattccatggagaggaaaaacagtcccaaagtacagagtgggtgctgaagagattgcagggtggaatagtcatgaccttatagcaccaaaatcccaggaactgagtgttgcacacagtgtttcttattgtttgatcaactcccttgactttgtacagaggacaagaggaagagtgtggagttaagctgactgcacttacatctacatcatcctaccacctaactacatggggggcctgggacatgctctcgagtcttagcttcatcatctgaataatgggtctcttactttcctattgctgccataacaaattaccatgaacttcttagcttaaagtggcacatatttattatataaattatatgttttggaggactgaagtccaaaatgggtttcactgggttaaaatcaaggtttgtgaaagcagggctgtgctcctctgtaaactctcagattatgattcactgtctctacagcagtggtcctcaatctttttggcaccagggaccagtttcgtggaagacagtttttccacagaccggggttgggctgatggttttggaatgattcaagtgcattccatttattgtgtactttatttctattattacattataatatataatgaaataatgatacaactcatcataatgtagaatcagtgggagccctgaacttgttttcctgcaactagatggtcccatctggggttgatgggaggtagtgatagatcaacaggcattagattctcataaggagcatgccatctagatccctcgtatgtgcagttcacaatagggttggtgctcctatgagattctaatgctgccacttatctgacaggaggtggagctcaggtggtaatgcaagcaatggggagcagctataaatacagataaagcttcacttgctcacctgccgctcacctcctgctgtgtggcccagttcctaataggtcatggactggtactggtccgtggcttggggtttggggatccctactccagaggtcacctgtatttgttccttggctcctggcttcttccttcatcttcaaggctagaagtgtagcatcttcaagtccttgtctccctctgccctttctacctccctcttagaagaatacttctgattacattgggccaaaccagggacttcaggataatctccccatatcaagatcctcaatcacttctgtgaagtcttctcggccatgtaagttaacatattcacaggttcttggtatcgggacatagacatctattgggagacctttattcttcctatcaggtaggatggtatgggtatgagtataaatatgggagtgatgataacagtggcttttccactgggttatcagaaagattccaggagattcatttattcatcctttcagtcagcaaatattaattgaaagcttcctatgagctgggcactgctcacaaaaaaattgcacaaaatgttctgccattatagagcttccatcttaatcaggagagacagacaaacaattcattatataatgtattggagggtgctaagtataatggaaaaaaatcaggagggaagaggactgcggagtcccaggcaagttgtgggctggtcgcggtgactcatgcctgtaatcccagcactttgggaggccaaggcgggtggatcacctgatgtcaggagttcgagaccagcctgggcaacatggtgaaaccctgtctctactaaaaatacaaaaaattaggtgggcgtagttgtgggtgcttgtaaccccagctactcaggaggctgaggcaggagaatcgcttgaacctgggaggcggaggttacagtgagccgagatcgcaccactgcactccaacctggtcaacagagcaagactctgtctcgaaaaaaaaaaatagtaaaaaatcaataaataaggtggtaatgctgtgacaacttgagaaggtagcatttgagataatgagtctaaaatgcttagcacagtgcctgagatagagtaaacacagagcatttaaatgtaaattaaaaataaatttaaataaataggcaatccatctcttcattgtcatctcaccatccataaaacaaaactctgttctttctgggtggtatcattcattgaaattcactgggcttttgccaagcggaactctgatctttggaagggtaatttcagtatggagtgtgtcatatcaggaaattaaaatactgttatagattttcctcccctctggctctcttttggaatagcaacgactgggaggtaaatagcttagaatagagacagcaagtttctgatgcatgaatgggcaggggctggggccagagagatctctccctcggctccttcctccacgtcagcaggaaggaggcttgtagaacttggccctggagcttgcactgatcccagctgccatgaagaatagcattaggaacagaaaccctccaaggttgagatggagagaggaaatggggagagaagtcttttatgggttgagacattttgagcccctgtggcaccagcccaagggaggccaagtgtggggtattactgtctttcagaatggaatactgcttagccattcaacagcccgaggaatgctcatttctggagggcacagacctgggctatgttagtgtttggagacactaatatctctagtcttcttcccaggccaggagagattattgagcaaatgcagacttattcaggcatatttcctgaatgttaattcaagtggaggaatccaagcagtttgcaggcaacatgtccccacatatgtcttcactaacaaagtctggaattatcctttgggcaaatagaagttttctttttgctgttgactgtttttgaaaattagattcttaaataattcctgatatgttggcttgaggtagtaggcagttctcccaagtcctagaaacttgactctggctgccaaggagactaggattgattacgaaggaattaaaaggaataattgcttacatagggcttactaagtgccaatcacgattttaagtattagacaaatattaactcatttagcccttataataaccttgtgaagtgagtattattatctgcattttacataaagaaaactgagtcataggtgaaataacttgcccatggctacaaaattaatacatgtttgaaaagggattctaatcaggaaatataactattgagtctgaactcttaatcattaaagtaaagggatagtgttttagttgggtccctcagaaacagattgtgattaaatattgaatgtacctagtttatctgggacatgtaggggggtcacaggcaggggagacaggaggtgataaaaggagagggagcccaccagtgagacatatgttagtaagccagataccaaggtggtgaactgaaagttaaccctgcaggtaagctctgagatcaatgtaaaatgcacacctgagaattattcctgccaaggagtggaggagctgaggtatttatactcctgtgcccattagtcatctttcaaaggctattccagggcagaaaaggatatattaactctcagacacttctgacccaccatgcatgctggcaatgtggggtccaatattcagaggggtttctctcctacaaagatgaaggtgctggctattgggattcagggtggctttgcagaaatggtaagaagatctgaggcagttcaggtggagcaccaacatctatatcaggtatgggactcaagtctgtaagttcatagaacaaagtaaagaagattaacaggaactgaggtcctaattcctaaaagcagacaataatctttaaaccaagaacacaatagtatgcaaagctaacatttattgggtactaattgtttgccaggcactttgttaggtgttttgcagtccttattttactgaattctgaaaatgatctagagaggtagactttatcaccccgattttctggatgaagaaactgagatcgagacagtaacatccacaagctagcggagagtgggacctagatctatctgctaccaaataatggttgtggttgttttatgttataaaataaatgatcatttatagaaggatataaattacttgagggcaggaaacaaatctttttatctgtatgtcaccagggtgtacaccaatggttttcaatgtgaagtaattttatccttcagggacaaatgttctctgtttggcaatgtgtggagacagctttggttgtcatgagtgaaggtgagtactactggcatctggagggtagagtccaggggtgcttctacacatcctacagtgcacagaacagcttccttccacacagaattaaccagctccaactgtcaacagcactaaggtagagcaactgatatacacagcacttaacatatagttaggcttaataaacgttagctgaagtctgagtgttgggtggtgaatatgtagacgtgccaccctctgaagggggtggtagggactgaaaatgtaatgatacccacaaagcacttggagtttattatgcattttcatacacactatctcatttgaccattacacaatctcaaaagggtgcagaatttatggtgttatcaacatggaagaaatgaaggaaattaagagctgtgtgtgtgtgtgtagctgctgctcaaacttagctgtttgcctcagactccagggctctttaaaccatcctatacggcattgggatgcattgaaaggtgatgttttgactactaataagcgagagaagcaaagtaggtttgttatggaaaagatgggaaggtgtttatattgggatgcttttggctgcaagtaacaaaaccccaactcaaatttatgccgtcagtaatgaaatgaatttcatttattatgtagtgaagagtcttaaggtatggtgaccctaaagttgcttaggttaactgaggagccatggctttaagaaaaaaaaaaaaacaatttaaaaatgtatttcatccttttttattggctgcatcctcagggtggtgataagatgtgatctagatatgccagcaaccagaaagagacactttcagttttgtagcttcttaagagtgagagaacatttctcaaaaggcctcaatatgacttcctctcatgccacattggtcagaactggatcacgtgctcacccctaaaaccatcactggctaaggcaatggggctatcatattggcttagagcagtggttttcaactggggacaattttgtctttccctccccgaagggtaatagtctggcgatatttttggtgttcacaggtaggtgtttgtcgggagatgctactaatatcagcatgtagggaccagggatgctgtaaaatatcttacaatgtacaggacagcccacccagcaaagaaacacgatctggtcagtagtgcagaggttgagaaaccctggcatagggcaaaagagatttaatcctgagcctcctgtaggcaagtaagcacttgaacaaaatgaggactccatcagcttggaaaagggtggcatggaagttgggtggggcaccccaagatgatctgcttcaggaggactttgcacatttttgatgactgatgtcataggagacaaatacagctcttttctgcaaaacgtttctggatgcctctgtcagacagtgccatggccagaatgggccattggtctgacccagtctggcatttcttatcttcatcaggctcactgccaaaccccgaggataggttgtcacctctggcagaagatcagtcaggattaactgatggtgaagctgtgtcccactttgaacctctctctcacgtagccagagcagtgcagattcggagtcttaggagcagaacattcgggagccagtgcaaaaaaaaaaaatttgcaagaggcctgagagagagcctgctgtacaaaaggatgtaaaccagccagagacccttggtaaacataagaaggaagaacatatttaccttgcttctatttagggaaagaaaataatactttcctgaaggaggccatctgtgttcttaacaatagtgcttggcagttttgagctcgtgggatacattttcctggccagatcttaccagaaatccttgaatcatgtctgcaccctggtgatggaaggcaccaaggaagacttcggccaattggcaaggaactgtcaccaacttgaagaagcctatgacatcaactaaagatcctccccatcaaacattttcaaaagaatattttgaacaggcacaggttttttttctttgccaggtgataatgtacggtaaatgttttattcaaaagcagtgtctttgaattgctcaataattccctggtcattgattagggaatagtaacacatttaacccttgactaaatagatcacagttgtcacacatttatctacaaatatttgaatgctcgccttgtaccctgtgatttatgttagagataagaatggtgaaaaaatcaatttcttgcccttggtaacttacagtctaaaagaggaatcagattcgaacacatgattggaatgtcgtgggatgagagctgtcataactgttgtaggaacacagcagacgtaggctatcctttgaatgataaacgtgtgcatccctttcataacatttattgagcatctagtatgaaccagacattggtgcttagggaatttttaacacatctgattgtctaaaaacttttcaaaagcaaataatcataaagcaataggatgtatattaaagatatgtatagaacacaatgacagcctagatgaagaatgacttaatttgggagttagggagtggcattaggaaagacttcataaggactcagcaaagacatcaacagaggaaagaaaaagcataaaggagggcaggcaagtcaaacttttctgtgcagcaaaaagccatgtacacatgattttaaaaatgatattgtaggccgggtgtgaaaaaatattgcaggccaggtgtggtggctcacacccgtaatcccagcactttgggaggccgaggtgggtggatcacgaggtcaggacttcaagaccagcctggccaacattgtgaaaccccgtatttactaaaaatacaaaaattagctgggcatggtggcgagacggaggcgggagaattgcttgaaccgggacctgggaggcagaggttgcagtgagccgagattgcgccaccgtattcctgcctgggctacagagtgaggcactctctgtctctgtctctgtctctgtctctgtctctctctctctctctctctctatatatatatatatatacacacacacacacacacgtatgtgtatatatatatgtgtgtgtgtatatatatacatatatatgtgtgtatatatacacacatatttatacgtgtatatatatgtgtgtatatatatatgtgtgtgtatgtatatgtatattgcagcccccttccattgatcaagcagtgggcaagtgtatattaagcatcaaatgctgtaatatctaggctcaggggctgaacaaaaggagtatttggcacaggagtttgaccttaagaaggaggtagcttggctgatgggggcaggttaagatgcttgaaacaatttgaaaacccttcagcactaagctgtgtggttctggttatcagtacagtgggggttcagagcagggagccttgactgtgggctagaatggttgcagaagcttccctagctgagataattgaaagttggtggcatctttgtaggatactgagaaacaataccatatatagtgagaagtggaaaatcacatcaagacctgtcctgctttggaaggcatcatggcagaggataatgtttagctccacaaaaagataaggaggtagcgagtgagcatttaaagtttgggcttgctgctgatgtgatcccggctgcctttctgagcaaatcctggggtgctttcttagcgtgccactttgatcatcagcctggtgggttggaacgaatgtcaactttgagttcaaaggcctgtactgaatcctagcggtgcctctcactagctatgtgacctaggaaaagttatttaacggcatcaagcctcagtttcctcatctgtaaagtaggggtgataatatctaaattgtaggatactagagagattagaaagaatctgtaaaaagtgtctaagatactaccaaatgtaaaatgcagagagcccattacaagtagctccttgaatgagttggggtatgtttagctgcaagtaattatgagaaccttgactcaaagtagattatacgatgtataaacttattatttcacatgaccagaaactctgacgtagatcaaagttggggactgatggattcagtggcccagtggtatcaacaagaatccaccttcttcccttccgtctgttctaccatccttagtgttgagtctactcataggctggttccaaaagggttcctgaagtttgaggcattgcatacagacacaaatgtggcagaagagagattttatcttcctatggcccccttaggtgtgagttagtaaatgtttccccatgccgcctccatcccaaccccagcagattcctcttaatatatcattgtccgggattgggtcagcatcagaactatgtactgatggctgtgttgtgtattagttagctattggtgcataacaaatcatcccaaaacttagaagtttgaagcaacaagcatttattatcttactgattatgtggatcatattcgggagcaacttagttgggggattcttgcctagggtctcttgtgaggctgtggtcagtacattggccagaggtgcagtgatctaaaggctggactgaggctggaggactggctggcatggatggcttgtttccgaggctgctggcagggggcctcatttattgattttgagaacctctccgtggggctgcttgaagtccctcatgtcatggcagccaacttcctcagagtgagtgatccaaaagagagaaggcaaccacattgcctttgttgatgtcatctcagaaatcacactgtcttttgtcccccactccattcatgagaagagagttgccaagcacacagggaggattaagctttaccttttgaaggaggggagtattgaaaaatttgcagacatattttaaaactaccttatgtgtggtacaacagaaattccattgttatctggtggtcagggggtggagtgctttttttggagccacctacaaggtctaccacactattgctattaatcacctaaggaacatttatggagcccctactgtgtgcaatcattgcacaaggaggactcagacatgagtcttgctaattatggtgtaaagggagtgtaagatgcaccgggactatattgcgatatacaaagctgaatgtggaaaggaacaaataaagtaccagggggtgactgcagattgcagaaggaggtggtttacttccaattagcatattcatggaaagacttcactgagaaggtgggctttgaactgagctcagcggagtaggttggatttatacactcaaggatgggtatctgggttggtcaaaagcatggtcataccaaagttatcagctagcaattattgagcacctagtctgtaccagacactgaacatatattatctttaactcttattgcatccctgggagacaggcaatattactcccattttacagatgaagaaacaagcccggagacattaaatgaccccgtgagaccatgtagctaggaagaggccccactcagagcccttacctaagagatacttgtgttttaaagaactgaggggacaccaccttgccttaaggaacttccctagcttgttcaaagtaaggcttttatataacaatttagcttcagggagtaggtacagcagaatgagtaatctctttacaaaagaatttgtcattttattgaacctttacagaagattctccttaattatcaagcccacaccccacccaatacattgaaaatatgattcaaaatttattaagatttactttgcacatctttccccctggaattcctactctgcgttataccttttgtaggctgggttgttggaagaattagctggtaaaaatgagcttacgaaaatgggaaggtctcatggaagaagtgaagtcttacacattcccttcacttttttatgataaaggtgataagattcattaaagtaaaaagacattaattgctgctgattaacatctggcactctacccactcagaccaccacctgtgtattggaggtgagggggtgccttaacctgggttactttgccagggggctttgatgtcaggtggaggcagagaaggaagggcttaggataagcacagagaaagccacctcttccagcctgcggcagaggggagtgttcctggctggggccgctttcgcagagcatagatacgacggctcatcggcacagctctgacctgccagcctcccccacagctgcctccagcctccagagcggcttattcaggaacagaggcagatgcagtgtcggagcgcagctgcgtgagggttgcgtgggtgtgtctccatgggagtgtgtgcagtgtgcctatggtgtgtgtatgtgtggtgtgaatgtgtaggtttgtgtgtgcacatgtgagtgtgtgtgtatttgtgtgtgtatgctatgtgtatttatgtgtgcgtagttgtgaatgtggtgtggatgtgtgttttgtgtgtgtgtgtgtgtgaatatgtgggtttgtatgtctgctgtgagtgtgcagcattatgtggtgtggatgtgtgtttgtggtgtggatgtgtggtgtgaatgtgtgttcatgtatttgtgtgtggcgtggatttatatttgtgactgtgttcatgtatttgtgagtgtgtgtggtggtgtgtttgtgggtgtatttgtgtgtgtggtgtggatgtgtgtggtgtatttgtgtgtgtggttgtggatgtgtgtggtgtatttgtgtgtgtggtgttgacgtatgtgttgggtatgtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgtatttgtgtgtgtggtatggttgtgttgcgtgtgtgtgcagtgtatttgcgtggtgtggatgtgtgtgttgggtgtgtttgtgggtgtgtgtgcactgtgagcgtgcgaagttgcgagcgtgtatgtatagtgtggatgtgtgtgttgtgtatttgtgcagtgtggaggtgtattgtgtgtttttgtgggttgtgctgtttgtgggttgtgtgtgtttgcatgtgcgctgtgagtgtgctggattgcgagtgtgtacctggtgagtgtgtggctgccgcacccctcctctgagcggtgtggaccaggactcctctctctctctctctctctctttctcccccccctccccctccccctccccctccccctccctctccctcccttgcacatttgctcaggctcctcattgctgagggagggagggggcttctgcccagcacctggtccttcgaaaggcccctcccaggagtagagcgagcagaggccccgctcccgggtgcggaccctccccgcgcagaccctccccgcgcccaacgccaccggtccctcccgctgctgcgcagtcctcgctgccctctgttctgtaggtggcagccttggtaagccttgctcccatcctgcccctagggagaggagcttcagcaaaagacttagagtttagcgtctcgattttcaaacaaacaactctatcttttacagtttaaaaatgaaaacagaagatccagagaatgcgcttttaaacaaagccacatttacctgagaccctggggatagagagcaggtttttggtgcaggtttggagtgcagttcatccctgcccccgctacgaatgcacattcgcattcgcctttgagtcgtgagcaagagagcatctgagaaaacacgctagatgcagccaaacctctttaaaccctggcaccaaggaacaagagtgggtcccccctctgcctttcttttccactcactgtctatcatctagttgatcaacagacatcagtggggacattggggggtgggaggggatgtctgctccctgccgggcgggcactgtgctagcgtcaggggcacaaaatagaagcagacctggtttcagtctgatgtgggaaagagctaaagtaaacacgcagtgaatttgctgctgtttgggggatgagggggccagggggcttcctggaggaggtgacactgccctgatttttgaaggactagttgcaattatctaggccaggggacatttggcaatatctagggtgggtttttgttttttttgttttgttttgttttttgttttttttttgagaaggagtctcattctgtcgcccaggctggagtgcagtggcgcgatctcggctcactgcaagctccgcctcctgggttcacgtgattgtcctgcctcagccaccctagtagctgagactacaggcgcctgctgccatgcccgggtaattttttttgtgttttttatagtagagacagggtttcaccatgttagccaggatgatctctatctcctgacctcgtgatctgcccgcctcggcctcccaaagtgctgggattacaggcgtgagccaccgcgcctggccggcaatatctaggtttttctgttgtccaaactggggataaggtggagttgctactggcatctagtaggtggaggacagggatgcttgtaaataacctacagtgtgtgcaggacagccccctccaatgcagagttatccagccccaaatgttcgcagtgctggggttaagaaacacaggtctagacaagaggaggaaaagtgctgtggtttgaatgttagcgtccccctagaattcatatgttgaaatcttgatctccaaagtgataggctgaggtggggtggagcctttgggaggtgattaagtcatgaatgggattagggcaagccaggcaaggcaaaaatctctagacccttccactgtgaggacacagtgagaaggcagtgcctgtaatccaggaagctgaccgtcaccagacaccgaatatgctggcaccttgatcttggacttcccaacctctggaactgagagaaataaagtctgttgtttttacgcgcagtttatgtgttttgttacagcagcctgaacagactaaggcagaaaagcattccaggggattatgatgtagactgggaggagctgcagacagctgggtttgtctggaaggactgctgggtgtgggagagggcttagaaatgggagtagagccaggcacaatgattcatgcctgtaatctcaacaatttgggaggctgagacaagaggattgcttgaatccaggagttggagagtagcctgggcaacatagcaagaccctgtcactgtaatacaaaaattagctgggtgtggtggcatgcgcctgtctcagatactcaggaggctgaggtgggaggatcacctgagtccaggaggtagaggctgcagtgaactctgatcactccgctgcacaccagcctgggtgacagtgcaagaccctgtctctaaaaaataaaaaccaataataaaagaaataggagtagagaagctgtcagatggagatgaatgaagacccttgaatatcatgctaaggggtttagactttatcttagggaaggggaaacattaaagtgttttaagcaggttttaagtaacttagtccaatatactttttagaatgatcactctggataatgcgtgtcgggtgcggtggagggtggcagggctgcacacggcggggagaggcttcaaatgcgggctgttagtgcatgcaagcggagaagtgatcaccatgtttccacaaaagaacttagaattggtttagttaatgcagtgcaatggaatgcagttatacaacagggtcgtttttatatttcaagaagaagaaagcaatgggaagaaaagcattagggagatagagttttgcatggctgccgtgccctttcatttaaatgaccgaccaggtcagcatgttgcataaggacacgggcaaattacttctgctaaccgaggcggaactctctggtagcccaaattccagtgctccatccatccagggaggtgtctatgagatgacaggtcatcaaggcaaataatgagttgtttgtctccacggcatggatcctcctgggatcagaggtgtcatctgacaaggcatcatgggctgtatcccccaccaaaacaaaatatatgttgaagtcctaaccctcagtacctcaggatgtgaccttatttggagagagggtctttacagaggtaatcaagttaaaaggaggtcattagtgtgagccctaatctgataagactggtgtccttataaaaaggggaaaattggacacagaaacagacatgcagagaggagagatggtatgaagatgcatacaatcttaaaaaaaataatactggccaggcacggtggctcacgcctgtagtcccagcattttgggaggccgaggtgggcggatcacgaggtcaggagatggagaccatcctggctaacacagtgaaacgccatctctactaaaaatacaaaaaaaaaaaattagccgggcgttgtggcgggtgcctgtagtcccagctactccagaggatgaggcaggagaatggcgtttgcaatgagccgagattgcgccactgcactccagcctgggtgacagagtgagaatccatctcaaaaaaaaaaaaaaaaaaaaaaaaaagaaaaaaaaaaagtaagtactaatatttttattatggcataaatagaacaccatctatgagccaaggaatgcctgaggctaccagaagctggaagaaaggcatgaaatagattgtccttcagagactccagagggaaccaccgacaccttgatcttacactttcagcctccagaactatgagagaaaaaaattatattgttcaagccaccaagtttgcagtactttgccacagcagttctagagaactaatgctaataccaatcacacaaagtgattgaaaaggggagaagtcctggtgaatttcagaaaaacccctgatctcagttatgcaagtgagatcatcaggggaatctgaatcaatcatcgtttttacctgaaagcagtaggcagaaaggaaattaaattccatagaaatccattaatcgtgctgggcatggtggcttacgcctgtaatcccaccactttgggaggcccaggcaggcggatcacttgaggtcaggagttcgagaccagcctggccaacatggtgaaaccccgtctctgctaaaaatacaaaaattagccaggcatggtggcaagcacctgtagtcctagctactgggaaggctgaggtatgagaattgcttgaacccaggaggcagagtttgcagtgagccaagatcataccactgcactccagcctgggtgacagagtgagaccctatctcaaaaaaaaaaaaaaaaaaatcgatcatccagtgcagtggttctcaaagtgtggtccctggaccagcagcatcagcatcacttgggaatgcagattcttgggcttcccctgagatctcctggtcggtgactccagtgggtgatgcccatgcacactcaagtttgaaagcccctggcctagggtctgtgagaccctggagaagtcaggcagagcttcacaggggaggtgacacatgagatgtgccttgagggataggtaagggctttgaaaggagccagggaaggacatttgaaatggagcagaggcagggagatatagatgtgtgagacttcttcagaggagcagtacagtttggagggtatatggagaggagggtgagagaaaggaagtacagacacatggtgggcagtgaggatgggtggggagtggtggctcacatctgtaatctcagcattttgagaggccaaggcaggaggatcacttgagtcttgacatttaagaccagagtgagcaatatagcaagaccctgtctctacaaaaaatacaaaaattagccaggtgtggtgacgtgtgcctgtagtcccagctactcaagaggttgaggcaggaggttcactggagcccaagagttcaaggctgtagtgagttgtgatggtgccactgcactccagcctgggtgacagaacgagaccctgtctctaaacacgttaaaagaaagtgaagatgaagtcaaagatgttgtcatgttgtaaaggatttgtgagccaggatgagtttatatttaatgggggccgctgaagagttttagaaagattactgtaggctaaagtatcaatgtgtaatttgggtatatgtgtgatattcaaattagctgacctattaggactgtctcagccaacaaatcactgaatgcagacagtcaaccatgctttctgaaaatgcaaagtcctagtggttcttgagatgagtggaggggtcacaccaatgtcaggagaactctagatttggggaatctttaagaaagccaaggaccagtaagtctcctgaatagatagaccagttttcttccacctgggactattaaagatgagtgacacctttacctcttgaccttaatcattcattagccagcaagtcaacatccttctcaaagtgtggctccatcagttctgagccagtttttttttttttttttttttttttttttgcttttttttgacgtggggtctcactcttatcgtccagcctggggtgcagtgacacgatcttggctcactgcaacctccgcctcctgggttcaagcacttctcctgcctcagcctcccgagtagcagggactataggcatgtgctaacattccggctaattttttggatttttagtagagatagggtttcaccatattggccaagatggtctcgcacttctggtctcaagtgatcagccttcctcagcctcccgaagtgctaggattacaggcatgagccaccatgcccggccctgagccagttttgccccaagttgctaagcttccctgatcactgaccagtctgaaggcagataaacacaaagcctttgtctatgggacacttatgatttggttgcagagaaggtggaccttcacactgccaatctcagttctcacggccgcctggcatcaggaaggcattaatctctgccaaggctctgtcctcttcacctttcagcaggtgttccttgctggttgtttggcccggttgataggaaaaaaagaagagagagtgggcccgtgtgcctctgtctcctctttgctcaatgacccaagaaggcaggagaaggaaggcacttctcagctgcctttcctatggttggctgctgggctgggatggagctggggaacttacctcttgtgacgaacgatgaagaagcagggatttcatgcagcatcagcatacgcacaaggctgtgttgggaagaacaaggacagggctccagagaggactgactgcagctgcccctttaatgctggtcgcacatgcttgcttctgtctggctcccctcccggactgcatggatagctttgttcacacctgaatgcctggtgcctgggttccagaaaggcatagctttcatttctgagcattttatatgtgccttgagattaaccatcaccatgaacagatttggaaacaggtttggagggattacgagacttgcccaaacacatttagcttgatggggagaagatcatggccctgttctaacccctcactctcagttttgtttcatcacatcatcctgtttattttcatcgtagcttgtatcacaattgccaattttcttgcttgttgttgtgtttagtgtctgtctacccctccaggctctgggtttctgatagcggcacctgtgtttcctgggtttaccttggtatcctgagttggtaacacaggcccatcatacagccaaagctctacagtgtttgttaacaaaatgaatgaatgaatgatttgaacccagacctatttggccaaagcctcactctgtaacctctgctcactgcagagttccatgtggtacaatcttgcttggcaaatgttgatggaattataacagttcacggttggtaggtgggggtgtcagatacatgcatctgggaaagtcacagaaattcaccccaatataggtataatcacgtgcccaggaatgcagggcaaactttgcccacaggtgcaaaccagctggggcacctgtggtatcctaggagcctggtgtgcttaaaagcatggtgtagtcatgggttcgagaaactctccactgggtaaggacactggatatatggacacaagaaactctccattggttaaggacaatgataaggaaactctccattgggtgaggacactgaactctttcacatgagcagagacttatgttaggagttgcagctgggagtcaggcagaagctatgatgaaagctctctgggcctcagtttccccatttgttgtttggtgtgtgttccaccactgttgtttaatggctcagagtggagaccggcattaaactgtgttcgttcaaccctgaatccaccactttctaggggtgtgcctactggaaagttttcattttccttggtgcctcagttcctcgtctgtgaaatggggataatgatagtatttacctttgaaggtgggttgcaagggctgaaagttaatttatataaagcacttggaacacatggtaaatgtctggctgttttgatgagaagattcaatgagatactgacttttcataatgcaaaaggcgctaaaagaaactcagcagaggtggcatttagatcaaggtatctctgtggaaggtatcaaattagatgaaaggcttagaggtgggtagacccacatttaaaaaaaatcacttaatttgtacagtgtgcgccaattgttgtttataaaatatcatccattttatgtcattgaagtctcccatgtctctctggcatagccatcgttacccaaggctcaacaagcttgaagtagcttgtttgaaggtcacagctctttagttatttgttcatggatttcttgaaagcctactatatgctaggctcagcataaaatggggtccaaaaccaggtgctgtttctgctcatgtgaatctgacagtctagagaaggagggacatatttcaaaaaagtatcatgcaagtaaatacgatgcgctgtaataagtactgtgtgacccacccaggaaggtcagagaaggttccctgaggacatgggctgaaactgagatgtgaagactagggtgggtgacagagggaagggaaaagcattgcaggaagtggaaagagactgggcataggccctgtggccggagggatcatagcaaatgtctggtctgaaaaaaattgcctgagaagaccctggtgcttggagggtaagagtgaaggaggtcagagcagaaccgtgctgagaccctcaggccacatttgggtgttgcatctttgctataagagcagaaagaaaccactaaagattttaaagccagggtggatggtggtgaacatgagatttaccttccagaagcatcctctggtggccacgtggagaactggctgcaggggagaggagtgcaggcagtaagttacagttgctaagaaacattcaccattccatgggtaattattgtgcaccactgtctacgggctctctgctgggtgccaggaacgcagcactgaccacgacaaagcccctgccttagagagatgacgtttctgtataaggacagagacggcaaatggacaagcaagtgaatgaatgtggcaggaagcagtgtggctgggaagaaatacttaaaagcagggcgagagactagagcatattggctgccatttaggcaggaaaaacctcttgtgctgacatttgaagtgaagggacacccatgtgagtatctgggggaagggctttccagggggcagcacagcaatggcaaagaccctgaggtgggaacaggctcagggtattggaagaccatcatagaagtcattgtggctgcagagaaggattaaaagaggcagattgtaaaggccacattgaggatttacgtattttatttagagggtgagaagaggccattggaagccagatctgggaagtgacgtgaactaagtgcgattccagcgtaggcttcttctcttctcaaattctggcccccacaccactttcccgagttcagatttctccctggcctcatgatagtagtatttttaacaagtcagcagccagtatggcagagcctaccccctagatggtgcatgagacataccaaagaagcttcacttttcacttttttagggcaacaaataatacatctatttattgctttttccactagaatgtgggcactttgacagcaattttgctcactgctgtatctctgaagccttaaatagtatctgagattgtagctgtcgataactatttgctgagttaatagatgatcaccctgcacttaagtttctatgtaatgactcctggccagagagcagagattcagcaaagaagaaggtaaaaagaagggaaagatgagagaggcccctttataactcatcaatgtaaaaaacacaaaataaaaagtcttgagcttaagagagaatgcagtagaaaacatcaacaagaaaacctttctgtctgaaaacgcctgatccttgtgtgagacctttccaggatatgtgggttttcaggtagcatcttcacccccagggcaacagtaagtgcaggcaggagaccaaaaccaatacccttgccctcatccccatagcaggggtgaagtctgagcacgtgactggacacagcagccacacgcctttggtgtcttccaaggaggcagtgtctcacctgtgcacatgctattcatacaaacacaacatgatctggagcagagaagggcataggaaactcagcaggggtatattatattttctgccagaactgacagtaatattgaatgatgagagaaatgcagtaatattgaaggacgagagaaatgagagttgtataacatttaatgattttttttttaaaaaatcacccaagaacgtgaagatgatttgaaacgcctctgaaaatgatcccttcctgtccataggcagcccagcttgcacatagcccgtgcttgctttacacaatcagtgataaactttgaagatgctgcagcctccattgagtttctttttgtatatatatacttttatttatttatttatttttttggagacagagtctcactctgtggcccaggctagagtgcagtagcgcaatctcagctcactgcaacctctgcctcccgggttcaagcaattctcctgtctcagcctcctgagtagctgggattacaggcatgcagcaccacacctggctaatttttgtatttttagtagagacggggttttaccatgttggccaggctggtctcgaactccagacctcaggtgatctacacccccttcggcctcccaaagtgctgggattacaggcgtgagcattgtgccaggtctgagtttctactttaattggctgccttacgcaaaccatgaagaagcccctgcatgaataaggcaggaaactttttagtcccagactaggtgagacatatgccgtatccccaaaataaatgttggggcattaacttttaattgctgcattatgttttactgtttactgttttatacagcattcttgttcttttttttaaaatactgtttttcttttgagtctacgtgactgcagcctttacgcctctaatcccagcacttcgggaggccgaggcgggaggatcacctgacctaaggggtttgaggccagcctgaccaacatggagaaaccctctctgctaaaaatacaaaaatttgccacgtgtgggtggtgcatgcctgtaattccagctacttgggaggctgaggcaggagaatcccttgaacctggaaggcggaggttgcggtgagccaagattgtgccattgcactccagcctgggcaacaagagcgaaactctgtctgaaaagaaaaaaaaaaaagtgtgtgcaattggggtggggaggtatagtgctcttcttgtagactctctctcccaattttccatagataaatggattcagtggggacagaaagagggccactccagctctggggagaaatgagagagttgggaaagtgagatccctctgcatttggttgtggattattaggagactaagaaggaaaccaaagaggactccccctttcctatattacttgattaacattagctataataacaaataattcctgcaaaattttaatgccttagcacaagatttgacaagctgtggttctccagcccaatttgggcccttgtttgtttttgtgaataaagttttattggaacacagccacacccatttgtttacagatcatctaaggaagcttttatgctatgataacagagttgagccattgtgagagagactgcatggcctgcaaagctcaaaatatttactctctagctctttacagaaaagtttgctgacctctggcttaacaataaagcttactttttgctaacctgatggtccgatggtgggtattcctggggtcagcaggcagcttctcttcatgtggggatttaagaactcagtctccactatcttgtggctctgccatcttctaataacttaggattttctgcaagcagccagaaaatccaggaaacaggaaggagagaagaaagggtgtcctatctctccaaaactctggcccacatcctgttggatgaacgagtcacatggctacacccagatgcagaggtgctgggaagtgtccatggctgggcagctgcctcccagcgacagtgccacactgtgtaaatgggagcacacattcattttggacctgtagccatcaccaccatgctctttccctactatgccagatacctgcatttgaatcatggctgtgccacttactgactgtgaaacttgggggaatttaacaaaacactctgtgtgtcccaggttgctcgtctttgaaatgggcacaatcacagttcctgcctcatagagttgctgcaagcagtaagtgacatattatttactgctcaacacagacctggcgtggggcatatgtagaacatgtgtcactgatcaaggatgatgtcggcattttcagtgactagacaaaaaccagaggcactcggcaacatccttcagagcactttgtaataagtccccaacctcccgcactgttctgtgagaagccaggtggatgtaggagaggttccctggagagattagtccaggctaaggcagtggggacagctcgagggtggaaagggaactctgcccaaaagacaagggtgcttttcggaatgccttggacgagggaggagagaggaggagcacgcagggcagaggaagcacttggttggtgggtgcagcatcatctctggtttagtcctttactgcatcaacattgccttgcttgtgacgagtaagggtagggacagcttgtggatgggaagtcgcagaggcaccaggccagcccatgctgaaagctcaccaactccagcactcaccagcgaggactcctcatgtctcactgggttccccttccatcatcagaagccaaggatgtttccaaaatattccatcgatgtccagagcagcactggaaggtagtaagagcaggatttgtcatcttattttgcatatggctagatggaatcactgagagacacaccaacctcactcagctagtaaatgcagacccaggatgggcagccaggctcctatgacgctgtggctgtggatgttgcttctgaaacaaggcaggatgaacgttccttggagcactggcagggggggacattcactatattctaacgttaatacttgggttttcttgatagctgagatgctaaactttgctgtgagagcttggaaaagtctgttctctctgagcctcagtttcctcatctgtaatatgggcaactcctttataagatcccttacactttatgtggatgctaggtgttggggagggctataaacaacttattttctcatgtaacaaatgctacttgagccttcaatgggctgtgcatgctggagatacagcagtcaacaaacctgtcttctttgtgtgaggagaggccaacagaaacataacaaatatttaatgtgtcagctgataataagcactaggcaaaaagtggattagggaaaggcaaaaggaagcccttgggtggtggtgcgatggggttttgatttgaaatagagccatctccacgggagggtccacttgagaacaggcaggtggaataggagagaacttgatcgtttctgtgattgagaaagagaggggactggaagtgcagttgttcctgaggttcgttcacctgaatctgaaagcacctgatttcaagttctgcattgttttggggtgggaggaagtgagagaaaagcagacctggttcttgtttggcgtgtttctcactgagtggagctactaggctttcctggggccattgttaagagctgccatggcccatgtctgctggtggtggtcttctttccttgttctctgcagtgccccccagcttgactgtgcagtgaatggagcagatccatgttcttcagttgacagaaagggagagttagagatgaacctaatgccctgcttaaatcagagggcgaagtgatatgaagtttgaatttaggaaggacttttttttttctctctctaatggcctggagatatcctacaggctatgctgggtactttgcatagactaccttcaagatgcagagaaaggaaatgcatctaatgctgttagtaacaataataaataatagcaatagattccctgtacatgctggacagtgcaccaagcattttattttatttttcacaataataccatgaggaagctactttttattactcttgttatacagaggagcaaactgagccttaggaaggtgacgtgacttgccccaactcatccaattagtgagaacctaagttgggatttgaatttggctctcaatctccaagcagtcatgtgtccaagtggttgccactgggtgggggattctggaagtcctttctgtgtcctcatgctctagatatttttttatttttttctgtagtgagcatacagagattctatggccaggaggaaggttgggctgagaacagtgatgatgtagccagacagtattgtgtgagtcaaagaggctgccttgaggttggctccaggaccctggctacgaagctcgctgtgcctgacttcctcaagccacttgcctcccattttttctttagaggaaacttccactgcctcggatacataatgtcattgcaatcctgtctaaagtctggcctccagggtttgcagtaagatttctctgaagcaaggctgcatctctacccatgagattttgcatcccctagcctgcctgtctctgccagccgatatagggaggcaggggatggctcacatcagtatccttgagtggaccccgctctggtgtctttattttcatctctgggaaaaagttatattttccctggagtcaaatgaggcggtattccagcctccttgcttaaatatatctcaaaggttctgctgtgtcaggcatggtgattcacgcctataattccagcacttagggaggccgaggcaggaggatcacttaagcctaggagttcaagaccagcctggggaacacagggagaccctgtccctccaaaaaaaagaaaaaatagccagatgtggtggcataggcctatagtcccagctacttggaaggctgaggcaggaggatgcctgagcccaggaggtcgaggctgctgtgagttgtaattacaccactgcactccagcctggatgacaaaacaagaccccatctcaaaaaaaaaaaaaaaaaaaaaagaccctgctgcttccctgatctggcaaattaaaaatataaaacctttcgttaaaccccagagccacgagtttcctataagcatggtagttttatgattcagctgcaccattagtaatctccagtcttcttagcccctcccatctctctgccacctctttcaattttcttctttactcattcctctcttctttcctcctctcttttcctctccatctcctctcatctctcgattcctctctccatcatcctctcttccctcttcctcccttccctcttcttttctctcctctctgactcttccatgacttatctccatttcaactatgctttttttaaaaaattcatttaaattttggattattttgtgggaggctctgttttgaatttagtgcttattttatttgctcaaaaaatgagcagccagccaaccaaatagccattctgtgtctacttgtggtctctcatgccatccaacagctcttacttgatataattgctaagcagtgagaaagctattgtgcctacctcttcagtgaggagtgagtgggaagttatggctgaacgtgggctttctctatgttgtttaggcttctcatcttgacactacactaaatccatggcttgaatgggtctgcaaaatgagagtctctaaaagccagacccatcttggcatatcttgtgatctctaagcggcaatgggagacagagaagacgtggtaatgacatagtttagctgagactgaaacatagttttgcttaaaactgtgcgtgacattggctgggcacggtggctcacgcctgtaattccagcactttgggaggccaagacgggtggatcatgaggttgggagtttgagaccagcttggctaacatggtgaaaccccatctctactaaaaataaaattagctgggtgtggtggcacacacctgtaatcccagctactcaggaggctgaggcagaagaattgcttgacccaggaggtggaggttgcagtgagccaagatggtgccactgcactccagcctgggtgacagagcgagcctccgtctcaaacaaacaaacaaacaaacatgcataccattaatgagaccacttgtgcatcattagtctgcaatgagccaaaaatccaaatgaactggtagatagctgatagaagcctcatgggctcgatttgagcccttgtgtgtcctagggagaggtgaatgccatggttcttaagaacatgtctttggattcgaattctggctctgaggacaagctatatgacctcggatgagtcatttaacctctctaagccccaacctgttcttctgaacaagaggcacaatgacagtttatggggtggattaaatggcataatgtgtgatgtacctggcctaaggtttatgcttaataaatatgtgtcatcactgcaatgttttgggatgttttctctgtatgtaaaatggtgcccatgtccacctccctgagctattgggggattaactgagacactgcatgacaaaactctttggaagtccagtgcaaatgagtggacttgtgacctctcacattatttctgtttgtaggttcaactggcaagccaatcatgctcatttatagcgacacgcactgaaaacttttttctcacaagaggttattgaaccaagatgagaggaaataccaaggctctttttggtgttttaattccttcacatctatttctttcatcaccagttaatgaggacttagtactcacatcagcagtaagagtagaaaatgggctcatattggtgttcgaatcctgatgtgttctcttactggttttaagatttgtgccaggttactaatcaaatcttaaaccttagttttctcacatataaagttgtaattataatacccacttcgaagggtcattgtaaaaaccacacctgaatgtacccacatatatacagacacaaccactaaagaaaatagattatgtaatatttattcaatgtattttacttgtctgttgtttatagagccctgcttcagttggatgagttatttcagatttggaagtgtctcgttctctagcttgggaatgcagctgaacactgggggcagctgtggccctctttttgtttgttgccaactcggtctaagatcagcctgagtggactcagtcggaatctaccatctcaataccaggtggttaatttctcattggtagagccctctttttacaggcttgggaagtctggctgatcatctcgggttgtttaagcaagaaagttaagctatatccccctgattagtaggattttctcctttagattcctgtgttaatctacaaactgagcagtttatccctggtagacattggaataccaggtgtggtagtcatactgattatgcatgtgtagtactttctagtggtgccgttcttagaccacattttcagttcttgagaacagtgtcattgttggcatttttctcccaaagagctggcataatactcaaaagaaacggggtcttattaagtggttgttcattgactgataggaagagaactgtgggaatatatatttatggaaaaacagttccaaggtattcattcactcattcagtcactaaatacttatttatcatcctcaaaatgtcaactgtgtgctaagtgttcagactggagagaagaataagacctgctatggggaagcactcagtctgaggtgagggaagagagggtgggaaatagactatggtgcagcactgatgtatgttttatttttgtttatgaaatgttgtagggatgtagaggaaaatgaaactagcatcagtgctggactttaaagcgaggctaaacctccacaggtgaaggagatggggaagacattctagacagaaggaagagatttgtagacatgtcaaggtgggacatggaggaacagcaagatgttctgtgtggctgggatggtacacgtatgtgcgtgcttgcgtgtgtgcgtgtgtgtgtgaatatgtgcatgcacatatgcatgtgtgtgactctgtgcatgcatgtgtatgtgtgtgtaaggctgagctggaaatcaaggcttgcattctattctgctagggagtttgtattcacttattcaacacatatttatcaagcacctgctatatgttggatgctgtggtgttttgatgtgtgcctcataatcacagtaaaacctccacaggtgaaggggatagggaaagacattctagacagagggaagagatttctagaggtgtcaaggtgggacatggaggaacagcaaggtgttctgtgtgaggtattatgagataggtattatgaccattactctcattttactaatgagaaaactgaggctcagagaggtgaagcgacttgcccaaggtaacacagcatgatgatccccatcactgggggcagagagtccactgagaagagaagttaggcagatggggcagaatgcagcctaaggtcactcagagtgtcctgaacgggcttgatggacattgactttggcagcctcctcatttgctccagccccactgaccctgtctcccctgacaggggagacaaccccaaggtctcccctgctttggggcatttgcatatgcttttctttccacctggaatgctcttcccctcattccctcccttggctggctatttctcatcattatccatcatctcctgagaaagggcttgcttccgctcctgtcaatcccctcctgcctatctttgctgtcaatgtggatttcagcttccttttttatttcctttttcaaagtctaccattggtaactgggggaatgtatcacagttcactgagtggcgaagagcttggagtctgcggtagactgctgaggtgagaattctggctccaacacttaccagctgctgggatattgggcaagcccttcacctttctgggcgtcattttcctctgctataaaatgggaacaatagtagattcccctcacagggccatccaggagggattccaggagggcagagtctgacacaacatagatgttcaataaatatgtgttgaatagagccgtcattgaccagtccattcattcactacctaggtctcatggctgccttagagctgggaaggtacaggctgcttaggggacccagctgtggtcttccctctcccacccacccagtgactgctctccaaaggctgtgggcttgcttctggggattctgccagtcacctgccccctgaaaggacttctgctgaattgcagccaattagggctgattagatgttaatgagtctgaagctgcttggtaagcggtttagcacaaacttggaggtgagagggagaagtttggggaagtggtgacatcatgcacaggctggagaagtgcaagggcctgaccaagacgtacagcatctcagttgtctgtccagactgtcctgtggctctttatgttggagctggtacaggtaggacccctgctaaacctggcaggggagtagcaatgataataatgatgatcataattatagtaaaataatgctttttattgagctcttaacatgggccaagcactatgcttggtgctttatatgtacttacttttatcttgtccttacagcatcataggtggcaccatgattatttatcctcattttgcagctgagaatcagaacaattaaccttgtatcgtatagctagtatgactctcttgaatccagagttcatgttctccttagtttttcagaaactcaatgtggaaaattctaattctatatttattgcacacacagctgcagcctgctgcactaaactcccacctcgtattgaaataataacgtgcagaactcccttttatatttattgatcatctacattgtgaaaggtggttttttatgcaattgacttctgaacatcttggaaaaataatggaaaaataatgtaggttaggtatgagaattcccattctccagatgaagaaactgagcccaaagagtttcaatgagcctctcaagtagctgggactacaggcacctgccccacgccccatgccctgctaattttgtatttttagtagagatggggttttaccaggttggccaggctggtcttgaactcctgacctcgtcatccacccatctcagcctcccaaagtgctgggattacaggcgtgagccactgcacctggcccatcttttcatttctttggtatactgtttttttcctcccagctttattgaggtttaactgacaaataaagtggtttgtattcaaggtgtacaatgtgatgttttgatgagtgtgtagactgtgaaatgattaccaccatcgaattaattaacacatctttcacgactgttggttaccattttgggtgtctgtgtatgtggtgtgagtataattaagatctaatcgcttcacaaatttcaagtgtatagtatgatattactaactgtagtcaccatcctcagaacttattcattcaccttataatggagagttggtaccctttggtcaacatatctacattatggccatttctaagtcagccaggaagtcagtgtaagatgaatccaggatcactccttctgactccggtagtcctgaaccctcgctgagctgacacagacctggctgcaatcttagaagaaagcatttgccaaacaaatgagtagtaaagaggcattgggggtacccggcagggttgatttaatctacttgagggcataccgttttctagccttgggtagataaattgtttatgtacaaggaatgctgctaactagaaatgtgttttatcttttcattaaaatgggtccacaaatttctgcttagaaatacaattttagcttccctctttgaaatccttacagattaaacatttcctccttgctatccttgtgacaatatcttccatttattgtgcctctgctgtatgccagacggtgatagatgctttccatgcataatctaattctaatttttacaacttaataatagtgataattataaaacaatgataaacagtagctttcatgtatcaaatgcttgtcacatgccagacactgtgtcaaatgtttatatcttattttatccttatactcgccacacatgaaggtactgttagtgtccttattttactaatgaagtgttagcagtgaggtgacttccctctttttattaatggggcaactgaggcacagacagatcctgcaatttgctcaaggtcacaaacttacgttgggattcagttttttttttttttggagatcaacacttccttggacttattgggaaatggatgatcattgttaaaaacacgttttccaaaaaaaatattttttcttgaggtttgggggaacttgggagaaaaagtggggtctgagctgctggcatggtccaaagtcactgaaggcaggccacagccagtgctcagattgggaaggtggagctgtaactctggggcattcttgcttatgacaatgaggatttccaaggtgtctgcaactcagagattctgggacctagagaatcagagcaacgtcgggttgggagatgagttttctttcctgctcatcttcatggtgaaagcggagctggggtgcacggtgtgtggggggtgactggcagtgcaggcatgcccagctgtgagtgccgtggcaccaggacaatcacctccctggatagagtttccctcgtgcagcatcagcaataggtggaccagaggttcacccctctctcagcagaagtatcattagtgttgacagcgtgaaatagcctctagggttctctcagccatctataagaaggtcaggctagaattgagctgagagccacacccccttagcacgcagctgctggactcccctttcacgttttggtgaactcttctccaggggcttctgtcacatcaactgcagtgggattgctgcctccagtttgtgtcttctggtgctagcacagaaaccccaccttcttctcttctgtttctggaaaacaccagcctcctcttaccttactgagatcagaattcttataacacccaccactgtttcatcttagggtcctttttcacatacagtcttatggttttctatttgaaatggcccacgtgcatctgctttgcctcctaaacgaagctaaatgtcttctgatcacgtctccttttaataactcatctctttaaaaaagtcatatcatttgattcttctaaatgtaaaagtaactactctcatcgtagaaaattggaaagccacgtatcagggccaggacaaggaagaggagattaagaatccctccttggatgcaaaatttaaaagggtgccaaacaattaagttatcaaggtaaataccatttcagtgcaatattttagagaatagaaattaatgccaagaattccatgattaacataataatagaggatccagcagggctgagactaaggttgggcaagtacagtcggatcttgtctttatttcaaattttgatttgttttgcatcattttttttgcattggtttttatttgtaaaaatatcatattaaaatattacttatcttgactgatgagtcatttatcaccctcttaaatgttgcacccaaaggaagtgcttcattggccttgctgtacttgcagtcctggttatgatgaccaatgtatactgagtactcacagtgtctcaggctcattcttatgcttttcttatgttatgcttgttcttttgtacaacccccacaacaactcacaatagctgggaactgttactgttcatatttctcagagcacttagagaccctcagagagtagtgacttgcaattaacatagctcgaaataagccgaacaaaccaagatgcaaccaaggctgtttggctctagaacatgcactcagtctactgtaacctgtgcagaaatgatttcccctcctgccttctttcatgatccccagcccccaggtagtcttctctgactgccgcccccccaagactcatcaagtgccctatcatgctgccattgtagcacttaacaacgtgtaatgattatctattaatcgtgtaatgattatcttaatgtgtaatgattatctgtttctttgtctgtattcctcataaggttccttttaaaaaaatggcagtgtctctatgttcctatggtgtttttgtggtcagaagatgaggggcttgtaggccatttcacttggggcttgatcacctgctcattgtcggctctggactcaaactcatttgccccagtagcagcatgctcttcagaggacagaaagaggcccataggctctgatcccttagttggtaaacaatcatttctctagatctgtgttcatccatcatggcccattaagcagcagtggcctggggccattttccagtgtgactgatgatatttgaagatttggcagaggaggtgtaggaggcttgtcttctgtgccagctccatcctgctgctcatgtgagtgatgatagtggggttggggtggctctggtctgcactgattggaagtatgaggggtagtgggatggtgcccttgtgcgagtccaggctgggaggcccagagagcaggtaagagagatgtgagctcactttgccctaatgtggagaagcagtgcatgaataatcacccagtgggggagagaaactattgcaaaaacacaactacaataaattcttcgtctctccgttgttatccatttatcctatggacaattactaggcacccaccaggtgtgggatgctatgccagataggaggcacagggctccctgccctcacaaagctcatgatttaatgctaccctttgcattgtccactgagatgggtctgtggttggcaagaggctgcagccccttagcaatactagatgcagtgaatctgtggggcaatagtccttcttttctttcccatgcatgtgtggaaatccagtgtgtatgaagtggagatctgaccccatcttgtttgagctgtgtgctgattgttggatggggtgacagatgaaacatgtaccatgagaagtccacaggctacatgggaaaccaaacaacgctcaggtatccaaagtgtctttcctgactgtcccccactccactgcaccattgcaggctgaattagggggcctcttctctgcgcctcttacattaccctgggtttcccgtgctcaggccatgcctaccacttttttttttttttttttttttgagatggagtttcactcttgtcacccaggctggagtgcaatggcatgatcttggctcactgcaaccttcacctcctgggttcaagcaattctcctgtctcagcctcctgagtagctgagattacaggcacttgccatcacacccaaccaatttttgtatttttagtagagacggggttttatcatgttggccaggctgacctcaggtgatcctcccacctcgacctcccaaagagctgggattacagtgtgagccactatgcccagctaccctaccacatggtttaatgaggttctgtgtggctgtccatttcccacactgatggtgaattgcctcattgcaggggctgagttgttgcacctccctgtcccctgcagttgccatcacctcgtaaatagtatgttcccaataaatgtttgctgggggaatgcagccaatgggtgatgaagcaggtgaaaatgcttagaagaaagcttacactgcaatgttatatacatgcaaatgaatctagtgcaaactgcctatcttgcaaaatgattttccaaatgtaagtatgttcagaaatttaaagcgcattcggaatcagggagtctttttttgaaaaaaatatttttgttattattttgcctgagtgaactagttgttgtgtcactgagttaaaataagtcacctggaagtaggtctccaaaggtaggccacaggtctctgtacttagatctgttttatagacattgtggatctttcaagtctttttcttcctctctattctttcctcctacccttagtaagattctagttatttcttttttttcttttcctttcctttctttttctttttttttttctttttttttttttttttttgagatgaagtcttgctctgttgcccaggctggagtgcggtggtgcgatctcagctcactgcgacctccgcctcccggttcaagtgattcttctgcctcagcctcccgagtagctgggattataggcatgtgccaccatgcccagctaatttttgtacttttagtagagatgagatttcactatgttggccaggctggtcccgaactcctgatctcaggtaatctgcccaccttggcctcccaaagtgctgggattacaggcatgagccaccacacctgtccagttatttcttatttaaatgattataacaaccttctaatgccctcctgcttttctattcactcatcctcctgtagatgctaaatttttttttctgaaatataaatgtcatgttcctattaataacccattacttgttgataaagtccatattgcttaactcactgcataagtctctttgttcatggccttctaggcttgtctctctccactctgacctatgtttaaatgacttaaaacggttgtcacttcttgagacaccctcatttcttggtaatgagtttccctttgtctgggactcctgtgccatcctcatctcgttaactcctacttacaccacagaacccaactttctttataatggcattcaacacttggtttcagagtggtccatttatgcctctgtctgtcctgctagactgagtaatctaagggtggggctcatgctttgtttacctatttatcttcagctaccctctgagcctggctcatagtagccactcaagacatgtttgtagaatgaatgaagacccgagttttctaagaaatgtgtacatttataaggccaggagaaaagaacatatagtggccaatgaaatcaagcttcaaatatggtttactaaactagaatgcagggtaaagttgtcaaggtatcctttaagagacatacatactggtcttgcatttaggttataaaatttattctacaagtgccaggttgagaaggggaaggtatccagccatatgaaaatgaccaaaaactggagttttcatttgttctgataataaagcagaatattgacaagtcagactcccctacacattcactcacaactcaccacctacccatttattagctgggctaggctatacaggcttgcactctgctctcacagagcttatcaatctagacggggacacaggcatcaaataacgaagtcacagtaactgtgtgtaattacagacagagctgaatgttctaaaggaaaatatcattcaacagaggagcttgacccagactggtagctggtctgagacggcttcgttgaggaagtgacgcttgagcaagagattacaggcatgagtagaagctgaatcaatagctggatttctaggaagaggaaggaggccagagagagaggtgtgggtcaaaccactttaagcaatttttctcttcaccaaagaaaatctctttgcctggaaaaagattgaataattttaaggagagtttagatgatttgtagttaaaaagaaacacttcagtggtcatggtttcgctgtccttgctcctgacccaggaggatgctggttggtaccaatctttgcgttttagaagggtcagacagaatgagcacagagagaagagctatgattccaggaaggtctcaggaagaaaggcagagggcatgagagagcagtcttcaaacatacgaagggctgtcctgtggaggagaaacaagagccactagttactgtcccgcagggaagagtaggacctgtgggcaaaagctataagggagagagaaattagctgtgcttgagagcagaccctttgaaatattaaagctctcacttattgggatgatgattaggaaggcagtcagctgccatcatgtggatgcttaaggctggatggccattcttcaggataaagcaaggggaaggctttcgtgggagaggaacagaggaaaaagggcagcctatgggctgaatccagcccatagatacaccctggacctcagaggctgtaaaaatccaatgagtattcacgaaaatatctagggatggatctctttttaaaatccagatttttgaaacttttattttaggtttgggggtacatgcgaaggtttgttacataggtaaacacgtgtcactggggtttgttgtacagattatttcctctcccaggtattaatctcagtactcaaaagttatcttttctgctcctctaccgcctcccacccaagaactggtaaattgggccagctttctagaactgcaacaattgtttgcagttgatacatggtgtattagttgcctattgctgaaataaattaccgcaaacttactggcttaaaataatacaaatttattatcctacagttctgcaggtcagaaagctgaaatgggtctcatggagctaaaatcaaggtgttagtagggctgaactctttctggaggctctaggggaagaagctgctttttccttgcctgatttccttggctcaaggccccttcctcatcttccaaggcagcaccagggcatcttcaaatatctttctcagactctactttcaaatgtcctttctccccatctcaagatctttaccttaatcacatctgcaaagtcccttttgccatgtaaggtaacatattcacaggttccagggattaggacatggacacctttgggggccattgttctgcctgtcccacatggccacccttttagaatcgattgaacaaggtttacattattttctttacctgcttctccatgctagatgttgcatttgtgattcttgagttaaagggctggtctggataaccatttttcctgtggttatcctataattagaaatgaaatttagcatatgagggttaaatgcattaatacaaccctttgaggggctggagatcaggtataaaaggtgtgagaaggaactttaagttctttaaaagtgatgcttttattgtttgcaggatgtcacataatcagttcaattcaacattgaatctgtgctctgttctgtacaggattaaagaatatgtaagacaaagcataacacattaaaaactttttccatttcgctcccactcaagaaaacatttcagattgtaaatgagtaagaatgatgttattatagaaatgaccttgaatgtgctgtagcttacaaaaaaagccaaaatcatttccaagtatcactgattggactgggatcctaactaattagtgcatcacacctcacagctgctcatgatccattagttttgaggacctcttatctatgctatggtctccagcctccagaaaagcttttgtctgtctgcagagacaagagttatagggtgaaactatgagcagcttggtgtagcatgtgattaagtacttacatgtgtggtacagacactaggtgctcaggggtttggacaggcatcatggtgaaccagccctgaacgatgcttggtgaacgtcatcccgccacaaagcagattcccactttctgattctgcagtagggcagcaggtagatgaaaccaacactgggtaacttagattaaaaaaaaataattaattagcatgtttcaagggtgctctgcaaaaagcgtgcatctgcaatgaataaggagagcctctctagggatccatgaaggaggatctgacaggcagttacttcagcacacagcagtcagtgaatcggccctgaccttgtgtttttcctcctgtgttggaaatgtttggagaatgagtggttgatttgggtcccgccttggccctgggagagtagacacgtagactgatggacccaccaaggcaaaaggaaatagaatattgctacttacagaagaatggttggatgctgatgtcagttgtaactttttacttgcaatgtcttaagagtcacaactcaggcaatcccacaggtaccttagcaccttactaaatattcaggggtgaacttgtgtccacttatctccaaatctagaattctttctaatgtaaacacctgggaagataatcttagcattaaaaacttagtttaacatacatctgtaattactgataagagccatcttcaaaatgcaggcacaactattaccgtgtaatttcaaactgattcataaataagaaagagtggggaaggtagataagtattcttcccagttgtttgtggggttactgatgctaaagaagagtctggcattggtggctgggaactttggatgtcaccatgaaaagttggactgggatatagaacaaatgttacaggaataacccagcaagcctgaacgtttagcacatggggacaccatgttccacaacttcaggtgaagggtggggtggaggactatgctcacaggatataatatgattgctgccccctggagttgtgcagcatagcagtcctggtgaagagaccagtgcagtataaatacatggcctccctggagagacaaggtaagaattctggaggagcaaggggagatattcctttttcagcacgtacctgggggtggaggcatgaaccttcagtagcctctcctctcctcctctctgagctgagtcctagtcatcacttgttaatgctgcaaatccatagtattcacagtgcaataataacggtgggaagcatttatgaacctatgaagtacctataaagtactatgaagtatattaaacagttcctatacatgatcttatttaattttacaacatttttacaggtaggtactattgctaatgctctccaggttccaaatgttatccttttaaaacttttatattaagttcgagggttcatgtgcaagtttgttatacaggtaaactgatatcccaagggtttgtagtacagattatttcagcacccaggtattaagcctagtacccattagttatttttcctgtctgtggaataaggttctcttgaaaactctggaggactaagaaaaataaggctgtggaaactcacctaggtgaggattcttcttgtattagtgtacaaagtaaaagctagatatatgtgctgaaatgaacagcttgataataataaaataaggaaagaaccaggtaggccttgctgttctctacccttatcagaaaggagaaaggaactgagatgttcatctatgtgcctgagggcacagtactagggagtagaaagcaggaattcaaacagaattcacagtcgtgcttgtttctttgggccttgctcctcactcgtagagtagaggggactgtgctttggtctggcccaagacaagtgactgtgcaacgctgtgccagcatctttaggaacctcagttccagtttcattgtgcatttggccatcatccggcctgtctctgcctcttgttcattgtggtcccacgtgacttctttctgcctggtttgtctccggtcatgtgacttagctgcctggactcttctgttctatgcaggaacagagctagttttcatttactgcaggaaagaccagattggcaggttgattttttttttttctttctcatttgagcaaggcactgggaacactgagggtgataaagggaaggcttagttttgcaatctgtgcttatatcactgagctccctgcaagcaagacccttgaggaacatgtggggtgggtgcccaggtgagctcaggcacagactctattgcaacccccatcctgcccaggtctccctgtttgttaccactgcctttcctggtctgagtctaggggttgtgccgtccttgggaattgagccgaatcacaaataaaagggcacttatggtttcgagtggcgcatactctattacagtatgtcgctctcacctgcctacttttgcattgaaaaaattcacctcttcttagctcctaatcctcacttcatccttacctaccttctacctctctgtgtgtcaactctattgtgtttctatgattacatttttaaaaatatttatttgttttgaataggcaatacccacatgggattacaaaaattaaatcagcatctgtatgtgtctagcaagtattttttcttctaagcttccttcctggaggaattgctgtttcttgtacatcattttgtctgagtatgtatttggctaagcctttcaaaatcaccttctttatggatcaaagtggtcacttaccagcaaattgacatgattcacccaaattccagcataaatacgggactttatcagcacttgacatataacgtattttcatctgtattagtgtattgcctgtctctctccatcagagtgtaagctaaatggagccagggcttgttttgtttactgctaaatctccaatgtctggcaccaaaaagacccaacaaataaatatactactttttattcacaaatggtagccaactctgtgctctgttctacaccttgctttcttcatttactgccatgtttttcaaattattatttgttggtacctgtaaatcagttttgttttctaacagttgcatggaatgtgcatccatggtgaaaatgtaccctaatggatgtgaccaattcccttctgatggacacctagcttgttcctaatctcttgacattacatgcaaaaaatgccttgaacatccttgcacagatctctgcctaaaagtgtgagtacctataggaagttacctatgtgtggaactgctgcttctgagattatgttgctgttttgggtaaacattgcctagttggtttattgtatgctcagggaagaatcacagtgctcatgggtccggtctttggtcctttgattgttattgttggaaacaactccacccacttcttatgctctacaaaacaacagcagtaggggagtgactgcacgctgttcaagcttcttaaagttagtcttactactccctgtggtcaacagcagtccattctttgtatgctaatctgttacatttgtattagaagatggatatctcagcatgacacaaccaaattagttttgctgttggaagccaccatggggtactagttggggcacagctgttgcatagccatgggatatccaaataaggggattggggaaggcactgtcataagatcatgacctctcttagaagcaggagccgtcaaggctcaagaggacagatctccaataccttcattccctgcctcctctctgtggtgttattacttccccccaagatgttcaagttcagctcatgttcatagagtgcctactgtatgccatgtactttctgtccaagatcgaatttaactttcttaagagccctgtgaaaaaaagaatactacttgtatcttatagaggatgtaccagaggctcaaagaggtagaatgacttgtcagagtaagcttttttaaagatacaaataagactgtccttcctgcttaggaccttccattctaaagtcctcctgtgttcttatctgcccatgtcagtgtctccaagtcaatcatattttcttcctttcaaatctgtctccagctacacagcctcttgtcacttacatctatgtgttcattcctgtcaaaggccatttgcttttctatttccctttaccgagaacttttagccccctaaattaaaatttacgtggaccccgacagcacaggcaaccaaagcaaaatgggcaaatgggatcacatcaggttaaaaaacttctgcacagcaaacggtcaagaaagcgaagagacaacccaaagaatggcagaaaatatttaaaaactatccatctggcaagggattaataaccagaatatttaaggagctcaaacaactcaatgggaaaaagatctaataatccaattaaaaaaattggcaaaagatctgaatagatatttctcaaaagaagacatacaaatggcaaagaggtctatgaaaacatgatcaacatcactaatggtcagaaaaataaaattcaaaactacaataagttatctcactccagctaaaatgacttttttacaaaagacaggcaatgatgaatgctggggaggatgtggaggaaggggaaccctgtacttttttggtagaaatgtaaattaatacagccactatggataacagtatggaggttcctcaaaaattaaaaatagaactaccatatgatccagcaattccgctgtcaactatatacccaaagaaggggaaatcagtatattgaagagatatctgcactcccatgtttattacagcactattcataatagccaacatttggaagcaacctaagtgttcatcaacagattaatgcataaagaaaatgtggtacatatacacaatggagtactatttagccataaaaagaatgagatcctgtcatttgcaacaacatggatgaaactgaaggtcactatgttaagtgaaataagccaggcatagaaagacaaactttgcatgttttttacttctttgtgggagctgaaaattaaaacaattgaacacagaagagagtagaaggatggttactagagtctgggaagggtagttgtgagagagggtgctgggaaatagggagggttaatgggtaaaaaatatagttaagatggaatgcgtaagatctagtgtttgatagcataacagggtgactgtagtcagcaataatttgtcgtacattttagaataactgagggagtacaataggaacgttgaaagaaatgatgaatgcttgaggtgatggaaacctcattttaccctgatgcgattattatgcattaaatgcctgtaccaaaatatctcatgtactccataaatatatacacctactatgtacccataacattttttaagaaataaaatgaaatttacatgattgggttcttctagccacagccagaatgtcatctctttaggagtgatagatcctccttgaccgctcccccttagcactctctatctcatggcccattttgtcttgcacacagctcttctcactgtctaaaaaagtcgttttggttgttcacgtggtttatttattgatgcagatgttgaagttgcattgtaaaaaaactgggtttaaaaatctgggtgcatgcacctttgcctgagacgatttcattgcagtcctgaccaagggccaggagagcacagttggtgacttctacgactgcagttaggatggtgtccaggttcctgggacaattgtgcttagattgaccactgaggctaatcacattgtatttgggagcttattttctcttatatgaagtaggttattattacaacagcctacatccttacatagatcttcactgaaaggaaaacagtctttgctcagtgctggccaaagctgtaatattgaggtaaaaagctatcccttaagaacttatggtttcaaaggtagtttattcatacactcagaggtttgtgtaaatgtgtgtgtcactgtgtatatgtggttgcattagaaataaattcaacacaaatgtgatcatgtcatttcactggatgaaaacttcccctttttgtcttaggtttaaaaagtgaaaagtacttaatagaatttataatggaatttgcaaagtgacaggccacaggatgaatgagttttattcagcccacatggtgctttgacttagtctccaacatttacaaatcaggagatgttacatgaaattctggatatttgacttctcttaaagatttaaaagctccagtgatactgtctgttgaaatggcagtattcagatggaagtgagtaatatctttttctccaggtagggcgtggacccccccagtttacctctttacgtatctggaccacttcactcactcatggtacacacttggcccctataaaatttggttttgtgaccatcgctctgaaatttctccttcattttcctttggattgaaaaatagcagttaatgtgagtaataaaaaatgttatactcatgtttgttaatttgtggaattgcacaagcttacaaatataaacagcagttgtctgagagaaagcaggagagaaatcaacttttaagggtacattggcccagaatataagtagcttctgatatctaaatcttcgctgtcactttttatatcaatagttatttaaaataagtgctggcaaagaagtaatttcttaaactaattactttgatgcatgttgctagatgcaattttttcaaatgattattttatttgattcatgcttgtaacctacatacttaccagtgccccatatattctagcctcaaaactttgtaaattcagagaaacacagagcttttataaaaataaattttcgttttacttttgtcttttcaataaaattcatgggcatctaatttataatgcactttaagtaacaattcttaaaattgtctttcctttccacttctactctctcttgccccgtgtagtaggctgaataaagggccctcaaaatgcttatattctaattccttgaccttgtgagtatgttaccttacatgacaaaaggggctttgccaatgtgattaagttaagcatcttgatatggggagattttcctgtattatccaagtggacccaacaatataatcacaagtgtcctcatcagggaaagacagggagattctactaccagggaagatgacagtttgatgaccaaaggaaaatgctgtgcttcttgctttgaagatggaggaaggggccatgaaccaaggaatgctgggattacaattctaggaactggggaaggcaaggaattggattcttccctagagtgtccacagagaatacacccctgctgacaccttgattttagcccagtgcaactgatttgggaattctgacatccatgactctaaggaataaatgtacactgttttaaaccacctggtttgtagtaatttgttacagcagccgtaagaaacatcccataattgtccttttttttttttgagatggagtctcgctctgtcacccaggctggagtgcagtggtgtgatctcggctcactgtaacctctgcctcccgggttcaagcgattctcctgcctcagcctcctgagtagctgggactacaggtgcgcaccatcatgcccagctgatttttgtatttttagtagagatggggtttcaccatattggccaggctggtctcaaactcctgacttcgtgatgtgcccgcctcagcctcccaaaatgctgggattacaggtgtgagccaccatgccgggcctaattgtcctctttatttgtgtgttctcaaccctctccgtgaaactttcccagcccccttttgattccctttcatgggtaatagtgagaggcagcacacacagggaaccaggacagtaaacaaccttcttacccttttccaagatttcttcccaggagagacacagtaaaatagagcaggtgaggcaatgcggacgtgtgactgcatgatccattacctgaaataacttgaccaaaatcagtgggagaaccaacaagtctgtggaacccacagtctttctcaagcacttattcctcttactcatagctcagtgtctttgctttaatgacctcattctttgctgcataagcccactcagactattccctagatattctgccgacatggcctcatctagactccatgtggctctgcctctaattactgtgtgcttcatttgcataaggttttactcattctcatgtcattcgtataaagtgggagtctcattgctaaggcaaccagaagtgggagtgtgcacaatttcagccttgtccaagaactcagctctacttggtatactcccactgtgttcttggtttcctgccttccatatccaaaataatgcaaacaataccatggtcatctctgttcgttttttctctttttattaatcttttagcaggcctatccagctttttcctgaattcactaactttgttctttaattatccctagctaatcttgatgtcttttccttttcctgcataatagatatcttatctggaatcctttatggtaattactgctgtgaacactttccacatgggtttttctctttcttctaccacccttttgaccattccatgcctctcccattggaatcagaatccaggatttctgtttctgctcttcatctggacagggccactcaaaaatagatgaaggatcagggactccatactccccatgtaggaagacagatggaggcctctaagaaatgtggttctaattttaaactgattgcctcgtattcgcttcccatgcatcaagagctagtttgagttctactgtccataattgtcagttgctacacactcactcagcagcaatatgccagatttttctgctagttaatgcttaaaagtttattccattttacaaagtactgatgaatttcgacaagaataaaaggccttatggtttccagtaggaaaattgcctttctcctaaaggccatgaaatgcctttctccaaagtccattgggtgactctcgttcacaaatgtgtcctacacaaaatcttaaatgtgcatggtttaccaactgttaaaataggaagattttaacacaaaatcctgaattctggattgtcttgaaatactgaaagagctggcaacatcaagttgtattcttctatggccacagaccacagaagctggagttgtgtagtcattgccccttgggataaggtggtaacccttcgctcatctcacactctacacaccctactttgctcaattttgttgcctgcgtgctttctgtaggcatctcagtttccaacttctctcatggagttccaggcttactgtgaggaaggtacctatagatgactacactgacttccttctcttacccacctaatccgtgaaaccggtcattcagcctccagagatgaatttctcattgccttcctgaatagccattccatctgtggtcagctctccctaggggaatgtattccacagattaggtgtttcatctattatgtcttcttgtcccttagttggagatctattggcaataacccattttgattattctgtttctccaaaacttgatttccattgtatttccaagggctcagaggaactatcagttcaccatttgcactgagctgatgttaaagcattaaggaacctgatgcctcctcatcttgtaccttgttttatctgattattttatgccatttgcaagctctagtgtgatacatgaggccatctcagagatttctcaaggttcacctggtaagagccaaaggaagctgtgttagtttctatagctttttctctagtggtaatggtgctgataataatgatgatattagtagctacattttattagaaaaatgctgccagggtaaactaaatgccagaatgaatgattgataaatatccctgcatctaatcctaattaaaggtaggtgttatcctggtttatcaatgagtaaactgaaactaagagaagttaaatatattctcaaaggccgttgtggtggacattttatttgtctctcctcaaatttgctcttttttcttatggtaactgccataatttcccgttggatatccgtgcctaccccatgaatttcatgtcctttggtaaaagcaggccatgtgactcaggcttaagccaatccatgcaattctgattcactggccatggtgactggctcattgattagcatgaatcatagttaagaacgatgagatgggagattttattggagggcttctgagaaccttctaaagatacaagagcatgcatggaagcacttgtggaatgttggcaggttcccatgttgtgttcacgatggggcaccagccataagatagtttcagcagagggtatgtagggcagagagttggaaggagcaaaatcttgatgacatcattggtctactgacttgaaaactcctgaagccatctttgccactggtcattccagtcacagaagcttatgtatctctattgtttaagatggtttgaattttctgtcacttgcaaccaggtgaatcctacctgatagatgcacccaggtagtagataatagagccacaatttaaacccaggacttcatggttccaatattggtgccatttcttctcctctgttcttggtttggataaacactctttgtatagactcatagaatctcagagtttgaagagacccacaagatcatcctgctcagcctctgatgttacagataaggaaactgaggcgaagaaaggaaaagtaacttgcccaggacaattggggcccacgggtaaggtaggctgacctcagtatgctgcttttcttccccatatcacaacacctttatttatttttctgtttatcatcctagttaaattaatgggtctcagggatggagagtcattgcctacagattatggccatggtaagcaggacaaacttcctgggcccaggaggagtctagagttcatttgtgaaatctgccctttgagtataaccaagactaggaccaaagtaatgggagtacaaaactgaagaagctgaagatatgcagtattgcacccatttctggagaaatagaaaaataaataaatgaagacagcagcggaagagaagaaaaaggagaaagaggaaaatgatatttacaaggtgctgtccaaaaccaaagaagcatgatggatagggaagaatctttgtttttttgtcttccttaatacaatgaaatcagtgtagatccggtaggccaaggtacccagaacactgttctctctcctctgtttcctcccttattccatgctaaagtaccttaaaggactctatagactattaatagtgctttagaacataactcactgcttaggacttccaacaagtggcccactggtggaagaaaagcaatatattaagtaattttagaggaatttcaaggaatgagggtataggtttttaccctttctcttgatagctgagacatgactgctacttattttccttttaggaggagaaaaaaaaactttctttctctgtaatagtaggagtagtgtagaaatagccgcagtggttaacacatgcatgttcttcacatgtggtacgagaaggactcaccaaatgtgtccatgccctaatgcttggaaccagtggatgtgttgcctaatttggcaaaagagattttacaactgtgattaagttaaggctcttgaaatggggagattatcctggactattcaggtcaacccagtgtaataatactgggtccttataagggaagaaaggaggcaggagggagagagtcagaggaggagatgtatagtgaaggtagaggaaacagaggtggaataatgagggtgctcaggggaggaatgcaggaactccctggaacctggaaaggcaaagacatggaatctttcctagagttctggaggaacacagctttgtccatactttgatttttagcctagtgagcccatttagaatttatgacctcagaattgcagaataataattgtgtgttattctaagtcgttgtgcttgtggaatttgttacaacagcaaatggaaactaataccccctgtgtgagagcctgtgatcagtgattagcctccgtatcttgcttgattcttttcttttttatatatatactttcagttctggggtacatgtgcagaatgtgcagttttgttaaagaggtatgcccatgtgatggtggtctgctgcgctcatcaacctgtcacctacattaggtgtttctcctaatgctatccctcccctagcccccaacccctgacaggcccagtgtgtgatgttcccctttctgtgtccatgtgttctaattgttcaactcccacttatgagtgagaacatgcagtgtttggttttctgttcttgtgttagtttgctgagaatgatggtttctagcttcatccatgtccctacaaaagacatgaactcatccttttttatggctgcatagtattccatagtgtatatgtgccacattttctttatccagtctcattgatggacagcttgattcttatcaatccttcattttagagattacaaaatgctgtttagagtggtaagtttaatatgccaaggtcacttcttgagttaagcagttgagtcaggatttgaacccaggcagtctgataccagaacttggattcttaaccactgactctactacctctctaatatagctggaaactctttgacataagaacatccttcttgggccagcaggtgcctgggaagctgctttcagtgtaagtttctgtgctgtttggaggaaaatactacacttgtataataggaattgtgagttgttggaacctctaatttaatattgtttgttctgctgatgtaatgcttccattggctctgagctgactaaagaaataaggattctttgtatattccacaccccctacccgcacccctaggatgtttatgtccctcagcaagccatccaggaagtcctgaaggagaaagcaatgcatgtaattgaaactgatacatgacctgaaaagtttttgcaggagggggaggaggagtatttgtgactattgtcagaactgttagagagttggagaggaaggcaagggggagagaaaaggagggagggagaaggagagagagagagaagagtgagactgattctgaaattagttgagaaagatacatagagatatatacagtaatacaaaaacataaagggagtaagattttgcaaggcaatttgccaatttttataaaaatttaaagagcatactttgtgatctggcagttctatgttttttattgcagtaaagtgcccataacatagagtttactattttaaccattttaaagagtacaattcagtgacattaagtacattcacaatgttgtgcaaggaccttcgatctctacttccaaaacattttcatgactccaaatgaaaattctgtatctattaagtattcacacaacatgccccatccttccagctccctggcaaccaataatctaatttctgtctctatggatttgcctattctggacattttatgtgaatggaatcatacagtgttatgcctggctcctgtcgtttatcatgacgttttcgaggttcatgccactcttatataacaacagatatggactaaatatcaatcgcagtgccatggctaacccatgacacatgagcaccatgggaaagattcatctagtagaataaagtagagcctcatactggtatggagaggtctccaagacatgtttttgggtaaaaacagacagttatagaacaaaaagcataacctattatttgtgtaaaaagttatggaatgaggtgttataattctataaataaatgtagtaggtacatgtattagtctattttcatactgctatgaagaaatacccaagactgggtaatttacaaagaaaaagaggtttaatggactcacatttccacatggctggggaggcctcacaatcatggtggaaggtaaagcaggaacaaaggcatgtcttacatggtggcaggcaagagagcatgtgcaagggaactgccctttataaaaccatcagatcttgtgagacttattcactatcatgagaatagcacaggaaaaacccacctccatgattcacttacctcccactgggtccctcccatgacatgtgggattatgggagctatgattcaagatgaaatttgggtggggacacagccagaccatattagcacatcaatgcatagacagaggtttgagtggatacacaacaaacatgtaacacaagaatggtcgatgttggggatgagttgagattagggatggcagtcaagagggctttagctttgtctcttaatgtttggatttatcaaaggagaatatattcatatgtgtatataaatgaatcaaattgaaagaaaacatgaaaagaaaggaaaaacagaaggagatcaatgataccaagaaaaagtgtagggggaaggctacacacaggaagagatcccccgggatagaatctggatggacctatcatcacaccattactgtaccatttggagtgggaacattgggagtggggagtgttgaatggtgagagcttttagactcagccttttccctgttgtcataagctgacttcaattatagcatctccaacactagtgattactggtttgttccagtgttagaaagtctacaggccagttcaggacagagctcctgttttgagttttaactcagcaatcagtgtttcgattttggaggaaattttccaagattaatcaagttgttttttcttctgtgttgtcaggatgatacatttttgggctggtgatgatgaaaaaaatcatggtttccttaaaggaacgaaagagcatgacttaagttgtgtaaaggttggcgtttttttgtttgaaatgtcatagcaattagctacttaatatgtgagagataattttatgatttaaaaaaacacctggtgttagaggaatcagaccagaaaaatgaacattttatttttattctgttttctttgttaagaactgtgagtcctggtttgaaatccccacccctattcatctctccatcattgagaatttttgatgagtgattagtctatgtgctaggtgctgtagtgttaaaaaataggtatagcctcttcccattggtggagcttatggtgtattgggaaagacagaaactccataaaaaccacaacagctatgtgtatatgattataaatcctgacaagggaaattatgtgtagacaaatgaagttggaatattacttacaggtgtgcccaccacaatctgctcagggacaggtcacttgggaggagatgtctagttggatttcgacactctggcctcaggcaattaattttctcccttaacgattacagtgatgggtaggagcaggtcttctggagttcagtttgcatttagctgaactcaattttcatgcgtgcctgagtctgaaagaatagctgctcaggggagcccagggagcctgcatcgtgggagggagtgtcagcagtggtttcacgcaatgcaatgtggtagaagagaatgaggtctgctccctctggaaggtgaaagaggcaggttatgatgcaggttggggtaattgttggagatgcccttccaccctacgtaactctgtcattttcttggttggctcgcatcttctctttctgacattcaacttatcccattcttttattattttatttccatacttctttctccttagtttctttactttccaaatcctcctttctctgtttccttctgttctcttccctcttacttctttctttcttttttttttttttttttttttttgccaccctctgcctgctttctttttattcctcctattccttttcttccttgatctattgttttacctctttgctcactcttggtcaatgcccttctagctctcctagtttatttctctacctccctgcaaatccctctgttattatcttagactcattgatgatcccacatagatcccataagccttacttctctatcccctctttaaatggaagctagtgttaagggggtcatttatcccttgcattgaaaaagcatactgaggatatagggggacccactcaaaggaaaggggatgagggctttggaaaatgtaagtgcaagaatcacaaacattataagcatagcatacactgggagatcagaggtgttattagatgactgggaccttgggtgatttatgtgtttggggaagtttcattatgactgggagtgaatagactggtttggacccctccttcctttgctcacttgtacccaagccctccttggaagttgtgttactgtagcctgaaagggctggtcttcttcacaatatcttgaccaaaacaccaccaccaccaccaacgacaacaacagcaacaaccttcttgtctttattaaacctgaggggattaatgcttagaaatccatttaaaaatcctaattcgtcatctatcccctccatgaacctgcttaaaaatgtctcttcttttgtttgtcccccagattctcttgaccacatctggcttgtgctgtttgacctctttgtgtcttagatgggcttagccttgctttccctcttcccttttccaaaccctctgcagtctccagggggctgatttcttataattcaggcctcagctcagatgctgcttcctcagagtggccttctctaaccattctctcttgcagatactcttaaccttaaggggatgataggaggaaatacattgaagaatttgatgaaaccaaggaccaacagtcttcctttctcccagtctcaggggattcttcagctcgtccctggacttttcaggtgtctgtttgaccgagtcagtctccaagagcccctcccctcccttgtcataccctatcaccttagcttgcatttatttgcttgttaacccttaaaaccagatgaaatgaggttgtatgtttgtttgcttattcaccatcatcaagatcccagccaggaatacctctaattaccatagcaacaggagacactggaaaaagcactttcagggtaaaggagttccaatggagatggtgagccaagaattctcccttacgtttttccatgctgtggtgacgcaggtacctctgacctgaaacttagttcagaagctcccaatgctatgcctggtggtttccatttgtattcaaacccttccctgcccatggtcttctcttctatttgcttcttgtctgttttgatagaaatcaataatttccctcatcttgctcctgcatttagaaaagtgaaccaactgtccagtttccctgcttcattgacacacagaggttaacatctcggggacgtcaatcctcagggcagaacttagtgaagagaatgctttcctcctaattgatgggatcccattgctgagactctctcatttcacctcccacctggggacgaggagggctccacattctctggaacaatgacagtttactttattgccttagagagaaggagctacaaggcctgagtacagagaagatgggggaagtaacccaggtcacctcttgaaatagctgaaagaaactatccaggaactgacaaatgggctttgcattctgacaggtgcagggccctcttcagcagttcgcattggaaattggaaaaatgagcctattgttgaagatctagatcattcattccatttttaagtgagaaaggaggtatttcacactattacctttacttccgagcgtttgtgccaaagatgtaagatgataacatggagggtgatattccatgtgatggatttcttcttcccttgcctcactacagaatgttcaaaaataaactttccatctgcaattcctgtagaatatcagactactctttgcaagtaagaagacatgatggtgcaacagaagaccagaggattacaatgatgtgtccgaaatctgagccaggagcaaaaacaaagaatgcatccttttccccacatgagccgcctgtcctgactcatgatggacctgggatctcttgcctctgttgacttggagactggggtctttacgaatgggggttggagttaggggcagatttaggttttagtctgagttctctctctgacagagtttttgggtgactttgggcaagccacccatttcctctgtgtctttgtttcccaacctgcaatgtaggagggaagcatgcccattgcacaggagagatttaaaatggaagagcctcaatttttagggaaaacaaaataaaacagatttatttattatttattttattttagtgatgggttctcacttcgtgtcacccaggctggagtgcagtgtcatgatcgtagcttactgcagccttgagttcctgggctacagtgatcctcctgcctctgccttccaagtaggtaggattacaggtgcaggccaccatactctgctatttctttttaaaaatttttttgtagagatggggtttcactatgttgcctagactagtctcgaactcctggcttcaaataatcctcctgcctcagcctcccaaaacagtgtgatttcaggcatgaacccccatatccaaccttattttatttatttttacttatttatttatttttgagacagagtcttgctgtgtagccgaggctggagtgcagtggagagatctcggctcactgcaacctctgcctctagggttcaaatgattcttgggcctcagcctcccgaggagtagctgggactacagacgtgcaccaccatacctggctaattttttggggttttttttttgtatttttggtagagatgaggttttgccatgtttgccaggttggtcttgaactcctgacctcaagtgatccatccaccttggcctcccaaagcgctgggattacaggcgtgagccaccgccaccggccttattttatcttattttttagatatgagagtttatcattattatggcaggaacgggtagtgttggaagcaagactgagaaggagataatttcagtcccaggtagtatgcacattgtgctttatgttatgcaccgatttacatagccgagtattgtctctctgtgtcagatttgtccactgtccacacttccatgtgaactgtattttgcacagctgccttgatttctctgcatcctgatttattagccctggttgatgcaaagtgagcctctgcataaattcaagaacaatttataacctgccccatcagcaaatatccagagcattcgtttcagaaaacatgttagttggtcctgttccttgcctccggtggaaggagctaaaacgaggcgggttattttcaccacggacaccttctccttaactttgggaactgagaaatatattggcctgtttcttttctttgatggtacaaagaaatagggcagaaacaatttgctgtttgtgaacaactggctgagagtgaagttggccttttctgctgagcaaatagaatctgtcttccctgttccatcttcacatgggaacatcagcttgagagacaatagacttataaagcctcctctttacctcatccagcttcctctataaactagcttatcctctgagaaggcttcttattaagaaccaggattgcaacttggattgattccctatcttttcaagtgtccatgaacggatcattggataaagaaaatgatataaacataccatggaatactactgagccataaaaggtaattacatcatgtctttcgaagcaacatggagggaacttgacgtccttatcttttttgtttttaattattatactttaagttctgggatacatgtgcagaacgtgcaggtttgttacataggtatacatgtgccatggtggtttgctgcacccatcaacccatcatctaggttttaagccccgcatgcattaggcatttgtcctaatgctatccctccccttgcccactaccccctgacaggccctggtgtgtgatcttcccctcactgtgtccatgtattctcattgttcaactcccacttatgagtaagaacatgtggtgtttggctttatgttcctatgttagtttgctgagaatgatggtttccagcttcatccatgtctctgcgaaggacatgaacttgttcttttttatggctgcatagtattccatggtgtatatgtgttgaggcccttaagtgcagcaactccaaaacagtcaaatgtgacatgttctcacttataagtgggagctaaataatgtatacacatggacacagagggtggcataatagacactggagactcgaaggtgaggggaatgggaggaggtgaagaatgagaagttatttaatgggtacaatagacacttttgagtgacagctacactaaaagccaagacttcaccactacacaatatatccatataacaaaaatgcagttgtatcccttaaatctatttttaaaagaaccatgattgcaacttgaaatcatatcatttattttacctgtaggaccacttactaattcagagctgaaccctggagccagaggaccaagattgaactggttctccaccttggggatgccatttcctctatctaggacttggatcccttctttgcaaatggagttaataatactacctgatattaagtcgttggaagcattaaatctgataactcctataatgtgctgagtgtagtgtttcattaagaaataccaggcatttgcctttttccattttccttttaatgaggacatcggcatcttagaattatcaagttatttctttttttttctttttttgagacagagtctcaccctgtcacccaggctggagtgtagtggcgtgatctcagctcactgcaacctctgcctcccaggctcaagccattctcctgcctcagcctcctgagtagctgggattacaggtacccgcaaccatgcctggctaacttttgtatttttagtagagaggaggtttcaccatgttggccaggctggtctcaaactcctgacttcaggtgatccacctgcctcggcctcccaaagtgcttggattacaggcgtgagccaccgcacctagcccaagttatttcttaaaataagaaaatagtattatccaaaacctaccttacaaactctgttaggcgaaatttctcctgctcttgaccttttgagaaggagacaggtgaaaaaaaaaaatgccaatgtaagaacatagttgagactgttgagtcagtatctagaggcagcattcattttccatcaaccgtgtgtgtgtgtgtgtgtgtgtgtgtgtgtgtgtgcgcgcgcgcgcgcgcgctgtagagagagagattcagggggtgcgtgtgcaggtttgttacatagacatattatgtaatgctgaagtttgagcctctaatgttcctgttgcccaagtagtgtagtgaatgcactacctgataggtagtttttcaacccttgaccccctccctccctcctcccttttgggatccccaatgtctattgttcccatctttatgtccatgagcacccaattttagttcctacttattagtgagaacatgtgttacttggatttctgttcccttgttaacccacttaggataatggccttcagctgcatccatactgctggaaaggacatgatttcactcttttttatggctgtgtagcattccatagtgtatatatatcacattttctttatccattccattgttgatgggcatgtgggttgatgctatgtctttgctattgtaaatagtgctgtgataaacatatgagtgcaggggatttttggtggaaccatttattttcctttgggcatatacccagtgatgggattgctgggtagaatggtaattctatttttagttctttgagaaatctccaaactactttccactggggctgaactaatttatattcccaccagcagtgtataaatatcccttttctctgcaaccttgccaacatttgttatttctgattctttaataatagccattctgactggagtgagatggtatctcactgtagttttgatttgcttttctcttatgattaatgatgctgagcattttttcatgtttgctgaccactgtatgtatgtcttcttttgagaagtgtctgctcatgtcctttgcctgattttaatggagttatttgttttttttcttgatttaagttccttatagcttctgaatattagccctttgttggatacctagtttgcaaatattttcccccattctgtaggttgtctatttagtgtattgatagtttcttttgcagtgcagaagacctttagtttaactagattccgattgtcaatttttttttgttgcatttgcttttgaggacttagtcataaattatttgcctaggctaatgtccagaacagtatttcctaggtttcttctaggattttttatagtttgaggtcttacatttaagtctttaatccatcttgggttaatttttgtatatagtaaaagataggggtccagatttagccttttgcatatggatagccagttttcccagcaccatttattggatgggggttctttcctcattgcttatttttgttgactttgtcaaagatcagttggttgtaggtgtgcagctttattttagggggtctgtattctgtttcattggtctatgtgtcttttaccagtaccatgctgtttgggttactgtagcattgtagtatagtttgaagttaggtaatgtgatggctttggctttattctttttgcttaggattgccttgcccattcatcaaccctatattttttattttgaggcaaagaagatggatgttcagagagcaccaaagtcttatcaggtcacgtatcaagattcaacattgtttcctttccttatttggacagaataatggaccaagatatcaagtcttcaatattggcttgaagggaaaatgagagttagttgtaggaccgtcctcctgtctggttatcatggttctgttctgggggatcttgggctacattccatcaaaagtgggagcatggagggacctgcagtattgtggaaagaacctgggccgatagttagtcttatttgagattaatcatatcttggcttggttctaaccatctcaacctggggaagttatttaaattccctgttcctcataatggagataataatggcttcttgagagggttgttgtgaagatgatattgtttaaggcacctatcactcagcctggcatatggaagatgctctttgaatattcattgtctttgctaaaaatgtgtgtttgtgttagagagagagagagagagagattaattggtacacacagagaaggagagagatggctggacaaccatggtggggatttgatatagacttgggggagctggaggaaggtttctggtgttctgtatcttgaagcttgattttggaaaatggttgtatggatgtgttcaaattgtagaaaattgagtggtataatttgtccactgtttttatgtattaaaaatttaaaaatgtgtgtttgtaagacctctctctgtgtcacacacacacacacacacacacacacacacgcacacaccacacacaccctatggatctctttccttcagtgttcaggagagacacactccccagacatcttgacatctccttttcttcactcttgattcctgcccctgacatcaactgtagtgatgcaggctcctacttctcttgagatctggtattcttctattgcgtctaagtggtaggttggtgttgtggaagccatatgggctttggaggcagaaaaaccagggtttgcatcttgggcttattttttacaagctgcagatttcttgtctgcaaaatggttgctgtgagaattagagatgattcaggtaaaccactgagcatgatgctagacacgtccaagtattagctgtacagtctttggatttctctcctgggtagagagaacctcctgccccaagtctggaaagatgttggcttttgtagagtaaactctcgaaatgtattaaattgactccatgcttgggaattttctccatttagaatgggtgtttctacctggttcagatctgagttcaacctagatcctcctaaaactatttaagaccattacctctgacataggctgtgcagagtaaacagatctcacatgaatgagaccttctccatctttctttgcttttatttaagccaaatatacagaatttgaatgtctaataattttcttctattggggtcattggtttaatttccttagcttaagggagagctgactagatattttttgtatgctactcttgaaatatgttttggcgtatttgtttgctttcttatgccctcatttattttactgcatttggataactggatgttatcaggtagctactattcttagtgaataggtggaattccacttctgtgcctaacagtatacaaagaaaacaacattattctagctgcattttttttgcttccatagtttctgagttataaatgggagtgagttggctttcatatgcacctacaaaattaatgttttataaaaggaagaaatataaaaagtctttaggccatctgtattggcctaatgcctaaaatcatttagcgaggtctgggccatgttagggttagggttagattctgttttttcataattagtaatctggttgcagggaccagacatgctctgcaataacaaacagccataccagtaagtatcaaattatgtgctcagtgaaaagtggagtccctaatacaatgtctcttactggagtctatggacctcctgcatcaatgatgccaagtatgctggttcagaatatagattcctgggtaccatatccagagattctgattcagtggtgctggaaggaaactcgggtatatgcacactgaaaagctcattagggtgattttgatgctaagttattgaattactagcactctacacaattggaggacagaaaatacctatgtgaggttgtagtatttatggaagaaggaaaaggtgatatctagatcttgaaagataaaatactgacaaaataaacattttcttctttttttttttttttttttgagacagcgtcttgcactgttgcctgggttggagtgcaatggcgtgatctcagctcattgcaacctccgtctcctgagtttaagtgattctcttgcctcagcctcccaagtagctgggattacaggcacccgccagcacgcctggctaattttttgtattttttagtagagacggggtttcactatgttgaccagactggtctcgaactcctgacctcatgatccgcccaccttggcccctcaaggtgctgggattacaggtgtgagccaccgcactcggcccattttatttctttaaaagagccttttggttattgtacattgttaaaacagaaatacactataaaataaaatcgacaaagatcacttgtaatttcaccacaactgtaactctttggtgaagtttttcaatcttattattttacaaatatttttatgattggcttgtatatacattttgttttcacttttattattcacctaacgtcataatttcagttcatcatgttatgacaacttctccataagcactttttcttggtagtagcatatttcttttccttggttgtaggattttctacagatttcctttcttatctcggtacccagccagaaggaacaatgctgttgatttctgtttccaaaggaggttgggtaattgtcttttcctttaaagttgtgtgatcattccattgtatatgtatataaaaacatcatattgtacctatgaatttatataattataaaatatcagttaaaaatgttttttatttctaatttttgtgagtataaagtaggcatatgtatttctggggtacatgagatacttcgatacaagcatacaatgcatgatagtcacatcagagtagatggggtatccatcacctcaagcatttaccctttctttgtgttacaatccaattatactctgttactctttaatgtacaataaattgttgactgtagtcaccctgttgtgctattaaatattagatcttactctatctaactatatttttgtactcattaaccatcactacctcataccatcccccaactacccttcctagcctctggtaaccatcactctactctctacctccatgagttcaattgttttaatttttttttttttagctctcacaaataagtgggaatatgaagcttggctttctgtgcctggcttatttcatttaacatactaacctccagttccatccatattgttgcaaatgacaggatctcattctttttcatggctgtacagtactccattgtgtatatgtaccacattttctttatccatttgtctgttgacatttaggttgattccaaatcttggctattgtgagtagtgctgcaacaaatatgggagtgcagatgtctccttgatattttcctcttaattcactgactaataaacatcacttcctaatgataaaggcaggtaaaaaccaaaataataaattaaaatttcattctattctaaatgcgggaccatataaaatgaacatataaataattggccccatatctggatgttgtaataacatcattaggtttgttcttactgatgacaaggaagttaacatctttaggtttgggcccaacgtaactgagaagcacacctagagagttgggcacatcaggaaacttttgtcaatagtttagtttctggcagagtctcatggagaatcaagttactcggtgtgtgtgtgtgtgcgcgcatgcatgcatgagtgtgtgtccacatgtgagtgtgtctgtgagagaaggagaacatactggtatgtgtgtgtttgtagctgaaggagtgtcatatcgcagatacgtttattagggaaatctggaagatagcagcagagtttttgatatctttgaacccactcctcaaaaaacagacaaactaacaaaagtaataaaaaaccaaaaactaatggataatagctacaaaaaattatgagacaggatgcccccatgaattctaaaatgagcatgtagataaaaatcacaactataaatcccatgtggtgttagaaactgcgtgtgagaaagtaaagacaagaccaagttactcgtgatgcctctgagagtttgggaagttcaagatcatcatcaggtactactggaaaatgaggcagaccattctgaggacaacagctacagcagaaatggtgcttggaaaagtggatattcatatgcagaaggatgaaactaggcatctatctctcaccatatacaaaatacactcaaaatgggttaaagactgacgtgtaaaacctaaaactgtgaaactgctagaagaaaacagggtaaactccagggcattggtctgcaaaaagatttttatagagaagacctcaaaagcacaggtaacatcagcaaaaatagacaaatgtaaaagcttctgctcagcaaaggaaaaaatcagagtgaagagacaacctgcagaatgagagaaaatatttgcaaactactcaactgacaagggattaatatgcagaatatacaaggaactcaacagcaaaaaaaaaatccgattaaaaatgggcaaatgagttaaataaacatctcttaaagatatgcaaatggacaagtttatgaaaaaaatacttgacatcactaatcatgaggaaaatgcaaatcgaaaccacagtgagatataatctcagctcagaaaagatattatcaaaaatacaaaaagtaaatactggcaaggatgtggagaaagagaactagtatacattgctggtgggaatttagaacagccattatgaaaaacggtatggagtttcctcatactaaaagtagaacttctgtatgatccagcaaccccattactgggtaaatattcaaaggaaaggaaatcagtatgttgaagagatattctttacccactgccatgtttattgcagcactattcacaggggccaagacattgaatcaaccactgaattaacagatgaagaaaatgtggtatgtatacacaatggaatactattcagccattaaaataacaacatcttggctgggcgcggtggctcacacctgtaatcccagcactttgggaggccaaggcgggtggatcacaaggtcaggagatagagactatcctggctaacgcagtgaaactccgtctctactaaaaatacaaaaaattagctgggtatagtggcgggtgcctgtagtcctagctactcgggaggctgaggcaggagaatggtgtgaacccgggaggcgaagcttgcagtgagctgagatcacgccactgcactccagcctgggtgacaaagcgagactccatctcaaaaaaaaaaaaaaagaataaataacaacatcttgtcattcgtggcaacatggatgagcttggaggacactatgttaaatgaaataagccaggcacaaaaaaccaaatatcacgtgttttcacttcatgtggaagctcaaagcattgatctcatggaagtagaaagtagattagtggttactagaggccaggaagggtgtagccacaggttggttaaaggatacaaaattacgctagacaggaagcataggttctagtattctatcacactgtaggatgaccatagttaaaaatatattgtgtatttttaaatagctagaaaagcagactttttaatgttctaaatacaagaaatgacaagtttgaggtgatggataagctaattaccttgccttgatcattacacattgcatacatgtattgaagtatcacaccgtaccccataaatattaatatacaatgtcaatttaaaaagtatcagtatgaacttatgatgtatttttacttaaaatacatatatcctagaacagtaaccaacctagtaaaactaagtactcctccacttagagtttggtttttaaattattttccactgagggagaccactgggaaagtgggtgattcaaggtgtagggtggaaatgaacaagataaaccttcctagagtgtcttgtcactgcaatgagcaaagcagttaccaaagactacaggtcaaagggactcagaagccaatctgaaatcaactggccaaagatggaacagcttgggcatcaatgaagatactaattgcagggcattgaaatacataaaatccgtgagtttgtaataataagatattttaaaagataactaattggtaacccttggaggatgctagggaaccaattcattgttctgaaaacatacatgggggaagaagcatgcgtttactgtattctgcccttcttgtatcagttcttcctcaggccaaatagctgacaaaggaagatttctctttttggcatagttccgggtaataaatgaagaaggaatagtagaattggaatatccctacattgcaaacgttaatgaactaatggatccaggcaattattgtcaatgcctgctaatgttacaaaagacaaccagaaaatttattttttaaagaaagtacacacatcacttatgaagtattcctggcaaaataagtgagatctgcatctacctctggcctgaactgccagcaaatatgggagggggcataagcctgttagatgacatcatgggcatgtcatcagcaaaatccagactattggaaactgcaacaaaagacccagtttttaaaaccaaaaatgcaatgaaataaaaagagtctcaagagtcatattaattacactggctgcggggctcacacctgtaatcccagcactttgggaggctgaggtgggcagatcacttgaggccaggagttccagacctgcctggacaacatggcgaaacccccgtctctactaaaaatacaaaaattagctaggcatggtggcacatgtctgtaatcccagctactgaggaggctgaggtaggagaatcatttgagcacaggagtcagaggttgcagtgagcagagatcacacccctgcactccagcctgggcaaaagagcaagactgtctcaaaaataaatacataaataaataccatattaatcatatagaccttgtgtgtattctaagtcaaaagaatacgatttttctaaaagtatatagaacaatcagcgaaatatgaacacagaccagacacttgataatattaaggattaaggtaaattttgagtgtgatgatggtattgtgatgatatttgtaaaaaggagtccttgacttttagagatgtatactgaaatatttacagatgaatgatatgatatctggagttcacttcaaaataatgcattggaaggagaacattggtaagaatatggacaaaacaagatcagtcacgaattgaaaatagttaaaattgagtggaggatacatgggggtttgttatactattttttctgttttctatgtttgacatttcccatgatgacaagtttaaaaagaatataaagtgacccaagtttatgtgaacctttctggaaatgacctaatgggatcataactaagctttgcagataggtaaacatctaccagcccaattaccttgagacatgattggaggcgctgagcagcatggcagtgctgccttgagatcatagaaggaatcctcctggtcagtaagtgaacaacaaacagcatggatggcattttcagtttttattctaatggtaatttgtgcatttcctgtcttgtagttctttagcacctttagcccaggcctgctttttttcctcctctaaggactttacagggtgaaactattctctctctctctctcttttttttttcctaatataatattttatttatttattttatttttattttttattattatactttaagttttagggtacatgtgcacaacgtgcaggtttgttacatatgtgtacatgtgccatgttggtgtgctgcacccattaactcatcatttagcattaggtgtatctcctaatgctgtccctcccccctccccccaccccacaacagtccctggtgtgtgatgttccccttcctgtgtccatgtgttctcattgttcaattcccacctatgagtgagaacatgtggtgtttggccttttgtccttgtgataatttgctgagaatgatggtttccagccttcatccatgtccctacaaaggacatgaactcatcctgttttatggctgcatagtattccatggtgtatatgtgccacattttcttaatctagtctatcattgttggacatttgggttggttccaagtctttgctattgtgaatagtaccgcagtaaacatacatgtgcatgtgtctttatagcagcatgatttataatcctttgggtatatacccagtaatgggatggctgggtcaaatggtatttctagttgtagatccctgaggaattgccacaccgacttccacaatggttgaactagtttacagtcccaccaacagtgtaaaagtgttcctatttctccacatcctctccagcacctgttgtttcctgactttttaatgatcgccattctaactggtatgagatggtatcactctctttttttttttttgagacagtctctgttgtccaggctggagtgcagtcgtgtgatctcggctcactgcaacctctgcctcttgggttcaagcaattctcgtgcctcagcctcctaagtagctgtgactgcaggcgtgcaccaccatgcccagctaatttttctttttctgttttttttgttagtagagatgggggtttcaccatgttggccaggctggtcttgaactcctggcatcaagtgatctgcctgccttggcttcccaaaatgctggaattacaggactgagctaccatgtctggactattccctagttatataggggaattttccaatatcaccagagtctatagtttcattttcaatataatataaatatcttgggtatatatacttttatctcatacacacacacacacacacacacacacacagaatataagtcctagataaatacatacgtatacatatatatatatatatatatatatatatatatatatatatatatatatatagtcccatagtcccttatatgtatataggactgtatagcctccaagcgttttctagtacagtcattcattctgtgaatattaaatgcttaaatgcctggcattgtactagagaatgaggatacagtcttttcatgtccagattctagtatagggagacatcaatacacaggtgaaaaaactaattacagattttggacagtgttatgggggaggtaataagcagagctgtggtgaagactgatggacaaagaccctgctctagcaagaaaaggcctctcagagcatgagacgtttaagctgaaatctgaaggataaaaaggaggtcctgatgatgggaacagcggaggaaaaagcattccaggtatagggaacagacagtgcgaagacactgaggagggaaaaagctggtgacaggaaactgtcaaggtctattgtagagcaaaatgagaaagatggagagtggcccaagggataggagctgatctcgtcttcagaataaccatgtggcactgtcttccttgttccttagatttcacagataaggcaactgaggcaaccctctgtgtcattgctagtaagtcacagaatgagagcttgaatcttcttcaccagactccagatctagtgttccttttgagtagataaaataaacctgttagaatcttagtctcctcttggcttactttctcacaaccagaggggtcagtttaagctgtgcttggcataaccagagtgagggacccgcattgtaagagaggcaagatcccacatgctcctgaaatcaacgtcaggatttcttcacaggtttcgttgtgggagtcggaaatgtgggcactactttttaatgtcttagaagtgtctgtgggtacatagcagaatttactgtcacatccatctgcttctctccctctgtcttgctgagtaacctgccatttcagacgagaagcccgtgccacgttatgtcatcagggtccattaagagattactctgattccagaggaacatccgttccgaatacagaggaacttgctttcatcttccaagggatgccaattgttgattccttgctcctcttcaaagggaaatgtgataaaaatccttctggaggaattttcctactggcagtgatcattttcatagtgaacttgagccaggtcatggagtggaagaaatgtaatgttcttacagagggaagatcttgcttcattaaggaggagtaagaggaggatggggaggaaagggaggaggagaaagaggaggaagtagaggaggaaggggaaggagaggaatgagaggaggaagaggatagggaggaggaggagaaggactaaggagcagacaaagtactaaccaccttccatactcatgttaatcatcacaataaaccagcaaggctgggaattatcacctttctcgaaatgagcaaactgagggtaagcaaggtgaaaagacttgcccaagttcacacagataggaagaggctgagccaggtccctgtaactgcatttgcctgagtcacatagcttctccgtggatactttgaaaagtgagtggcccttgctttctagaccaaatcacacacaactctaacttgcattgggaactgacaacccattgctttttctttatcagttggtgctttcgttatgctgtagcattgtcatgtttacaagtataacatccaactgcctcattttgcatggaagaaaaggctcagaaaggtgaagaatgtgtccaaaatcatccagtgaatatatggcacagccagcatccaagttctaactccaagtctagtgccttcttctcaaaccacagctgtcttgttcttgcccaagatctttttcttcatcttcgttgttaagctgcagggttgacctaattaaaaagttttatttttttatttttatttttttgtgaattagtagagattttcaatttgcttggagctgagattgagctaagagaggtatttactcaccaaagtctactccccaaggaaaagccgaccgaattgaagtgtgtgtgtatgtgtgtgtgtgcacatgtgagtacatgcacacatgggtgtgcacgtgtgcatatgggatatgaggaggagagtgggacacttttatatatgtactggttaaaatttagtggcaaaactgcctgaacgtgtgctgtggttaatgattgcttgagctctgccttccactctcagctttggagtgggtggtacgctgtatacagagcacctagcgtgcgcacagaactctcctttcatttctacacataaagggcttaacatagtatctggcagatggcatgcaatgaaattaactttaattataattatctcatttagggtgaggtaatactattttttcagttttacagattaggaaatggagacttcaaggcttaaataacttcctaaaatcactcaattagcaaatgataaacccaggactcaaactccggtcagtcctccctccctcccccctccctcccttgctccaagagtattgctctgttgcccaggctggagtgcagtgacacagtcatggctcactgcagccttggattcctgggctcaagcgatcctcctgcctcagcctcccaagtagctgggattacaggcatgtgtccccacacctggcttgtttaatttttgaaaatggtgtcttgcatgccagctttagattgagcaggactatgtaataaactggctggtgagagattaatcactatgatcagttagagaaggtggagagtcaactctttctttgttgtcggaatcagaaccaaaattattttgggccctcctgtttcaggtctccagtgaatcttatttacagcagtgaactgaacacatgcagaaaactattttgtattccactcatgtggcagcctttgcctggtacgacttggttctcagatgtcatttgtcacgcgatgtggtgtcaggctggccaccggatggatagtggcttccctcggagggatatatctacaagtgacgccagctgaatggcttcagaggacatgcatcatttgtgaggctcctaaaggtgggagctgtgcgcctgtgatttcattactggaattagagtgccggctttcatttttctattaattccactgatggtattagtcgtgttaaaaagacagcacaaacttggctctaagtgttcttggatgctgaatgccaccagcacttctgagtctcagttggttcagggtcctggagcttgcagttttctgttgggtttcaaacgccaactttaaagaggaggcttgggttccactcttaatgctaataaaagactcacagaacagaggaaggaacgttcaacaaaggatcagaacaccgggatctggcagcaacttgtttggttacaggagaccagttagtgtcctgtcctcctttggacatgtgagagagttaggttacataagtgtttcccagaatatggggctgcatatcacctcaggtaaatgagatggctttaggtggtacacagccccagttaaagaacacagactcacatagtagtcatgccatggtgtctggccaggatttaatgatatggtttgctttatgttcaaggtgattatttatgtaagtgacacgaggctccccatttatgtaagctataaaatttcctttagaatagcttaattacattttaaaaagttggtttatagactaataataaataatgggaaatatctgtgatggaagttgaagagaaactgtgattgtggagttgtctatttttccttttagttccattctgtatttttgggggttctgttattaagttcatacacatttatggttattatatctttctgatgaattgacccttttctcattatgaaatgcccctccgggaatactgtcttgaagtctgttttatctgatgctaataaagatggtccattcttctaacattttctggttgtgtgttgtatctttttccattaatttactttgaatctgtctgcgtctttacattgaaagtacatctcttgtaggtagagaatagttggtcttgtttttgtttgatccattctgagagtcttcaacttttagtccacagtcatttaatgcagttatcgatgtgtttgggtttggcatgtttattgttgtttctgtatttcccctctgtttttcatgtctctcttctccctttcctgctctgttagttttctgttgctgctgtgacgaatgattcacaaaccgaagagttgtggaactgaggttcccatttatttgcagtctgtggatggcaggctggtctttgctcctagagacttctttctcatgctttccatgtagctcctccagcaatggtgaatgaagatcctctgacactttgagtctctctgacttcttctctgctacttctctgactccagctggagaaagttctctgtttttcaggggacttgtgagtaggatccatggaataaaccaggataatctctccgtttttaggtccataatcacttttttcatgtaacataacacattcagaggttccagggttaaaggtgtggacatctttgggggattcattttgcccattatatctgcctttttatggatttttagagtatttacacactttgttttaacttatttattggcttttaatctatacctctcatctcaatagatgcagaattatcttaatagatgcagaaaattatttaaaaattttaatactttaattcctataaaatttaaactatttccttctataaccagttttctgagtgttttcatgatagaagtatatccaataaaggtcaaatacaacaagcccacaacaaacaccatactcagtggtgaaaattgagagcttttcctctatgatcaggaacaagacaaagatgttcaatctcaccacttctattcagcatagtactggaagtcctagccagagcaattaggccagaaaaagaaataaaaggcttccaaattggaaaggaagaagtgaaattatctctatttgcatttttaaagtgattgctctagggatcacatgaaacatctttagcttttcacaggctacttagggttggtattgcattgcttcacatacaatgtagaaacttttcagtatagggcctactcattccccttgtagcaggacgagccgcagacaaaactcctcagacacggagttaaagaaggaagaggtttattcggccgcgagcatcggcaagactcctgtctcaagagttgagctccccgactgagcaattcctgtcccttttaagggctcacaactctaagggggtccacgtgagagggtcgtgatcgattgagcaagcagggagtatgtgactgggggctgcatgcaccggtaatcagaacgaaacagaacaggacagggattttcacagtgcttttccatacaatgtctggaatctatagataacataaccggttaggtcaggggtcgatctttaactaccaggcttaggtcaggcaggcccaggcctgatttcgggtctggttccttggttttgggtctggttcctaggcaccaggctaactgcctttagtttcgcttctctttctttttctgagtataaaaccgtataaaacaatgtgagagggcctgtctctcttcttccaccctcaccatcctgtatgctatagtgttatatgcattgcatctgtacattaataccccaagaggcaatgtaaggatttgtgctttaaatagtcacatgcatatgtatttttttaattaaaagaagagtcttttatgcttatccagatatttatgcttctaatgctcttcattaattcctgaaggaattagagttttcttctggtattattttctcttgtatcagcttgaataacttcctttagcatttcttgaagggctggtctgctggaaatgaattctcttagttttattttatctgaaaagtctttaattctttttcattcttgaagggcattttcactaattatagaatttgttttttttccccccagcacttataaagacattattccactgtcttctggactctgtagtttctaatcttaagtctgtgaaaaatttgaatcattgttctctatatataatgtgctatttttctcttgctaattttgagattttctttcttttgattttcatcagtttgactgtgatgtgcctagcatggttttctccacatttgtcctatttggggttctttgagtttcttgaatttgtaagtttatgtctttcaccaaatttctttttggccattattcttcaatattttttccccttctccattctctttcttgtaggaacttttgaaaccacctttgcaaaaattataactgagaaatcatggcagtgaaagagatctgacttaagtgacttcatcttgcttctaacctccaagttgtccttgtttttcctgggcggaggtgtaggccaaaataaccttcagagaaacttagtttatagtttaactttgaaacaaagagatattagccctttcccaaaacaaacacccttcctgcctggggattgcctaaagccagaggatgagaaattatggtttaggagtcatgcagttgaaggctgcaagactctaaagctccccaaattgctcctggggataacatcactattgtaaaacctaagatcggtacttgagatattttgcagacccttcatctgatggatcagttagcaccacccagattgataaactggctcatctggccttgtggcccccacccaggaacggactcacagcaggaggacaattttaacgccctgtgatttcatctccagacagccaatcagaactcctgaatcactggccctctacccaccaaattatccttaaaaactctgatccctgtattcttggggaaactgattttgagtcataataaaactctggtctcctgcacagctggctgtgtgtgaattactctttctctattgcaattcccctgtcttgataaatcggctctgtctagacagtggcaaggtgatcttgggtggttacactttaatcacatgtatgttagatctcactctgtcaatttataaaagcccctctgcttaagtcatttctattgatctatcttcaagctctctgactcctgcctatgtcatcttcattctcatgttagttctatccagtaaattctttatttcagatattttgtttttcatttctaaatgttcttttttttattttcctcttctgaggcttcctacctttttctttgtgatgagcatattttcctttacctcattaagtgtattgttagaatagctgctttaacacctggatcatattgggattggcctctgttgattgtcttctttccttgagaatgggtcagatttccctatttcttatatgtaaagtaagtcttttttgcttgagaatgggtcagatttccctacttcttatatgtaaagtaattttgaattgtactagcactttgtgaatgctatattgtgggttatatttccttaaagagtattcatatttgtgtcttagcaggtaactaacctggttatacttacatttccatatctgtctctcaggtggaggcttagttctcagtcctgttgggtttaaatgcaaactactctgagccttgtctactcaccctttgttcaaggactggccagaggcttgggcagagtttacatatacatgccaagaattcccttctctaagtctcctctttctggggtttttatattctgctggccgtggacttccaggtctctaacttccacctcctcaggccagaaagaggttggctcttccactagatgttgagccacccggtgccattttgggacagcagcatgctgtcagacctaggtggcaaaaatgtagaactctatgatgagcccttcttccatgtttcaatgtccctgtgaaatctactggctatttttactctacagagccttcaggtatattttttttttccttctagctttaattttttacctgtttgggtgtgggagggaatctgttaagagatttcctaccataccagaagcagaactctggctatcttctgctgttttcttaaacttctacactgctggaactatttttcagataaactagatcagataatttttatggtaaagttagactgacatgtcatcatcttcagccatctcattttcttacccgacattggcagttttacattcttatatattcttgctacaagatacaggagctagaaacaagaatcattttattgtcagtcacagttctgtgggttgactgggctctactaggtggtttttctgctccatgtaataacagctgaggctacagttccctgagagcacagttgggctgaaatgtatgagatggctcatgacatggctaagtggatggagctggctattggcttgggggcgtagctcactgcctaatgtaacctttttaagtggcttggatttcacaaagcatggtggttgagttttgagttgacatacccaagggcaattgttatatcagggaagaagtggaagcttctgttttactgaaaattaggcttttctattggtcacatagtcactgtgctggtcagattcaagaggagaataaagcaatccacctgtcaatgggaagaataacagaaaacagtgtgggcatccttaattcaccccacctcatactgtctgctcttatttgtcacccatagcctttgttcatgccttgatcatctctttatagaattcctgaaatagccttctagcctctccccttccccccagtcttgcctctcaaatgactatctacacaactctttgtcttctccagaaaggcttcctttatttcccagggtgaatgagcctctcatctctccattattccatagcattctgtaatactttaacatttactacattgttctgaaatcataaaatctatttgtctgtctcaccaaccagtctgcgtttctcaggggaaggaactatatttgatatatccaatatttctcctgttgagagtttaccagcctgtaattttcttaaggtaggggactctgcctgctttatttattttatcttcagtacctaactttgtgtctagctcatcagagatccttaatacatatttcttgaaccaaaatgattttttttaaattcacattgtcagttaaggcagagcaagaactcgattccagatttatttcccctctaatttacttctttctagggccctccagcagccaagtgaatctaaacaatcctcaaggcctcttttccttagcagatctatcgtatctttatctccatatctcaaaagcactttctttcatatgttttaaaatataaactgagcttaataagatgaaaaggtttcaggattttcctgcattggtctctactccagtctctctagtgggcaatgcaccaaaacactgctctatttcctagctttaaacttgaagaaataatctccaagctccagggctaagaaaaggattgtacattaaagacttgttgctttggactatgaaccttacaggtcaatttttttctggaatagtgctaataaagagaaaacaagttaaattattcacctggaggcctagcaggttgtatcctgaaggctgaagtcaagtgcttactcaaacattgaatttgagctgcttttttctgtatcagcgatcccaatgcttggtgcagaacaagaactcgagatttctttgacgtcaaggttggctctacctagagtgtgattcttgaactgtagtgtgtataagattcacacggagagtgtgttaaaacaccaaccccaggccccacttcagagaattctaattcagtaggtctaagatggcgtgcgggagtaggcgtgcctgtgagtctcctgtgagctgctgatgcagctaaggctttaaggcagagttgttcagcagtggaattcttgacattttgggctagataattatttgtgaatagggagctttcctgtgcattgtaggatgtttagcagcaaccctggtctttacccactgggtgccagtcataccctgcctcctagctgtgacagctaaatgcatctccaggcatagcgaaatatcccctggtggagcacagtcattgcatgttgagaaccactggtctagggtatctggatggctgtggattgaggtatcactgagtaagtttgggtggtggatgacaaggtcagttttagagtctgctgagcttaactggcttatggggcaccatgaacatccagttctttaaatatcaaagcccagtggaatgatctggatttggaaggcattggcatatatttaaaaccatgaaggatggataaaatgtccaagtaaatgatgtacccagtgaggaacaatggatgcaacacagagccttggggaacactaactcattaagtggcgagtgaagaaagtgtgcatctaagaaggaatgatagggggatataagagaaggacaaggagaaaaagatgtttcaggcagcaatggaggagagtgtgtcaaggagaaaagggaggtgatgtcagtagaggaaagattcggtaacaccaagttcaaaaaaggaccatgggacgaggagatcaccttgaccacagaaacctgttttgtgcaacaggatggccattgactccctgtgtctactgagcatttgaagtgtggctagtgtgacctgaaatgtgctatatgtgttaaattcactctgaatttcagacttgctgtgaaaaaaaagaatgtgaaatatctcattaataataatttttatattgattgcacattaaaatgataatatagtgagttgaataagatacattattaatattaatttcaactttttctttttactttaatatatgtggtttgagggcagggcgcagtggctcacacctgtaattaccagcactttggaaggctgaggcgggtggatcacctgaggttgggagtttgagaccagcctgaccaacatggagaaaccccatctctactaaaattacaaaattagctgggtgtggtggtgcccacctataatcccagctacttgggagactgaagcaggagactctcttgaacccgggagtcaggggttgcagtgagccgagatcacgccaccgcactcccgcctgggtaacaagagcaaaactctgtcaaaaaaataaatacgaccaggtatggtggctcatgcctgtaattccagcactttgggaggccgaggtgggtggatcacctgaggtcaggagttcgagaccatcctggccaacatggtgaaaccccaaatctactaaaaatacaaaattagccaggtgtggtggcgcatgcctgtaattccagctacttgggaggctgaggcaggagaattgcttgaacccgggaggcggaagttgcagtgagccaagatcgtgccattgcactccagcctgggtaataagagcgaaactccatctctaaatacatacatacgtacatgtatacatacatacatacatacatacatacatacatacatacatacaagtcaatagaggcaaagaaatgatagatgcaggggagagaagaaggaaggaagcaatacaaagcctagagagattgtcattgaatggatagggggagtgtcggggagattaacttgtatctattttcaacctctttcagcctcctccttttttcctgcaaaatgggagtaagaatcacgttgcaataataacgcctacccactgggttgtctggaggtttacgtgagataatagatggggactacctttggaaataatgaaacactgtatgaattccaaccgcagtcataagtgtctttctttctgacatttcactgtctttgcctcctaatgcattaataattcatactgttttaaaatttttttaatttctatttcaatagtttttggggtacaggtgcttttggttacagggataagttgtttagtggtcatttctgagattttggtgcacccatcacctaagactactaactattgtagtcttttatccctcaccccctcccaaactttccctacccctaagtccccaaagtccattatgtaattttttttttgagatggagtctcgctctgtcgcccaggatgcagtgcaatggtgcgatcttggctcactgaaacctccaccttccaggttcaagcgattctactgcctcagcctccccaagtagctgagactacaggcgcacgccagcacgcccggctaatttttgtatttttagtagacacgggtttcgccacgttagccaggctggtctcaaactcctgacctcaagtgatccacccgccttggcctcccaaagtgcggggattacaggcgtgagtcactgtgcccggcccattgtatcattcttatacctttgcatcgtcatagcttagctcccacttataagtgagaacataacgatatttggttttccattcccgagttacttcgcttcgaataatggcttccagcttcatctaagttgctgcaagacatcattttgttcctttttatgactgaatagtattccgtggtgtatatctaccacattttcttgatccactcattggctgatgggcacttaggtttgttccatatctttgcaattgtaagcataattcatattctttattaccacagagtcgcaggaagaattcaccccaaatttcaaaatgtgggacctgctgaacacagaatctaccactgaagtgtcgaacatgagtcacttaatagtgctgaactaatagtgagaatttcatcgtgagaacttaacagtgactcatgtttcactactgctgaaggctgaagtgtggaaaatgagtcactattaaacaaggaagggcactgggtaacctttgtgctgtggttctcaaagtgtggtttctggaccagcatcatcactatcacttgagatagggccaaaatatgcacattctcaggcccatatgcatcctactgaatcagaaagtgaggggcagggattgtcagtctgtgttttaacaagccttttgggtgattctgatcgaggcttatacactgttggtgggaatgtagattagtgcagctgttgtggaagacaatgtggcaatttctcgaagacctaaagacagaaatattcaacccagcaatcccgtttccaggtatataccgaaaggaatatagatcgttctattataaggacacgggcatgtgtatgttcttgcaggactgttcacaatagcaaacatatggaatcaacctaaatatttgcccatcagtgatagagtggatcaagaaaatgtggtacacatactccacagaatactatgcagccataagaaaaggatgagatcatgtcctttgcagggacatggatggagctggaggccattatccttagcaaactaacacaggaacagataaccaaatatcatatattattacttaaaagtgggagctaaatgatgagaacacatggacacatagagtggaaaaacacacaatggggccttgcagagggtggagggtgggaggaggaagagagtctggaaagtaactaataggcactaggcttaatacctgggtgatgaaataacctgtacaacaaacccccatggcacaagtttacctgtgtaacaaatctgcatgtgtatccttgaacttaaaagtaaaagaaaagttgagaaccctgccctcgtgcttgtcaaatcagatcaattctctataagtgcaaggattctcgaaccttgggaaactagttaaaattcagattctgggcttaaggtgctgcatatttaaaagatcccaagattattttgataagctaccagaaagtattgtaaagcagcaattggcaagtgttttatgtaaaagcccagatagtcaatattttaggcttggcaaaccaagaggccacacattctgctgctatagcacaaaggcagccacagacaatacaggaaagggcttggctgtgttttggggctatataaaagaggctgtggggaggatttggtccacaagccatggattgtcaacccctgctttagaatgtaaatatcacccttgattgtgatcctgggtgatttcctctccattcatttattccttaattccacacattttattttattgggtctcagctgtgtgctagacatggactggacatcagagatggactgttggcttcctggcaggatccttgctctcatggagcctgccatctcttcaagtgtcgaggaaattattaagtggaatcaaaatcggttgtgatttctgcttaaaataggggaggtagagtttgttcactatcccaaaagtctcttattctatagctcagcccaacatgctttgtgttctatttcctggcttcctcactgcccaacttttaatgatattgaggcagctttggggggcatttttgttccatctccccagttgcctggaattttttgcaaatggttaacaaagttccgtttaccaccaggctgtagccatttgtgagtcagactagaccagctggttgatacggcacagagggttaggagaggaatctgttctagctgttggtatggagatgctgaaacaccctgcagtctttgttctgccagcgtgtgagtatgcaactgatagtatttagtgaagaagccttactttattagaaccttttgcctaaatggaaactctaggtttgtacatcatttggagtagttccctgagacctgagtattcccaggatttacacctaacttggtttatatttgcatgcttattggtccagaggatttggcatttccttctcatactcttgaatcacatttaataatagtaatatagttcctgacaattattaagcacacactataagccagacgttgtgctaaataatttcacgtgtgataggaagaataatggcttccctaagatgtccatgctgtgaatatgttgcttatagtgtaaaggggactttgcagttgtgagattcagggtttagtaccttgagatgcggatgatcctggattagcaaggtgggaccaacttaatcctgtgaatcctcaaaagtgaagagcttttccaggatgtggacagagaaagatgtgaagatggaagagtcagagagatgcagtggtgctggcttgaagatgaaggaaggagtcataagccgaggaatgtgggcagcctctgaaaggtggaaaagtcaaggaagtggattctcccctacggcctccggaaaggaaagcaatcctgctgacaccttgattttagtccagcgagacccatttcacatttcagaaccacagaagtgtaagacaataagtgaggattatttaagcccccgccaagttgatggtaatttgtcatagcagcaatagaaaatgaacgcaccatggctgatcccattaaattgtcacaagaacctcaattaagcactaacagtggtcacattttcaggaagaagaattcaaggctgagtaattgtgcaaggtcccatatttatcaagtggtagatgcaggattgggtcactggttccagggccacacttgtactgtaaattcatgtaagctccatggtatgaaactccatttggatatttgacgattcccttcaagtccatgcggcagtgcctttgcacacatgccttcaaggatgctgttgcctcctccaaagagtcacctgcaatctctgctgcttcatcctcaggctgtgttgtgttttcttgggagccctctccaaatttgcaatcaacccacgtggccccttcctgctgtgcatcaagacaccacatgccctatcacagcacttactgcatggtgcggtgtgactttgtgtctgtctgtccactagactgtgagttctttcattcctgcaccacaagcacttcctctcctccaccaggacatggcactatgtctggcacatagctctaaaatgcaagccccatgaggcagggagtttgtccatcattgctatactccagtgcctagaatagtacctggcacagagtagctatatagtaaatatctgttgaatggatgaattattgaatagcagattctcaataaatatacagaggctgaaggttaataaacctgtagtaattatctaaaagccttttgtttatgtttcagtggtactttatggaggcatagcttacatatagtataatgcatgaatcttaagtgtaaagctcaatgaatttttacacatatatacaattgtgaccacacagatcgagatgcagaacattttttaaaaaattgtttaacaccacatgttttcactcataagtggaagttgaacaatgagaatacatgaacatagggagaggaacatcacacactggggcctgtcaggggtggggggcaagaggagggagagcattaggacaaatacctaatgcatgcggggcttaaaatatagatgcacagattgataggggcagccaaccaccatggcacgtgtatacctatgtaacaaacctgcacatgctacacatgtatcctggaacttagagtaaaatttttttttattatactttaagttttagggtacatgtgcacaatgtgcaggtttgttacatatgtatacatgtgccatgttggtgtgctgcacccattaactcgtcatttagcattaggtatatctcctaatgctatccctccccgccccccaccccacaacagtccccgatgtgtgatgttccctttcctgtgtccgtgtgttctcattgttcagttcccacctatgagtgagaacatgtggtgtttggttttttgtccttgcgatagtttgctgagagtgatggtttccagcttcatccatgcccctacaaaggacatgaactcatcctattttatggctgcatagtattccatggtgtatatgtgccacattttcttaaaccagtctatcattgttggacatttgggttggtttcaagtctttgctattgtgaatagtgccgcagtaaacatacgtgtgtatgtgtctttatggcagcatgatttataatcctttgggtatatactcagtaatgggatggctgggtcaaatggtatttctagttctagatccctgagcaatctaccgatttccacaccgacttccacaatggttgaactagtttacagtcccaccaacagtgtaaaaatgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttgttttgagaagtgtctgttcatatcctttgcccactttttgatggggttgtttgtttttttcttgtaaatttgtttgagttcattgtagattctggatattagccctttgtcagatgagtaggttgcgaaaattttctcccattctgtaggttgcctgttcactctgatggtggtttcttttgctgtgcagaagctctttagtttaattagatcccatttgtgaattttggcttttgttgccattgcttttggtgttttagatatgaagtccttgaccatgcctatgtcctgaatggtattgcctaggttttcttctagggtttttatcgttttaggtctaacatataagtctttaatccatcttggattaatttttgtataaggtgtaaggaagggatccagtttcagctttctacatatggctaggcagttttcccagcaccatttattaaatagggaatcctttccccattgcttctttttgtcaggtttgtcaaagaccagatagttgtagatatgtggcattatttctgagggctctgttctgttctgttttggtaccagtaccatgctgttttggttactgtagccttgtagcatagtttgaagtcaggtagcgtgatgcctccagctttgttcttttggctgaggattaacttggcattgtgggctcttttttggttccatatgaactttaaagtagttttttccaattctgtgaagaaagtcattggtagcttgatggggatggcattgaatctataaattaccttgggcagtatggccgttttcacgaaaaatctcaaaaattttgtttaaatttaagaggtgcatgtgcagttttattacatatatacattgcaaagatatagaacatttctagttccctatgaagttcttatttgctcccttctcaccaaccccaagataaccattattctgaattcaatcatcatagattagttttgcttgttcttgaacttttataaaatttccattctgttctgttataaatgggcttgtatagcatgcctttgttttgtggctggcttcttttgcttcagcatgatgcttttgtggttcattcgttaggataagtgtagaaacctctttactcctgcactctcctagtgatcccccacccctgcacccccatatcattagatgagttccctgtctggagcatgtgaccttctattgggttgtagctgcgtatttccatcagagtggtaaccagagattcagacttggaatgtcttcctccgggaccacagcttcagtgagatagtagttcttggtacatggttgaggcttaataaagagccattaagtaaacgagtacgtgaataagtactgtacttttctaatagtcttttgggtgctaaagtcatacatatattgaatgcttgctatataccaagcactatagtgctgagtattttacatccattaaattgcacgtaaatgacaacaacaataacaaactcgcttgaatggtaaatgttattagctcaagtgtataactcaggaaattgagactaagaaaattacagctgggtgcggtggctcatgcctgtaatcccagcactttgggagactgaggcaggaggatcactttagtccaggagtttgagactagcctggacgacattggcaaaacctcatctctgccaaaaatacaaaaattatccaggtgtggtggaacacacctgtagtccctgctacttgggaggttgaggtgggaggatggtttgagcccaggaggcagaggttgcagggagctgagatcatgccattgcactccagcctgggtaacagagccagaccttgtctgaaataaatacataaataaaaataaagtgtataaaaaagaaaaattacacgttaggaacaagtgatacaattaataaaagatagtctggttgacttcacagcatatgctctccctacctacctaggctgcctcgttttccagttaatttttcatttataaaagaaacaggctaattatggaaaatttgaaaaatacagaaaagcagaagcaagaaaatgtaaaggcatccatatgctacaacccaagaacagtcgctcttagtattttggggtgtattatctttttgcattattttctgtgtatagttttttatctgtttatttaataaggttatgataaaagtatacatgcaaaattatatccaactttttcatgtaatctctacttaggttgttataaactctgtgtctgcaatctagttcattcagtatttattcaactgatatttatgaattacctactatgggacattgttgattgagcccctcctatatgcaaagctcatttttttccttttttactactaggttctactatctgttacctgggccagatagttgggtgtcaacctggaagccacatcatctctgcctttaatattgctcaattatgtggtttcagtgagtttctaggtttgctggtatgtgctatggtttttgtttgtttttttgagatgaaatctcgctctgtcaccgaggctggagtgcagtggcccgattttggctcaatgcaacctctgcctcccgggttcaagcgattctgttgcttcatcctctgagtagctgggatcacaggcatgcgccaccacgcccaggtagtttttgtatttttagtagagatggggtttcaccatgttggccaggctggtctcgaactcctgacctcaggtgatatacccacctcagcctcccaaagtgttaggattacaggcgtgagccgccatgcctggccaatgtttttaattagtacacgaataaaaccacaagaaaaccattggcaagccctctagttctttgggctccttgctttagcacagtggaaagcctgtgtactaagtcagaacggcgactcctggaataaatcatcccaggtgaagagttgatacgttgcacatcggtagcttgggtggcatatttaaatactaaccaggctcactctgcaaatagattgaagtgattccaaaacctcggtgccataacttgattttcagaatcaggtggaacctacaagcctattatgagctcctatggggagacatgcagggcatgaggaatagaaataggaggaggagacagaacatcataatttcgctctaggtttagggatggaagctggttggtgggtcaggggtgggaaaatgagtgaggctttttatctcttaggagattggagatgttttcaagagggctgtgaatcatttgaggctgatttcagggcactgtgacagatgagtgcaaatccagcctatttctctggtccaaatgaatacttgtccttgtaacactgaaaaccaaatatttgaataggaatgagtattctggggtattctggggtagcatggctcagaggctcctagcagttgttcagtgacttaaaagggagatggttgtaaaaatttggggcataagctgaacatttgtctgattcaacataaattagcaccaattctgctcattttgtgccttttccctaccaactcctctgtatttattcattaattcatttatctaacaaatattcactggcaccttctgtacagccagcacaagggatgtatcagtgaacaagcccatgcttgtatcgattttctagtctgttaaggcagtttatgctttagtgtttatttagcacatactatatgtggcttggagacaggtggaggtaaggtatgaagctattcaggttctaatttctgccctctgcttgcaatctggtatgcaaacgaatatatgcaactgaaacctaatacacagcaagcattctttccccagctctctgtaattcctgatagttcactttggcaaagtgcttccatcccatggggtctgtcctagtaccaatttgcagactatttgcttcagaatctacttaaaaatacggatttctgggtcacacctcagacatactgtgccagataaaatccgtgggaacagagccccaggagaccattgctaaagatatggaagtggggttgaacctgtgtgtgtgtgtgcatgtgtctgtgtggtcattgatgggcatgaggagtagtaaatttggcaattcacggtctggtttgccaagaaagatgatctcagaagaccaacattgcccacatcagcaagagggagccatggctttgtggcaagtcagcattcaaggaggatggatttagtagtaagttcaggtcaggctggatgttattaatggcaattatgataacaactaaatgtattggaagttaattgcatgccagatgcttttacatcaattgccaattttaatcctcacagtcgcttatgcagaagttatagttatcttcatttatggaggaagaaggcaggcacagagaagctaagcaacttcctcatagtcacccagcttggagatagcagagctgtgattctaaagcagtttatcactatctctctttcctggtataactgagaggaaagactagagaagcatgcacaatcaacatggaaaacaagccaaccgtgttctttggggaagcccttcatatcagtggccaagtgttgctcatgggggcaaccaatgtgaaaaccctgctgaaaaccaacaggcagaggcccaggtgatgttcacctgcccaagtctatagaagagttctcaggtgaggttcaaagaggtccaggaaatgcgagaaaccaagcccttcagagtcatcgaggggcatctttcggttgttaaatttcccaattaaggaagagttgagatagccccattttgacgtgctttgctgtggttggtaattctggccctattgctaattatgatgcgatgacatcatttgggtaatctcccttcctattagaagctgcctcttaggttttatatttgctttatttccactactctggccacccagtgcatgcagagaacaactgtggattgtgatattgttactggtaatgtctttcaaagtgaattggggtttcacatgggaaggcatgaaaaaagtttattaaaggtaccacagtatcaggacccaaatactgaagagtgctcgcagaagtgaaagagcttgttcttccttgggtggtccatgagatagggagtggctgtgtcccacagtgagagcagccctgtgtttggagctcaatcctatatccactgtgtgtgtcctgaacatgggcagctcccttaaataatcttccctgagtaaaattaggggctggcaccagatgagtgccaggctggtccccctggctgagaacaagccctagggagatagcacacagggccagagtgaaagccaagggcattcccagggtggaggaagttaggagcattttgtgatcacagagaggcagaggtatgctaataagggaattaacaccttttctctgattagcagccagggaattattgaaagggattagatagaaactgtgaaaagattcttgggcaactgagaggtcagaggaaggtaatagcctcttctttaggtacaaaggaatacaaatacattttattagcagagaaccagtctctttcaccctcaccccaatggctatcttaaagaccctcacacttgcctcctatctgggtacctttgcatatgaagcaccttctttgcaagaggcattctgtcctctcctctttgcctagataacccctactccagcatctcctgtttggagaagtcttcaaccatctaaattgttctgtttcccccattgtgcattcttaatgcaccataagcttttcttacaaaatgtgaatttcaatggcaattttacacgtgtgtagttgtttaattaatatttgtcttttccatctggatcataagctctttgagcgcaggtttcatggctgtttttgttcactactggattctcagccttcagcactgtacctggtccagagatgaataaataataggttaaatgaatgaattaattaaagacacagttaagtgataattgacatctggctcactgtgcagttctagaagttggtaagattcatactatttgtcattcctgtgaagagactgaagctctaaagatcagtgaaatgaagtgagtttcctgagacacacggctcatacgtgataaaccaggacttgcatagatcccctgagaatctgaatttttattcacctttgctttttaagtatgggtattatgtggcttataggtagaggtttaaaattttttaagttaaaacatgaaaataacagaaacaaaaacagaaaacacaagaaagcccacaggacagtggattctttccaaacatctcacttcagtggcagctacatttgaagaaagtctacttgttgcatttaaattacctgtcacaaatcacagtgttcacccagtagcagctaggaggggctgattcaagcccctgagaattgttttgtgtcttgatcatgagtccgaacaacagaactttacaaggatgttgcaagccgctttaaggggtgatggaaccaatgataggaaccagcacctaacacctggcagagactttgtcagcgtgatgcccaagcccctggggatttctgcccaaaggtgatacagcctgatgggtttcctggtttgttgaagctggcggtgagagagagtttgaaagaaatgacttactcgatgctgtgtgacacagggagctcattcgccttgatgcacttaggcaagctgcctaacctcattcaaaacaagccagtaaactagtaaaccaaaacaaaaccaaaaatggaattaggcttctacagtgctggagatatagtgattagtaagacaaaataaaacagcacacatagcccctgcctttctggacaatttgtttaaatggtggacacatacattcatgaaagcagtctataaatcaatgttgattaacagccacattaagtactatgaaaatattaggttggtgcaaaagtaattgctgtttttgccattaaaggtaggggcagtaacagtaatttacttttgcactaacctaatacaagaaagagcatggaagagcggaaatttgcctaatccgtgagggtatggaagacatcccttaggaaatgatgatctagaaatgaatgaaggaagaataggagttggacagagaaggtaagaacagttcaaggaacctggaacaagacaagcaaagtctctgtggtggacacaaggtggccgagaggtcattgcatccagagaggagaaagcaaggtggggaggctgtgatctgtgacaagactacatatcccattggtatccacaggccatgtggtgatttgtggtatttgtcctcagtgacatttgacactgaatggtcagcactgcagtagtggtaagctcaggctgttgagagagtgaaaccctcgccttgactcaggcaaatggctgcaaggatttattgactgcccatggggatgacaccaaactcatccccaacttcagacagtctgtagaataagtacagtctgatcccaggtgatggaaaccacatcatcacagtcactatgtgcataataactgtggagtaagcctaacgccacttggtacaaacttaccactcaacataatgaacataaaggacgctggcctggagaaaggaggactttgactcatattgaattctggattcatcccactgcatgacttgctttgtcgatgcatttcatttaagtctggagaggacttgagtgccgggtagagagatttatttagaggcagaaggctcattaaaatcccaacctttttgttttgttttgttttaagccaggggtacctctaatttgtggcctgaaaattttgctcggcaagggattgaaaaatggagagatgggtttgtatgccaggactgtctaatcaccatcttgtgtgagctttagaaaaggactcattctgcaggctattaatgaggtgagtgtttaatggccccttgatgctcccccatcagatatagtgtcttgagtttttaataagctctgttctgggtcctttacaaatcagagtgttggaacaaatccttgaggagacatcaacagcaagatgatgcaatgtgtgtgagctggaaagagcagccgtcttaactccagagagtgtctaggaatctgtctatctcaatctgccgaccatgtgcacatctaattttcacttcctttttgttctctggggaacaagacacacttagattttacgttttctctgtaaggaaaaggtgatgtccggggtgaaaaactaaggaatcttgttcttcaacattgaaggtatatcgcaagcatgattttggaattaaaaaggaaaaatgttcacttcgttttcctttagcatgtagggagttattttaggatatcctgtgttttctggcacaagtttctctgtctaggacagaaggattgacatagaggacattggggaatggggaaaaaagaaagcaggaggaggagccccctgaccccagtttgaatcccagtattcagagaaattcttctctatacctctaaaatactgttgtgtttgagaagaagcatggggcagttggaaagtgttggaacgtcctccactgtcccctttactacttctgcctccttcactcctctggaccactctgaggttgtgcttctacctactccacttgccttaaagtcccaggtgaacatctcactgcaccacacagcagtacctttcagcctttgtcttcctggacactagacacctttcacccctgccttcgtcttcaagctctctactcccgtggcttctaagttatcgcattccccggctttctcctcgtacctctcctacattccttctctgcctcttttccacacacactctccttcttttgttaggggatgccatgcacagctgtcaacaactaccgcccccagcagatagacaacttctaaatctcaagcctcagccctgacccctttctcatcttcagacctgcctatccaccttcttggtggactccctgcagggaggtttcaaaagcagctaacctaaacctgaattccatatgcatttctctgtccccctacctatactcacttccacccttgctcactcattcattcaaaaaacatttacagagtggctactgtatgtcaggtacaaggctaggtgctggagctacaattgtgaggaagaaagcagggtccctaacctgttctccacttttgtaagtgacatcaccattcacttggcaatcctctttcactccccaatctccctgccaatccgatccatgagttgccaagaccagttgaatgtacctcctaaacatctcttgaacctctcttttgtgtatctgtattgcagcaatcctagttcagatctttctctcttttctggagttgctttagtgagatttctctgggcctgcttttctgccttcattcattccctcctccaagcccttcctcatactcaagctcaagtggtccttcccgaagataaaaacttgctcatgtcacaccgctgctaaaaaattctttcatggattcttctcgtcaaccccagaaagcattaactccttgtctctttttttcactccctgtctgtgtctctccatccttcctcctttccatgctctttcttcctccctctttttcttcctttttccctttttctctcactttcttgttgcctgactttctctctttcattcaataattatttgaatgtctttaatccaatcccacagatataagcattgagttcctctctgtggcaggctctgtcacgtgtacttgggatcaatgaacaaacagaatatacctgacttcatggagcttatattctatcaaataggacattgaacagacagaaaatattaataataagcattgtaagtaaatcatatgagttatatggaacgtaaaggtgacagataactatggaaccagattcaaaggtatttctcattgtgagccagagaggcatggacctaccctcgggccctgcctcttcccctagccacacacttctctggctcttttttctttttttttgcatgtgtttcttcagcactaagctgctcacattcccagtgggtgccatgttcttcattctgtgtgtctctgcacactgtctttgtacactgtcctctctgtactctgtctccagacctttccagcctgtgccaagttgccctccatctacaaggacctcaggggtcactgggaaccctttcaccctctcttgctgggttgggtgggtccccttcctctgcattcccttggtgccctgagctttctttggccacaactctcactactggagcatgctgagggtgggttgagctctgtggctccatgactttctttctgggtgaggcttggaggccagtgaaccctccacacttccagccttaattttctcaggtacaaagtgtgaaggagagccttctatttatttctcgtggttgctacaaagtttgcagcaaatatgaaatacccaagggtgagcggtatcgttgggggctgggaggtcactgggcagtgagtgtcagggcttctctgtcctctgagccctgaggaaggagtgccttctgtgttcatcaacactggagaagacaaacttacctgaggttgaagaacacatgggctgacttgggctctcgcctgcaaccagctctgagtgtgatgggagccaggaagccctggggctcagcatgaacacaaatggaccttatttgattgtgtttttctcctttcaaatagtaatttggacacttttcagaggctgacattcaatttctttttctatgtcacttcggagaaaaaaacaaaccatcatttttttctgttaaaatctctcccttttccaccccttgtttatgctcctaattccatttgtgctcagagtttaattgtaatggtgagctctggtcatattagttcatcctcttcttttgagctgcaagtgggtcttggacaggctgcccagcttagtacttgctgaagagaacaaacagatattagctttttgacatgcacgcctgtgcgcacatacacaaacacaaacacaaatgcacccatgagaatttagcgttgctctgttaaaggggcagatgatattctgtatttggtctgctggtctccaaagcaatgagaggtgaataaatcggatgcccataagatgcttatttacataagttaaaggatgctctgtattgtgttagcttcagtggggggagtgatttgcgagcagaatattatgctccaggaaaacagtgcagattaggttgctaaatctcctggcattagttcagggtgcattcttctgctgtggatgcattgcttccagaggaagaagctggtgatggaggaagcactgtgctggggaagggttgatcttcagatggtatctgaatatatgggagaatgaccaggtaaaggaaagggagctcacaggttaagcaccgataaggagggaggtgcacgttgtcagtggtgaagagcaagggttttggaatccagtaaaatttaaattaattagttttgacattagacattaatactaccttcttcatggggtttcgttaaagactgaatgagataatgtggaagaaatgatcggaatgcaataaataatcagtaaacagctactgtacatgagctcatctgatctatgaagttggtggaaattgcttttcctgttttacagcctaggacacggaggcttaaggggttgagccagtttctcaaggcaacacgggtagcctgtggaagaactgaggtttggacctagatgtgtcttattccaaaatccttgcgccttccactgcactaagccatctcccatgatttggctgggactctgctcctgcaaagcaattatagctgtcctgtttgctatctgcttagtagcctcattagagaaggctgtcattgtagcctattcaagttgtagggctctgcaaagtgagaggggtgaaaatgatgcttgcaaagcttcctgggagctttggatacctagaaggagcaataagatgtgggtctccaggtacccacatctgatgggtggtgacctcctccctcctagacccttggtagtttcttttttctaccttggctagggcctcaagtaaccatgaggtccaagggctccctagggatcctctcacaccacctgcaagactaaagatacctaggaaaagctttaggtgaggatatgtagctgggagaggagaacacataaaggggcttgggagtgggctagagattaggggagggaaacagtctgtccctgtgctcacaagagccctcagtcatctctgacagcagcaaggacatgggctctttttggaatcaattcctttcctgggttttgatagagaaggaatccactttgcctgaatctgtttggttcctgaatcctagagagcaagtaacaagggttcagacagtgaagaatgccagcccaaccctcctcagaattgtttattactttcctgccttcagattgtgagagtttgggtagcaatggattctcacactgcagacactcagttctacctctgagccccctcatttcacaccccctgttcatccagctctcacttataccctgccctctctaacccatcactgtgctactaactcagccactgcctttctcactggatgttcgtttatttcttcaatctcttatacccacaactcatgtcacatccacccatccgtccatctgttcatctgtccatccatccatccatccacccacccacccatccatccatttatctgtccgtccatccatccaaccacccatccatttatctgtccatccatccatctgtccatccatctgtccatctgtttatcccatctctccattcatccatccacccacccgtctacccatccatccatctgtccgtctatccattcatccatccattcattcattcattcatcctcccaaccatccatccatctgttcatttttctcttccgtcatccatccatctaccctatccatctatccactcatctgtccattcatctgcccacccatccattcatccacccacccatccatccacctgtccatccatttgtcctatttgaccatccatccatccatctgtccatccattcatccatctatccatccaatctattcatccgtccgtccatccatccatgcattcgtctgtccatccattcacctgcttacttataccttcactgaatgtgttctcagctccccatgtactgggagctgggctgtgtgctattactgtacagatgaattagcattaatctggttgcatggagacagctatttaaatagacacctaaaatacctggtgacgattgacaatagagacctggacagtgtgttctgggagcaccgtggaggtggaggggagagaggaggcggcagctgtttcctatttcctcagtgagctcccacattagtcccctacctttcagttcatggagctcttgctcattaccctgttacagataccccagctcccctccaggtaattagaaaactgccaggtccattttatagatgaaaaaaatggaggctcagggagacccagccacttgcgtacatttgtgagctgcagcgctggcatgcagagaagggtggctatgcataccctggggtcattttctttgcttggcagatggccatgggcaccataggactgaccggtgcttccttctctctctgtgctcttctcgttcctggatggcttcagttctctcccaggagtgaggcggttcaccccagggtggcccctcttcctttactcccatgcagtatgttctgactcataactgaaagtgttttgctggataagacgatggggactgacaggcatgacatacctgtgatatacctgaaggaaacacacggtggtgagaatgttagacatcagacactgtcttatgtcattgcctagtcctccctgggatggacagaggtcacctggcaccaggacccctgggtcagaaccatcactctgagagatgcttgcagcatgatattgggcatgccatgtgacttgacctctagaactttgctactgaaagcttggtccatggactagcagcaactgatgccactcgggagcttgcttgcaatgccccagcccccacccgctgtgttttaacaagatccaaggtgattcttatgctcattggagtttgagaactgcctctctctaagccccaacttccttaactgtagaatgggaatagaaatattccctgaaacattagtgtgaggattaaataaatgcacttgaagatctctgtgtgatcgactgattgtcctgatttgtccaggactgaaagggttcctgcaaagcggaacattcaggtttaacattgggatgggttgtcaacctgctttcacctcagtgcttggcacgcgataagagctcctttgccatggtgctgcaaagttgtgtcatttagaagacgtggaaaaaagccacaggggagctgtttgtatttgcattagtgctgtgtttgtgggttgtagtgttttgggttttgttgctgtcattgtggttgattctttcttgattacaacagccaccataatcacagctctcattaatggagctctcggtatgtgctcagagtaatacatgcattatcccaatcacaacaacctctttaaggtagggaataaaattccctccatttaaaaaaaaaaatgagaaaatggagcctcagagctagtaaggattttgtccaaggcccagacaccagtaagagaaagagctgaaatttgaaccctctatttggtaccagtgtctgtgcctttgataacaggaacatacagactcccaaagggagaagaagcaatttcttctggaacttgagcattcagagctgtttggagacatttctttgagaacactgggatatttttgaaatggacatttcgacgataatgtttaccaccagggcctgcccctagcaagtgttatgggaaagcccaagacactcctttttattgcagaaataaagctgcttccttcagttcagcagcagctcctctatgtatgatagccggagacgaaaacttaatgaacgggactggtttgctttttctctttgctggaacagcttaatgataagcgattattattggtggcaacttgtcatgtcttaagtcttggtcttggctgttgtggctgtcagagtctttgagaagaaaccaatctcagcacatattagagaaaaacaaaaaacaatgaggaaagatgaagagctcatgcagggaaaagtgagatttgtgaagagaggtgggtgtcccaggaaaaagggaagaatgatgaagaaaaagagaagaatggtaagaaaagggaaggatgatgaagagagatgcactaccctgtagtttgaattattctgattcaagttcaggaagatgagttaaacatgttacattatttttttcctagccaaagtggcatcagtaatctttgattgcaagtgacagaaaagctaatcaaattggcttaagcaaaatgaggtaattaattgggacatggaattgacaacaagagaatttgtcttcaggtgtggcttgaacaaggtgttcaacatggatatcagaacttggtaactctcgatcttacagcttaaactttgggtctgatagctttcttcttaggatggtatatagtggttgggtggctgccagaaattctggtagaacatccatccaagttcaagtctaacagtaaaagaagctgtcttttcctagtccctttcttcataaatccagaaagccactctgattagatcagattaggaaatgttccacccccgaattaattactggcactatgggccaattggcttgactgagagagaggaaaatgagggctctcagggggaattcactattaccagtaaaggaagaacagatgctcagtggtcagaataaaaaatatccaccaggtggctcagggaggcccatgcttcatgaaaaaaaagggatctgaagaaaatagtttcagaggcacagagaaggccaggggcccagtcacagttgggacttgcaaaataaagctgtttccttgtgcttaagtttatcagctcctcagagacccaaccccatggtctctggtccagtaggatttccctctggctttagtgggaatcaggcttgctttctgtgtgagattagctggacctagccccagacaatccataattgctaatgaccctgtttggaagcgtggagtcagatgctcacctgcatgttgacagagcaccaggtaaagccagcttgggtctttgctgtttccttgcataacaataagggtctgaatctcagcagggcctccttttggccagccctgctaatgatctagaaagcagggctgagttcaagagcaatgatcattgtgtggtcctaattaatgtacagtatattgggctgtcctaaatcagctgcaacgagaatcaagaaatacatttctccatgcatttatgtgttctttcctctggcattgtggacttgatagtgggaaacttggctctgggtggtaaactgggacaaggtctgaaattcccaggaaaacatggaagttctagccacaatatttgaagttagagtaccagttgactaaatgatatagcaaacgaaagatgctggctgcatctttcaagtcataacctagcaagtgttatgggaaagcctgaaagactcctttttattccagaaataaagctgcttccttcagttcagcagcaacccctctatgtatgacagcccttctatgttagtcaatgtaggcttacctattggcacagatcagaattccagagggaagaacagggttatcttacacaaaatcccccaaattccaggtttctcccaggttccctattgggagacactggtggcacatttagcagaggagttgtttgcaatacagttgacctaggaattagatacagactccctatcctgactacagggcattcattgtgtgatgtggcctctgcttcctgtcctaactcatgtctcaccactctctcttgctccttaaacttcagctgttctgactttccttctgttccctgaacttgacgaaccctcgcttaccttggcatatgtgtcttctgctggaatggctctccctactctcatctcgcccctaatctttgcctggatgactccttcttcatatcattttgatcagctccaatgtagcagatcagatgacctagagtggggctcctctctccaccccactcctgaactatgacatcatttgatttccttgaaattattctattttgttttattcaaatttttaaaatttgagatgggtcttactctggggttggccagactggtttcaaactcctggcctcaagctatccttcttccttggcctcccaaagtgctgggattacaggcatgagccaccatacccggccaattgttctatttattgatgtccttctttgtttgtctcctcccctaagaatgtaaaattcatggaatcagggtccttcactttggtagcctccttccctagattcactttcctggaacaatgcctggtacagagctggagtttgttaaatttgttgaatgaatgaaagacaatccacggatgaatgtctctttctagagtggtaggtctggcaggtctgcttaagtacatagagcatgggatcctttcctgcccacgggcagtcttgcactctaggggggatgcttgtgccagtttccttctcaaagaagtggtccagcagtctgcaaggtgctgagcagaagtcaggagggcacggtgccctaccctcaagaattgtcagtctgaaggacatgcaagattcacacctctccgcaactaggcaaccacatacgatccagattaaaatctttaatgcagggataataataagacatcccactgtatgctatatagagctacatattggatatgcccaagagagatattggctatgatgatggtcatgatgatgatggtgaggaggaggaggatggatgtgatgatgatggaggatgatgatgacagaggaagggggagggaggtgggtggtggtggagtagttgttttccagtgtgaccaattcagcttatgtgcacgtgagaatgctatccatctgaatcctcaggcttaccaggcttatttgatgtttttacttttcctctcacccctggaaattgaaataaaatatgttgaaatgctcagttgatacactatgagagtaacagaaagcacatcagggcttaccagggctcacaagggcaatcctcaacaggagaatgcaaattccccaggagtctctctggatcgttgctgagttacctccattatttccttttcttggcagacagcaggaaaataagttgtggaaatgggtgtggggttgacaatagtgaccaattctctcatgcttcttgggtgtaagcctcctgcccctctcatccttccccaagtacttatcaggcccctagtgtgtgtcagacattgtacttggctttaaagatactaacttgaatacctacttctcaaccatactgctgttgagaagagacagaggaaaaactaataaatcagctttaaagttcagatactcaggccacagagattccctttcaatcagacttgcatggggcacaatgcataggttattctttgataactcttcaagggattcatatgtgcagccaggaatgagagccactgatgtgagcaagggaaaactggatgcatctcacgatgactgagctgccatcaccatggggccatgtagatctcagggaagtcatttaacctctcatcctgtgtctttaggagaaatgccatccatgagtgttatgccacttgcgttatctcttgagtagttaggatcaaagagataatgggtgtggatgggctttgtaacctttatgaatgggtaaatggaatgtaagttgctattatgctctaggaaacaccaggctttggtacccatggagtcaggtgtcaccctggggacccagcaagctctggaacattctggaacaggattgaatgctctagacctgattgaatgagtcctcagttatgatggtactgaaacacagagtctagagcagacacccagaatcccacaccctcctgcctccctcgctctgtgtttaaaacagtttgttctgtcttccgcagagcagtgagcatggggagagaagtgcttttgcttcagaaccaaagtgggtgtatgaaatctgttcctctcccccagctgcacattctaaggaagccgagtgccagaggtggtcagaggctgatatgtagaatccgaaaaatacaggctgagccatggcaggaggaggtaagtgcaggagaggtggcctctaccatcaagacagggagtggaaaggatgttcaggggctttgggctatttggcatattggacgccaggccctgggagtgtggccagattccccatcatgtcctgccagttcataaaatcaccttaggaaatcccaaagttaaatgtgagcctcttcattgctctgctatgcaattatattttgcaaataggcccttgcttctgtccctccaaggggtagatgatgcttttggtccatggtggtttttgggttgaattttaagataccaatagaaatgacagtagtacagggtaactgcatgatgcccaggaaggacattagggatggtttctctccaaagcatggattcattgctgtatggaaaggcagtttcttctttgcattatacaggctccttgggctcagaatgaatgagctggtttgcatggggtggtggggatttgaaaccagcatgtcagtggacctggagaggccagttcttgaaataggatgaggaccctcttaggtttctgacgatgtctgtgtggtctgtaggaccgaggatgtggagacaagcacccaaactgtcaaagtcaggcgtggacagatgagtctcccacttctaccttttcatcccattctcacagcagacccatgtgatggaagggtcattattcctatcttataggtaaagaaactcaggcccagaaagattaagcactttttcaaagccacggggctggctaggttagccacagtccctcagaggcaggacttgaatttaggttcaatagaccctagagctcatggtatttcaactataaagctggtgcacatagatgggtaggctagggagtctgaacttaacatggtaggcctatgggagctattgatgactatagagcagggcagtggcatggttaaaggggtgctttaagagtttcaaccaggcagctctgaacagggtgagttgttgagatgctccaagtccagagtgtggattacctcttgcaaaagatagcatgatctcctgatgtgaaatatttgctgaatacttcatacttgatgggcactacactgggtgttttgatacaagagaatcatttaattcctacaacttaatgaggaagcaccattattggcaacagcagagtgcagaggtaaaaactcgagaccctgagggcaggcaaacctgattttctacctgtacgaacctggaaaaatcaccctacttctgggtcttttttcatttgtaaaatgggcatactattagtgccaacttaataaggtggttgggggtggcattaaatgagatagcacctagaaagtgaggagcaacgtgactctcatagagtaagtatttctagcatgtttactatgatcattattaccatagccacacccattttatagatgagaaaactgagacttagaaaggctgagtgttttttttcccccccatccaaggccacataatgaggattggagctgggtagtccaaccccagaggttctagtattctccattttctgcagagaggctgcgaatggggatcagcatagtgggtaatgggagagattcagcttgggctgaagtttggcatgacagggggtggagacagcacaaagcaagggtttttgcacctactctttcacagatggcctgtgccgagctggctctgggccaattaactgctgtccctccaattatctttctcctgaggaagttcacagtgcagccatgccctcctctctacatgtagagaaccagataagatgcgtgtgcttacagctttgctctgtgcacagaccttttcatgggtaccctggtcatgtctagctcagagtacatagagcaagggtgttggaggatcccacattccatcaccatctggcatgtctgacctccacctctccaccagtaccaatcttcccaaggaagtgtctcatagaccctttttattaggttccaatggtgcctttagcgtgtgtcttgttgagagctttctgtattccttgtgtacttagtgcaagatgctgatccaccaccttttgcagtcagaaggtaactctggtgactggcttcctttgaggcatcatttacatgggagctatcacatttcttttgtaatttagaacatttttgccccatcccaagaggcgtctcacagtgtgtgaggttggcgaatataattgcctttagactctacttctgtgttgtcttctgttggtggttttttttatcttgttgccctattttggcattaatgaagttctgtggacaactgctgaggtttataggtcttctatattctcctctttatcaataaaggatacattgagatataggttgggtattggatggttgggtagttcctcagggtaggaaggtgtaggtgatgatcttgaaggttttgttttgttttgttttggacacaatattcagaatccacacaaaatacaatctcagatactgaattcccattctttccatttctggtcttaaccaaggacagtcctttaggcttcattcacatcttcattcccttgtcatccacttatgggtgtgccaagacttctgccaggttctggggacataaagatgaaaacaacaaaaatctctgcccttgaggagctcacagtcttgttgagatgtgatttaaaatggttaatcaattcaagaatattagatttctgcaaaagctactgtcgggaaaacaataattatccaaagtctttaaatctattacccactttaattaatttaattaggtaaaattcatggaactgcaatgttggaaggggcccagaagacatttattcttgtttcttctctgccttcaggccatgcttcactcaaattatcccccaaacccatgcatttcagaaaagagcagtatttcgaagaactatagcttttggcccattctgatagaacttttagtgagcacccacagggaaagtgatgtaaacttgttgaaggaattgacatgcacagctacaaagtattgttctgaaaaacatgaatggaacatccacctttcacacacacacacacacacacacactctctctctctctctctctttctctctctctctctctctctctcagtggaatccccataagttatcttgttgaggttgtgttcaatactcatggtaaatacagaacgcaaaataaaaacatggctgtaatatgatgaggaccttttgataattctttcagttccctgaaagaaatacatctcagcacttctcaaatcctgttttgctctaacacagaggcataccttctgtttagttggcatttttgcaccatgtccacaagtcaacaacgtggtttaagcatctgttccatacagatcttcagtgatcccaggaagactgtgattgagtgtcagaaagggggcaggatgcagagtcatggcactgaggtacagatgtctacttgctctgtgactgttttgagcctcgttttccctgccagcaataccaactttgtaggatcattatggggatttgatgagttagggggtatgaaggcagtttgtatattgtaccactgtatgcatcacctgccttttctaaatggaaatttgttctcacaatcgtagatgggtggagatgttagggctaatagaggccctttaacctgacataagttaccatgccactttctagggtgagagcattcagtgactctcccttatgctctgaataggccctatgtgcttggatttctgccaagctcttcaacatcgtatcgtccgcctcctttcggtgccatgatgcattcatctacagcttctgagatagtcgcagtgcatcctcgggattcctctgactgtaacatccatgcacttctcctcttcctcacctggattctccttcagcacttcatatacctcttttagctcttagtttgtagaagttgtcttccacttaattcttattaagaacacttaataaggtgttcgataaatatttgttgattgaaaaggtagatgtccacatggtatttatgatactctgtattatgtgggagccgtatgttcaagtgacagaaaccctactcaaactccttaaatgaacatagaaactcactggcttgtataacaaaggggtccaggagaaatggcttcatacttggcagactctaggggctccaaatatatcgttagaaaactgtctttgctgatgctgttttatttccgtggcttgattttccggtcatgagctggggtgggggtcagatagagtttgttctgttagaaccatatagactcaaaggaggaaggggcaggacgaactagaggaaaatgagaagaatagatgataagcaagcaataattacagacatccttccaggacctggctatgagctcctgagtacaggggcttctgtcctctctgtatttgcaggatctgttctggagtctgggatatagtagatgctcaggaatgtctgcaaatgattgatgtgtgatttactttccttacttctaggacgcagtttgtgcttctatataaaccacctcctgcctcatcctctgttttactttcttttcactggcaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccgtaagaaagggcttgttgtctcccaaagtgggatcagagttttgctgttgtcattgtttgcttgcttacatactcattgttggaaatacgcactgaaaatgcagaatgttatgtgtttacttacgggacttttattttgctctcctctctctttctttcatctcctttgtaagaaaagtcacattagactttgtttcctgcaacttaacttttttttctactcaacaatatatcttggaaacctacacctgggattgatcgatctgtctgtctgtctatggctgtatctcaagtgtatctatattttttgtaactcataaagatttgaacccagataagtctaacctcatagccctcatcacattcttcactatgatatcatggtatcatgatttagttatccagtctgcataatggtaggaatttaggagttaattttcttttatttaaaaaaattttgtgggtacatagtaggtatatatatttatggggtacatgagatgttttgacacaggcgtgcagtgtgaaataagcacgtcatggagaatggggtatccatcccctaagcatttattctttcagttacaaacaattcaattatattctttatgttaaaatacacaagtcatttattattgactatagtcaccctattatgctatcgtatagtaggtcttattcattctttctatgtttttttttaccctattgatcatccccacctcccgccccaacccccaatacaaaaatgtgtttatttatgggataagtgaagtattttggtacaggcatacaatgtttgataatcacatcagggtaaatggggttttcatcacctcaagaattcatcatttgtcttataaacatttaatttagggattttgaagcttcctattagaagctaaacagctgtgataatctttatacatgtctaagcacatgtgcaagtgttttttctagggttgattctaagatataggatttttgggtcctaattcatgtgcatttttaaatggaagcatctattgccagattgtcctgcaaagtaacaacaccaatttatagtcacaacaacagtttgtgaaactacccagtttcccacatcctcaccaacatgttacgctttggggaaacttcccacactagtgctcctggtctctgtttgattttgcatttgattttttcccttcttatattctaagtatttttgtaggccattggaaatcttggcaaacattactcacagaaccgcattatattccattatgtgaatgtatcataatttatttagctactcccatcttggcgaacatttaagttaaattttaggtttctgagaagtgtcattgttccttgtggcccatcattatggttcagctgttgagatttagaatgatcactcctatcccaattttgcatggttttgcctgatgttcactgatttaatccacgctttattcctcagataatgagcagtgtagaactgtgattaagggcctcaactctggagttagacttgtctgggttcaaagcttgtctcgtccactttctgtatgacttgcacatcattttacttttctgggcctcaggtgtttattgcaaagtgatgataatagcacctaatttctaggcagtggttctcaagcctcagcaggcatcagaatctctgggaggacttgttaagacacaaattactgggcctcaatctcagagtttctaatgtaatagaaaatatggggtgagcccagagaatttgcaatttctttcaagtttttgggtgatgttgatgttcttggtctaggggctgtgctttgaggaccaatgttctagagattgtcatattcattgaggtgccgcatgaaaagtactgtttagcacggtatttaccacatagtaatactaaataacttccagagtgatcagtgaagtttttggtcatcagaaattacagtcagcaggctgggtgtggtagctcatgcctgtaatcctagcactttgggaggccgaggtgggtggatcgctggaggccaggagtttgagaccagcctggtcaacatggtgaaaccctgtctatactaaaaatacaaatgttagccaggtgtggtagagcatgcctgtgatcccagctactcatgaggctgaggcaggagaatcacttgaacccaagagggagaggcagaggttgcagtgagctgagatcgcaccactgcacttcagcctgggtgacagagtgagattccatctcaaaaaaataataataataaaagggaaatacagtcaacaaaccatgttggtttattaccagcagggtactatgtcactctgaaatatttctggaaggctttaggactttgaatctgctacagttcagaggttatctctgaactggggctggaggagtgtgtgtgtgtgtgtgtgtgtgtgtgtgtgtgtgtgtgtgtgtgatgaagtagacagaatatacttcttacaattaacataaatctgaaaaatgaaccttgaattaagaaatcatgctcctttgacatttctccgtcctctgtccttttactctctttagtaatcctgtttctacactgccactttcagcattttaaataattgtccagatatcaggaaggaactcagataaatcagcatgagacatgggagtctcttacagaggcaggattgctgccagcccaaagacacaaacgaggctaatgaattctcacttccatcataatatgtgccctgcagctggaatattcagaaacatataattttgatggaaacataaatcaattttagggcaattgaaatataacatatacaggaaaaggaattctagaaggataattggcaagacatttagatccctttccagtgaccaccctggattctatgctttttttaaaaaattctgctgctgtgaaatgctgttgcgcaatttcccaaagttacgcctttaaacacagtaattttgtaaatggtatttcagccccagagaagcaatgcatcaagcgtggtaagtcgccatccactgcttggtgtttaatgaaacatctctccatccatgcagggctggtggtgtccacccagtgtgtaagtttggataaggcacaagcagtctctccttcccacactctcccacggtccctgacgcccaccccagggaatagtggaaacctgccaggctgcccttgacagggagctagagaaaggccaaagaaagcatttaaaaacaaaaaaacaaaaaggattatatctcctttttttttttttttttttttttttttagacagagtctcgctctgtctcccagactggagtgctgtggcacaatctcggctcactacaacctctgcctcctggattaagcaattctcccgccccaccctcctaagtaactgggactacaggtgcgcactaccacatttggctaatttttgtatttttagtagagacgaggtttcaccatgttgtctaggctggtctcaaactggtgacctcaggtgatccacccgccttggcctcccaaagtgctgggattacaggcatgagccaccacacctggtcaaggcactatattctatcctctgtctatcattgcttccaaccaacagactctgtgctagcccctgggatacatagatgaattaagatataatttctctcctcaaacaccatacagtctgatcaaggtgggggaaatttatctaaagacaaacttaggaataagaattctttttttaatattgaaaaaagaatagtacagaaaacaacagaatctgataaaatactcaacccgatattcatcatagggaacaaagctaaacctgccaaaggttaatgtttgtttcaacattttgaaagcaataaaacattaatgataatgtagaagttctgattctatctgtttccctgtcccagttttctcctgttctctccatagaagggaaaacatgataatcagtttggtttacatccaaatccatgtacatgtgttcgtactttcaatacacatacatgtgcaaccgtattcccaatgcatacttctgtctaacgtacaaaaatggtgtctaatgtgttagaacttcctttacctcaaccttatgttttcaaaatccctctatgaagataattcaattgcatttattttattgatgatattctgttgtataagtgttccatctttacacttacataattcctctttgatggacatttaggtttttttatagtaagatatttttcagtctggatagctgaaagcagagaacagacctatctgtagcctgtgttagatctaccagcttgttcaatagaagcccaggactctggagttaggagttcttcacttcaagcttaaaaattacatttgcagctggattaaggtcttactctgcaaagcatctgataaacaaatagctctcactattcctcctatgtagcagggaggttgcaaatagctccagaagaagttcagatgaggtcatacctgatatcttcgtggtgagttactgaggggatctgggatccagatttgactgattgagaacaaagtcatggggccagctagacatgccacttggtggtcctcatggactttatttataatctcaggcaaagagctggtgcagttaggatattgttgctcatgggctgggcgtggtaccaggggctgcttgcaagggaaggtatgttcatgaccttacacccaaccgtttctgtacatagagtttcaggcaaaaaaaagtacaggaaagggggacattttcttcatgtttaatattcctgattttacagaagacactttgaaaagagcagtcagcattttccaaagtttaaaaatagctcagccatgttatataacctccttgctactgcacagttattaaacatctgttccttcaccaagcacagaccatgtcactgttaactcccaaaattgtgaaggtaaaccttgacctgtttggctggtggaatcccggctgttgtgtccggttccatcacaagaatctgtccagttcaggagtggccagggccccctgggaggcagtggcatcacggttaagagcatgggcactggggccaggttgcatgggttcgaacctaatctgtacttttttagacttcggaccttgggtgagtcactgaactccacgtcggctccctcaggtgtaatatggggacaagaaaagcatttgcatcttagaccagtgtgtggcgtatggaaaagcagtctgtaaatggttactactatggatgaaacttgtagatctaaagttattaggccgggcgtggtggctcatacttgtaatcccagcactttgggaggctgaggcaggcagatcacttgaggtcaggagttcgaccagcctggccaacacatggtaaaaccctatctctactaaaaaaaaaaaatacaaactttagctgggtgtggtggtgcacgcctgtagtcccagctacttgggaagctgaggcaggagaatcacttgaacctgggaggtggaggttgcagtgagctgagatcacgtcactgcattccagcctgggcgacagagcaagacccagtctctcaaaaaaaataaaataaaataaaaatgaaataaagttatgagtgaagtaagtgtctcttcatgccatagcccatgatattaccatttgttcattcaaaaaatgtctttggtgtcttacataagctaagcaccaattattcatagttggagagacacaaaaaggccatcatgtgattatcaggcggggcagggctgtcattcatctattgtttgctctgaggtttgggggccagtggaatattccatagtagaggcccagcctcccaagttggaggtataggagaaagaaaaatgtccttatgctaaagcacagcacctaacaagaggagtaggatctgggtgactcaatgctctgtgattattttccaagctgctttttggtagcttttatttatttcctctggtgcttaaagctctagccactaatgcctatttggggcttggttcaagcatatagacccaggtgaaattcatatcacattttagcctgtggttttatgaaatgcaaagcattaagtttgtgctgtgagtgctgtgtgtttgtgaatgtctacaggtgtttttgcacacatatatgtacatgggtatgtatatacacacatgtgcacacgtttacctgcatttttgtgtgcgtgtgtgtgtgtctttctctctgcatgcatatatgtgtttcttattccacagcggaggggacacattttacacttactgaagaggaggtcatagaagggagagggtggatgtttttcagaccaaaaccctcttaccaaaggattaccttgggagaaatatggccattgggaagagggcagtgtggcatcaagaaaacttcatggtctaggtagtatgacagacttgactatgaatttaccacatatttaccaagtataagttattaacaactgtgaacccaggagttttcctaaagagggtgtgtgtgtaagatagacatctcttcttcttgtaacatcttaaagtatatacatttagcatggtgccaggcatggagaaggcattttacaaataactatcaggtcattattataattttatttttcttattattgtggtcatcatcatcattattataactttatacttgttacactgcaagctctgagtaagctaggaaagcaagcaatggaagtgcatttcagttctattctttaattactgaattacaactgtatgttctgtgtggttcccattttagttagggaagtaggacatggagaagttactgcactggaaatcaagtagaagagctcaagtagatctatagcacaaatgagggggcaaaaaaagtcttatcccaggagagttatgaattagtattgaagggaagttatttggccttcattgatgacacctggcatgaccatttatgtgttttggattgacttcttgagttatgaagtcaggcttcagctttaaaaaccaacaacattgtaaattattacccctgcagaaagggaaatagaaggaagatatatatgtgagaaagagttttattcatgtctaagttacattgatactactttaaatcttcatttctaaaataacataggaaaaattcttggtttaatgacccattaagagactgtgctaaacctggttgacatatttttatttagtaatcagaatgatcactgttggttttttgtaatgccaatagaaatgcctgctcagttaattctctgagcttgaccagagttaaaacttccctaggtgaatgtgattaactctttgcaaatatttatctgggagatcaccatatgctcaacaaacacttctcgcagtgaaatcaggcacctcagaggccaagctgtcctgtgggcctttgctgtacatctgattgggactctgaactcagaagtgggaaaaacagctgagtctcaaagtaaatcagcaagagatacgaggtgagagaatccagaggaacacaaatcatttttcccaaagctatgtgactttgtggaatgtagacttagacagtgctgtgttcaaaccctcttattatctgggttattctgggagagttccttaacttctttgagcctccatttccttgattgtaaacagagaaaattccaagaatagggaggatgataccacttaaatgcaggtattgtgcttagtcaagcatctaggatatagtcggcactctacaggtgttaattctcctcctctcctggactagaggcacagcttgatctaggcctgatggacccatgagagtgggctgagcttgctgggtgttcagcctgagcactaagtcaacagcctctcttcagcatcatctctgtttgtggcatctctcctggaacacagccctcccttttatggctggaagtcaaaagaaccgtatgccagccctgcaatgcaagtcaatcatttccaattggcacccaatgaatagctcgacaaatggtagaaacctgatgctggcagcttgggaggaccagaagttggccgtgcctttaccttgagggaaaggtggtttgggttgttttggggtcacacataaagcacaaatattgttcacatttgccttaggccagatgtaagtcttaggattttggaaccagaatgccgaacaaaaaggcacattgatctatttcctccagggatgaatactagagaagttttcattttgaaatttagtaatttggtgacatgtgctaattatttgttgccactctcttttgtgaaaaaacaaagcaaattaagccccatctctattactctgatgcctgctaacagagtgtatactggggctgggaggctttaatgtgtagaaacataggctggttgggagatcatagcacaggtctaggaaagaggaagtggtgacttgcattacagtaatagctgtggattcagagagaagtgggcaggcttaatgcatatttgggctataaaattgacaagacttgacagatgaatatgaggtgttaaaagagctataataataattttcctcttgtatagctgagtagatggtggtgtcttttactaaacagaagaaatgaggaaagaaatgttggggaacagagagtcagggacatccaattttagacatgttaaattagacatacttttgagatatccaagtggaaatctcagtaggcaatcagagagaagagtctgagtacaaaccgaaaatgcaatacacaggatttgagcttattgatggcagtcaaagccctacgactgggcaaggtcttgcaggggagaatgatgactcaggagggcctgggtttaaaccatgaggaactttaacattaattggtaaataatcctccaagggaaaggagaatgttggagagaaagagttacgctgtaaattccaggtgctcttcccacatggagactctgttcccaatgttgattttgttttgatgcctggtgggcgtctgcacagtgtttgctccatgatagacatcgtagtaggccttccaaaaatgtgtaatctatggctatggtgaatatatctgggttgggtgcatccttgcagagttaatcctaccagcagttttatttaatcagtacattgagaaagtatggcaagtcaagttttggctttggagagataaggaagtgatgaagctttgggtctcgacggatgagggaggtgatgggtggtggagcattgggtctggagagataagaaggtaatggaactttagatctggacagatgaggaggtgatggggctttgagtctggagagatgaggaggtgatagagctttggtctggacagatgagtaagtgacgagtgatggaactttggatctggagagatgaggaggcgatggagcttttggggtctggagagatgagggagtgatagttcaggcagggggaaaacctctgtttttgtttcattctggacacgatttgggcaacatctgatattgtacaaaaagacaaagttaaaaatcctttctaccaaaagggagaagcatgcagcaaagtataaaggggcaggtgctcacgaccgattaacttatgagctatcgttggtttgctttcctgaaagagtatctgtctatgcacctctatctatatataggccaaaagctctcctgatcatcccttccaggtgggagcaagagaggcagaacgggcctctccacctgttctctgcctttgtctccttgcttctttgcttctctcacctcttgcttccatgtggatgctgcctgcctgcaggtgtgaatgagcccccgtccaggttcctggtgcctcaaatcctggcatgaatcttagggatggaggagtcacggtccagcgtgatggtgctagctgtgttctgcgtgggcatgggaggccagccacatttctacatgggcctcaaagttgggtaaatgaactggcagatctgctggtgtctggtgtaccattgtccaaatccccacagtcagcttcctgaggatctgcttcatttggttaagtcttggccaaacacaaagagtaaatccacactgcccagttttccatgtgatagaaaatagctctcctgagaaatgtgctcatttccttttcatttccatcactattaataagaggaagtttaaacaatttaatttaatcaacgcatcattatgtatgtgagggtgagtggggaaacttcaagtttcataggttatattatctaagcatatatatttttaaacgtgaaagtactctaagggtaagacctaccatgtattgacttcctcctatgtgtcaatctgtttaaatatattatctttcatccttagatgtgagttaggatgtttttactgcaggtagcaatcaagttaactcaaagttatgtgattgaattagttcccgtaacaaaaattccagaagaagtttggacttcaggtgcaatataatcaagcttctagttcttttctctatgatctcttgactctgctttttgggcagtgtgattttttttctctaactgacttcctcgttacctcaagtttgctggtaacacctgggaagacttctttgtggccaaattaggtcatgtacccatcttgggccaataatggtgattttgaaaatgccaggtactgactggcttaactccaaactcctgacccagtcacagagaaggcaaataggttaaatcaaaccagacctactcctggagctgggaatggggtaaacttcccttgagttccatagattcttacaggaggcatgaagtctcaataaaatttgagttctgttaacaatgagaaagaggtaaatgaatgctagagtaccagcaggtcaattaaaaatcatgattcatattacagataagtaaacaggactagagaagttatagaacttgaaaagagccacacaggtaatgtaaaatggagccagaagttaaatccagtttcctttggttccaaaccccacgttacgactttcagaggctgcaaattgacctgtgttgtgtgcatgtttttttttttttaaacttagagtgtttttcctgtttccaaaagtaaagtcccaatgtttaaacactatcatcagatttcacaaaaattatattttttgtttaccatgaaaaagatggagttagtgataataatcccatatcctgacctgctaatgatcaactggaagctggaagtgactgtcatctctgcgcagtacaccttagtccccacctgggttggtttatttatccatgttacctccagggctttttaaagtattttatcccaggttgtcttgtactcatttttattatttttatcataatcatcattatgtgtatttatttccaaaacaagaacttgatgattattaagattggcagatattagaatgagcaataacagggagttttgatagctcacctccagagatcttcatacctgagttagcacaactggaagtgtgtacaacataggtctctcttatcctatatgcttacagcattactggtcaaacattcttacttaaagctgcaggtgaaatcatataaagcactgctgggatatgattttccatgactagaggcttcccaagattggagaggcgcctctaatcttttgcccacattttctcaaaacaaagtaaaatgaacttggctttcaaaattacagctgggtgtgtctggtacatagtcatctgcgactaagtgatcatttcatgtagctgtagatcataaacctccttcttggttcaacttacaggtgagaatttgagttgtttgtgcctagagtgccttacccaaaggcaaaaacttcctgaattacccaaggagagttccccttgacagactgaattaatttgtagatgttattttaaggttggaagaaaatatttgctctggtggggtgtgcagtggcgttatgacatttgtcaagtgaatggcaaatgatggagccggatggaacccgtattacttgcttaagaaattgtcttgaaaatttccaatgtgtcatttaacgtagtaaagtatttggttccaatctgctttctttttcttagtcatactgggggtttcaatatttgctttaaaaataaatttggggtttgtaaattctaactacttggagatatgtttgagagatttaatggtcttatttaccttcaatgaattccattctattgactgctacttcagaccaagatggactgtaatatcccctacagactgaaacaaccaaaatggacaaaaaatttgaaatgattgtttttaagaccctgaatattggggaaaagaagatagaaactaaaataagtgagtttaccacattttatttatggctccactcaccaccttgagagagtttccaggctgcaacttaaggataggggattcaagtgtggcagactccctgaatggcagagacaaagttgaatctaggaaacaaaagcagctggatttcataggagagagtacctgagaaaagtgatccgcgtaaatggagatctgcctaaggcccaccttagtgttgagctgaatactgctcaacataagggtgaggacactacctaaagccaaagaaagaagcctcccaaagattgaaaataacagagcccaggactcacgtggagtgagggttagccgctagtcagactagaaaacccagttattcatgggcactgagttgagtacacagaagggggttgtctcaataatggagaaataattagctgtagactatgaattgctctcactctgcctaacaaatatcaaaagcaaaatttgaaaagatcaaactgtttccaagtaacttagtcactctagaacagagctcagtgatatttatagtaatacaaaaatatcagcacgaaaaaagttaaaatttataatttcttccatcccatcaaaagttaccaggcatgcaaagcagcagggaaatataatccataatgaaaaaatatcatgtaacaacttacccagatttaaatgaatgttggaattggcacatggggctattactatagagagtaactctaactctcaacttcataggttcaaaaattcaagtggagacatagagaatgttttttaaagaaccatatcaaactactagatataaaatctacaatgcatgagataaaaactacactggatggattaatggcaggtttgacattgaagaagaaaaaaatcagtgaacttgaaaacaaagtaatttccccaaatgaaactcttagagaaaacacaatttgaactatgcattgagcacgactgaggattttaatatatgtttaatttgaatccctgaagtaaaagggggcaggaagaattttggaaaaataatggaatgaaaaattttcaaatttaatgaaaactataaaccctcagttcaaaaaacttaaatcctgagaatgagaaatatgaagacatagcataatcaaatttctcaaaatcagttttaaagatatatcagctaaaaagatataccacagttgaaagctgtcagagtgaaaaaagatgtcagccgacttctcgtcggaaacaatacaggttagaaaagaatgcagaaagatattttgtactgaaagaaaacaatgtaaacttagaattctttgcacagtaataatatctttccacagtgaaaatgaaatactttttagaatagaataactggaagaattagcagcagatctgcattacaaaaaaatattaaatgaagttcttcagggagaaagaaagtaataccaaacagaatatggatcatcacaaaagaatgaaaagcaattaaacaaaaactagattgttaaacgcatgaggtttttgctttttttttgttttttttttttttttttgagaccgaagtctcactctgtcacccaggctggagtgcagtggtgcaatgtcggctcactacaacctctgccacccgggttcaagcgattctcctgcctcagcctcctgagtagctgggattacaggcacatgccaccaagcccggctaatttttgtatttttagtagagatgaggtctcaccatgttggccaggctggtctcgaactcctggcctcaagtgatccacccaccttggcctcccaaagtgctgggattacagacgtgagccaccatgcccagcctcacatgaggatttttaaacaatgaaatcattttaaaagataaattacttttaaaacaaaaatactaacaatgtagcatgaggttaataggttgttaaaagtaaatatgacaacaatagcacaaagattagcagggaaatcaaagtatactatttgaaggtcttatggtatacttacgtagtatagtggtataacatcacttgaagataaccatgataaatttaaaatatatactataaactctaaacaaaccactaacattaaaaaaaccccaatgctctggctaataagccacaaaggaaataaaacagaatgataaaaaatattcaacttatcaaaagaaggtaagtagaaaggaaaaagagaacaaagattagatagaacaaatagcaagatgataggtttaaacctactgtattaataatcacattacatgtaaatagtataaacatcacaaagcaagaaccaactctaaggtgcccataagaaacccactttaaatataaaagcataaataggttgaaagttgaaatatggaaaaatatgtacacactaatactaattttaaaaaactggactggctgtattaataagacactaagtagatttcagatcatgaagatttttggcattaaatattgccatttcattatgataaatgagtcaattcatcaaaaagatcaaactatgcatctagtatagcttcaaaataatgaagcaaaactgatgcaactgcaaggggaaataaattcataattatagtaggagatttcaatactcttaataattgctagaacaagcaaagttagtaaagatacagatgattttaacaatgtcacaaccaagttgacctaatatttgcttgtggaacactccacccaacaacagaacacacatttttcaaatgtatacagaaaatttatgaggatatatcatattctaggccataaaacaagttttagtatatttaaaaggattcactaacacaaagtatttctgtgaccactttgaaattaattagaatctaataactgaaagatctccagaaattccccaaatgtttgcacactaaataacaaacttctaaataacctatgggtaaaagaataaataaaaacgactctttactcaagttgtcccttggcagaaatccaagcctctttgggaaactgttcttcactcaggcatgcggtccatcttcagttaaccaagtcacagggacatttggctctttgcttggttagttgctgctcagaacagtcaggaattgatgtctacagagaggtttgtgggtatgagggcatgaagaatgtgtttcctaataaaaataatagaaaactgggtccagatgggcgtggatgtaattctcaggcaagccacattccctgccttcatccgagtttttatgaggtagtggaaataggacccaaactaagatttaagacattgggttttaatcctagcttgctcctgcatatggttgtaatctttgttaagattcttaacttttctgattctccttttttttttttaaatctgcagattgatggtgttggttacaataatctggaattgtatttcatgatgtcagagcaggcagggatgctggagatcacttaggccattaacttgtaattatttttctcctttgtacaaagcaggcttctgggtgcttttgcaatatcatcacactccctaggatgtaagtggtagctccaacccttttcttccacttaagaaagattagacggcaaatgagtgatgataatgagtctgctttaaattagatcaaagtctaatttctcttttttatgtttttaataatttataaaatttgcctcaaaatgataaaatatattattagttgtaacaacgtattttcaactggttttacaaaatcaaaataaattacttctctgtgttatgttacagatgaggaaattgaggccccaaagagacagggttaatgttttgctgtctggctcatggcaaaggcatgacagaagcacagtttttctttctcccacacctaggtgcattgcttccactacaccttctaggttctttgtggttattaataataaggtgatcatgattgatgaagatgatgatgaattccaggaaccttgtccattttacttttgtgcaccagcacccagcatagtgtagacacttaataaatatatattgaataagtcaataatgataattgctaccacagcacttattctgatctaggtggtatgttaaggattttcacatgcaccatcttatattattgtcacaacatctctgtgaaataagtagtagtgttatttctattttcacatgagaaaaagatttcagagagaagaatgaccttccgaggctcagttagtggtaggatcagtatcaagatgacctctctggctttagcacccgatcttctgattctctggcttctcaggggaaagaaaaggggtcagttgtgttttcatgcggtccgaggacgtcttccaatgctgcgaagctggtacaaagatctctcccttgtgggtaggagacatttgcttgtctttagagttaattcatcatgaaagtgtgactgatggaaattaattttataaactacaaaacctttctgaaaatgttaatgttgtcatcaatactaattattattattgtcattagcacagggatctatgtttggcattgccaataataaaacaggcagaagaataaaggggagaagctagtctttcctgggaaaatgtttataagaatcgtcaaaagctcaaatgcagaaccatcaactccctctaaattagttctggaatgagtcccttgagacatcgtgcacccctgaggaggacccatacatattaactctacagaggattgagcaaaatccccagcaagggaatcttagtaattctgactaggcagaaggaaggaaataaaaggtagaaagaaagaaggaaaccaagatttaattgtgatactgggtgcaaaccagtctataatgggcttgtctgcctggattttaaaagtttgggaggccgaggcagggggatcacgaggtcagctttctggccaacatggtgaaaccccatctactaaaatacaaaaaaattagccgggagtggtggcgtgcacctgtagtcccagctacggcaggaggctgaggcaggggaatcgtttgaacctgggaggcgaggttgcagtgagccgagatcttgtcactgcactccagcttggtgacagagcaagcaagactccatctgaaaaaaaaaaaaaaattcaattcacatatatgcagggaggccaagacactggtaaatattttccattcagtgtaaaagatgacagcaggaggagggatccatcatacttcttagctatttacttgagtttaaattttatcttgactttaataaatctttcaaaagagagcatttcttagaactctgaatgcaggactgggagagggtgtttgtcttcagccgatgaggtgaaagcaaaacaaaacaaaacacacagaataaaaacagtcccctggcatctgttacccatgttcacctagcaatttcctggaattctttcattcgttcattcattcatgcattcacccgttttcattcatttgtcttttcatgtatccatttaccctcaacagtcagctattgtgcacttgctatgggtgagaccttatagtaagtatgagacacacacagtcacgcacaaaacagaaaaaagcatgctgctcaaagctcctattctagtgagaagagagaaaataaatgaatacaggcaatgtcaatttgctattgatatgggatgggaagagaaacggagcagagagtaaagggatggagactgaaggatggttattttagacagaatggttgggaaggtgaaatttggcagatacctggatgaagtgaatgagaaagtaatatgacagtctgaggaaagagcgttttggattggggactgccaagggcaaagacctggaactgggaaattgcttggagggtctgaggagcagcatgatggtcagaacggcaggagccagaggagcatgcatttggagagaggagccaagttctctaggtcctcagagaccacgatgagagtttggaattttgtttcaagtattatgaaaagtctttggagagttttagcggggaagtaaggtactgcagtgacctctgagcttgcccaagttgtatctggagcctcattcactttttcttttccctgtgacaattcatctcctgttagacaccagcttttcctagggtggtacaaaatgtacttgcctttccagattccatttctcttctccttaccatgcaggccttggtgggtcctatttgaccacagctaatcagaataatcccatgcatctcactacagtgcttggttcaggaatgggcacactatctaatttggtctaatattaaaaatttctgagctatatgatatatggcaagtgtgtaaatgtgagacttggaatttctgctgccatttttccaccatgaaataaaccaggctgatgataaaggcaatttatacatgaggaagaactaagagaagcatggtatgaagaatgagtcagagccatgatctgactttatctgaaatctaccctatcgctgatcttttcagagagatatatatgtatttttttgagatggagtctcactgtgtcactcaggctggagtgcaggggcgtgatccaggctcactgcaacctccgcctcccgggttcaagcaattctcctgcctcggcctcctgaggagctgggattacaggcgcacaccaccacgcctggctaacttttgtatttttagtagagaccaggtttcatcatgttggtcaggatagtttcaaactcctgaccacaagtaatctgcccgttttggcctcccaaaacgctgggattacaggcatgagccaccgcgccgctccaatttcagacattaaccactaaacgcccgtagtggtttaattttgtttaagttagttttttttttttcattgcaaccaaaagaactttggttgcataatttacagtgaatgtataatattatgttaattagttgatgtattataccctttaatttacatggttacatttaacaaagctgaatgttaacaaagtgacattttaagtaagaatttgagaaacacttttgcacaagatactttggactttaatttcagacagaaaacttctcaatggacataatttgtgcttcgtatatgttagtcgcttttgaatgactcgaacctatacagtagtcccctcttatccttggtttttctttctgtgattccagttacccatagtctgaaaatattatatacaatacagtattttaagagagagaccacatttatatatcatttattctagcatattgttataattgttctattttattaataattgttgttaatctcctacagtgcctaattcatgaactttatcataggtatgtatgtctgtgtaagaagaaacatgatacatacacagttctgtactatctgcagtttcaggcatccactggggatcttggaacatattccctgtggatagggagatactgcagtacatccacaggctttggaatcaaatttcagctttttctgccacttattagctgtgagactttgagcaagcaactaaatatatctgagcttcatttttgtcatcagtaaaatagaaataatgctggtccccactcacagtgggggagtttgtgagaattaaataaagcatgtaaaacatttagctcagtacctggcccacagtaagtgatctatgaatgctggctcttatataataatataattctcggaataaccaaggaaaatagaacaaaaaatgccacctagatggcaggattgctttgcatagcttaattaagtatgtttcattattccaactccctggggcttttgagaataaaatttttaaaaatgtacaacgacagtctcattaagagagtgcagaaggagcaatctctaggcggggagtgagagggaggacgtgttgaaattgtggagcagaacgcacgagtactggtgtaaacttggtccttaaacagtaaatacacacatccaaccacacaaccatgtctttccaaaggaagtttttaaaaagttagaagaacttgggtcctgtataagagtgagatgttaacatattttatttgactgaagagtctagctattataagatctttatttcaaaaaagttaaagtgcaaaagatgtgcattttggaaccgatgcagtagaacagtggtgcattccatgtccagttttccaagtagctgtgaggtaggcgatattatcctcctttgagatgtaagaacattgaggcttaggaaagtcaagtgcctttttcaaggtcacattgttagtggacagcagtcacaattgcattcatccattcatctgaagaatttacctagtgttcagtgccaaaccccacaggggatacaccagtgaaaacaacagagcatgacccctggggttataatctcatagggaatttaaacaaaaatgagtaaggaatcaaatacataaaataattgcactatattatggctcctgtgaagggcagatatggggtactgagatggaaaacgtgaaggatggaaggaacacacctcttgcctctttgcagaagtgatgtttctactgaaagctgaagggtgaagaatcagatatgaaaagagccggagaaaagtcattccagccaaagggagcagagtgcgcaaagtccctgagatgggaaatattttagtgtttataaggtaataaaaacacttattctcatggtagactcagtttcgggtctttctcacttcagagtgtctgctatgaaccactaggcaacgctacctctgcaaaagggaaagttgggtgtttgaaggccaagagacaccatggagcagtagctgccaaaaggatgctcatcacttcctcacatcacttacttaactccccagaagaaaattcctttcatatgttaaatgaccaactccatctctgccttgtaaaagctggaggagatatttgaagggcttctgttaatatatgggatgtgggtggcggggaggaactggtggaaaagaggtcatgccttgaaaggttggaaaagggaggatggtggaaaaagagctaggagtggaccgttgactcctagtgaagaaggctgcatcaccagccacctccgaggtggaataccaggtgtctgttaatccgcagcaggatactattagaaagcccatttcacttgtcactgtatcgctgtggctctgagagttgtgccttttggttccaaattgttttcatttcagtaccttccttcccaataagtggtattgaaaatgagggaagaatgagaagacctcgatttatacgtgccggcagattcagggtgtatgaaaagctcctactcacaatttctggttctcttgagaagttgggtgatgtttaatgcaactttctcttctttttttccaaggactcatgtcatgaagcttttgactgttgggaggatctgtggggtcatgggatcactttgctttattaccctcctaattagacataattaataattattacaataatgttatatagtgttttagactcatatacaaaatcttgaatcctcataacaattctttgagttgcatgggattattccaattttacagataatgttcacagaggtgacatcatataaccaagattacacaaagagattgacctaactcttatgcctccaactccagaagacaaagttggcaaataattggcagatgagaaattgttgcagcactctcaataatcccaggaaggaagtacagatgttgattaattaacaacaaccaaaggtattatcacatctacagtaattagcatttatcaagtgcctagagtgtgtctggcatactgtgctaaattctatttattaatcaatctaattctcacaacaaacctgtcatgtaggtgccattagtatctccatttaacagatgaaaaaacggaggctcaaagaggtgaaataacaactagtttatataagtagcaagttgcagagacagttcacaaacccaaataatttaactccagagtcagtgcttgtcaccaccacctaaactacctccattgatggtgtacttctaatattaataacaatgacatcaattacatcaattcattggacagagcaactgtgagttgtgagtcccatctcttaccattggttaaaaaaacatacaagttttaggagcaggattccattacactgtctctgttcaaataagtagaaacaagtaattggggcaatggccttgataaataatcttaccataaagctgctttcacagaaaaatacttgtttgtatgtattttctacctttattagaacatttggatagttgtgtaggtctgtgctgttcttaaggaaggtggctattattaagggtggtggacttgattcaagtcctcccagttttgatgtgttccttgaccagttgattcttatttccctgacttgtaaattgctgtcagcttcagcttgccttattaagaattctgtatagttggccgggagtggtggctcacgcctgtaatcccagcactttcggaggctgaggcgggcggatcatgaggtcaggagatcaagaccatcctagctaacatggtgaaaccccatctctactaaaaatacaaaaaattagccgggtgcagtggcagttgcctgtagtcccagctactagggaggctgaggcaggagaatggcgtgaacccgggaggcggagcttgcagtgagacgagatcgcgccactgcactccagcctggatgaaagagtgagattccgtctcattaaaaaaaaaaaaaaaaaaaaaaaaaaaaaaaaaaaaaaaaaaaaaagctgcataatcaataggctgtaaataaatggaaacatatgccccttcccacatgtggggaatgttgctgttggctcttctgccccttagctgtcttgtagcacaatgcttcagctttcagttgagtctctttgtggcttgtctaactgctgctatcatatccaggtgattaagctgttatagccttaatggcaagtttcaattcactgtcgtcttcctcagctttgggtctgggagccccttacgttcccactttgttctctctgggaccatctttccatcttcaataagcctaacttctgagccacagcaaaacaaatgcgtatgcgttgaagatagtttcagaacttgtgcattgggaaattttctgtggtttaacacggtgagaagaactggaatagcctgtgctgttcagaagccagaactgatactgaaagcaggtgcaggcctgtcagccacacagctggttgagttaactctattagacactattggacaattttgttatctgaaatagaaaccagtatggtggcaggctgtccctttgccaaatgatgcccctgctaggctggtttaggtctgcctttcttgttggtgcatctgctgggttttgctgccagcatgttgaaaactggcagttctgtaaagttttattgtcttcctaggtgtttttgtccaggaaagaaatactaagatttgccgtttttttaaatgatgacttggcattttgactcttggctgtactttagctggaagaaattagtgtctgattttattctaatactggaactgcatcttttttttttttttaaccaagaatgattttctagttctctccaaatcaaacattcttgggagcctctattctaaattgtttttcacactcagttctaatgccttcacgtaatggattttgtaattttgttcttttctttttttcttttgaaaatcagcaacaagtaaaaagaacccctgtgggtgaaatacaatatccctcccaaaggagaaatggaaaaaaaaatgttatttcaaacttcaagcccaaacgttatctgccttctacattttaagcaggctcagagccttgaggattgagtcaaagaatgcaaaacatgacctctcaaaggcaaaagctaaaaaaaaagttggacctagaacatcaaatagctcttaccaaagagtgttttgatgagtgaagtgtaaatgaagcgtagaatatagctcttttccaggatacaaggcccaatttccgaaacatgcaaacactctctcaattgaatgcattagctgcttagttccagagctgctgaagtataaaatgcgataacttatgttaaacacccagcactgtgcctagccgatgttggaccctcaatttaatattattattaattatttctatatagaggggaaacataaagaaacttgtttcaattacttatttgacctaaaatacaaggttgcacaatgcgttgtagcaaatgtctataaatctttacataaaggtccctggaatagaatctcattctgcaaattcaagatcctgtctggagaaaaagagtgaagactctatatgtatatttttgaatgaaatagagcacccatatctactatgtgtcttatgagaaatgtttccctagaggagactcataaggagtgacccaagaactggcttcagagttttaaaggactgccatccggaaattgtagtagaattagtctcctttgcttacagtagagaactagagctagtgggttgaagcttcaaggaaataactgtggttcagtgaaaggaaactcttgctgacactttaagctatcagtggaagggaccctccaaagaagtggagagaaatcatgtggacactggaatcttctggcaggaagactgggaagagtttctgcaatgtatggcgaggccaagggcagagggagcagttctgttggtttagatagataaccttaaaactcttctatgtggagactatttgggtccagctgaattatctgccttggaatcctcccatccacttttgctgaacagcacagctattactgccttttagatatgaaattcaatagcatttgttccttggctcagatcattcacctttaattgtgcccattaataccagtgataactaatgtttattcttcagttactatgttccaggctctctacaaagtgttttgtgcatattgcccttttaatacgcagagatactccatatgagtatttttattatccccattatgcagattttaaacatgaatcccagttggcacaattaaagaggcagactcataactagcaatactgagatacaaagcaaggactcttaagtccaaagcttctgttcttaaccacttctttgtactaccctccccccaccccacccacttactctgaattttaagaagagtgctttatcttttcattattccttttgcagcttcataaagcttttatatgcatttcatcaggggctacgttctgaaaatggtgtttctggaaccatggttctggaaagggcagagactaaatgatgccgacattggtatcatcgtcatcatcatcaacatcacatcattgccatcaccatttatagcatcatctccataatcactaccaccattgctatcaacatcacaccatcaccaacatcattatctatcatcattgccatcatcatcattgccataattaccaacatcttcttcctttttttccccattcttcttcttccttctccttttcctttatcgtcatcgtcattaccatcaccaccatcatcaccatcaccaccatcaccatcatcctcatcatagttaacacatattttgtgctcactgtgtgccagcacattacaggtactaactcatttaatcctcccaccaacactatgaggtagggatattaaccccatcttacagttgagaaaactaagatgcagagtgaatagcttgcccagtcatgctcttaagcacaataccttaatgcctctcaccctttaggagctgcttttcagcttgactaagggtgggaatcatcacttaaataagtcatagaaacttcccaaaagtgtaaaagtgttcactcaacctttatactcaggtttttttctgtagaattatttaaaattttctagacattataatcatgtgcttctccctgttacatgatgggtaaatggccatcacaggttaggagacagacctttgtagagctatgtttttccaaatgcacttccttgttcctaagttggagggcattgttaacattcatgggctaatattaatgagagccactggatacagggattgggatggtgctcaggactctcgatgaattctcattttatactcatgacaaacctatggcatggctgctatgattatgcccattttactgatcaagaaacaggctacggatagttaaataacttgcccaagatcgctaacactaggaactagctgagttagcatataaatttaaggttttctggctccagagctagtgcatgtaatcactgtgtttcactgttcctttcattcattttatgaccattttgtttgtttattttagagacgagcatctctctatgttacccaagctggtctcaaactcctggcctcaagtgattctcccaccttggcctcccagaatgctgtgattacaagtgtgagccaccacactcagcttatggtcattttggaaacttctctacacgggctgacctccgctaactctttgctgtcactcctatttaaggctgctgttagctcctgtgctgttagccaggcacatagtaggaatacattattttggataattctggggactataggataaaatgtgaaaattacaagatggattttttttttttagttaaagtaaagaagacctttctaaaatgtgtatctatacaccaatgatactggttgttttggagaggtactgaggtctttactccatggaagcaggcaagcagaaaaataggcccacctatctgccagaggtattgtagaaatgattcaggggcagaagattgaatcaaaagaactctaaggctgggtgcagtggctcatgcctgtaatcccagcactttgggaggccaaggcaggcagatggtctgaggtcaggagtttgaggccagactggccaacatggtgaaactccatttctactaaaaatacaaaaattagccaggtgtagtggtgggcacctgtagtcccagctactcaggaggctgaggcaggagaatcacttaaacctgggaggcagaggttgcagtgagccgagatcgcaccactgcactccagcctgggcaacggcaagactccgtctcaaaaaaaaaaaaaaaaaaaagaactctgagacttcatatgagactcaaatatgagtttaaatctcatatctcagctatgactgcttttcaactacttattgtatccttgaattagctcagttctattcagccatctgcttgctttctttgttactttcatttaaaatgattctttgttgtggaaaaatacagaaaacaaaaaatttgccattttaacaatttaaactgtataattcagtggcattaagtgcattcacaatgttgtacaaccatcaccactatctagtttcagaaccacctcattaccctacccctaaaagattctacttctagttagatacctccccaaattaaaaataggtattcaaacaaaaactgaaaaacttgtactagaatgttcctagaagcactgttcatagtaacccaaagtgtaaacctagatgtccatcaacagacatttgatggatgaacttaatgtggttttgtccatactatagaatatgagccataaaggaatgaaatatgttttccaacattgatgaaccttgaaaacattaggctacgtgaaagaggccaggcacaaaaggccacatagtgtatgattccgtttacatgaaatacatgtattactttttgctagatctgtaagccctctgtggtattgttaacatagtactttttacctacattgacctaatcttttagagacataaaattccaccatagcgtcttcttaagcaacgatatatatgaaacagtgggtttgagatgctagttccatttttccaatatacatgaaaataataaaatctaattctaaaaataaagtttgcccatgtgccatctaaatgcatctgtgtaccatctcaaatacacttaaggcatttcagaaaacagccttttgggatcctcttggcaatcaatttctccttgaatgtgatccacacagctcttttctctgtacttaagctatctgatatgacagccagccactagccatatgtggctatttaaatggaaattaagtaaaataaaatggaaaattcatatcctcagtcacactatccacatttcagttgctcaatggcaacaggtgactagtggctgccatactggatgtgacagatatattgccattgtgctagaaagatctactggacagctcaacctagggctggctttcattctttctgttgtgctagggaagctccctgatatggtttggcattgtccccacccatatctcatcttgaattaccacatgttgtgggaaggacctggtgggaggtaattgaatcataggggcgggtttttcccatgcttttcttgtgatagtgaataagtctcatgagatctgatggttttaaaaaggtggagtttccctgcacaaactctttttgcctgctcccttccatgtaagacatgacttggtcctccttgccttccaccatgattgtgaggcctccccagccacatggaattataagtccattaaacctctttttcttcccagttcaggtatgtctttatcagcagtgtgaaaaacagactaataacactccctgtctcctagatcccatgcttaagtcaacctctcactcagcatctttaattcccaccacttgctcctggctgaccattcatcccccagccagctctgaaactgacctactttcccaatgtcaccagggagggcctggtgccaggccacggtgtggtgcatcccctcactgctcccttcctgtttgctgctcgcccagctctggacgcaatccatcttgccactctctcttgctctcatcgtactgacgtgaggatctcctcccacacagccctggccagctttcctgaagggctctgctgggcttcaaactccattttgtttcattatcaagtgtaagaaaacagcccttttccttttcccacacttctccctttactctcctgttggtctgtcttcttcttctccttcttcccctgggttttcttctctttaacttctcttcttttcctctttctcctcctttgttccctctttctcttcctcctactctccccacaattatttctctgtagttgtaagattaaccctttatagctatttgggaaaaaaaactggaagaaggactatagtaaaaagaaaaaaaaagctatattctttttaccatttatacagaaaaacaaaacaaaacaaaacaaaactcctcctccacccagcagttcctttgccctttaggtggtaaacacatcattctcttctcccaccaagagggtgaccttgcaattatggatgaagatatgaatatcagagcagtgactgggacttgcagagcttagtcttttaggggacacatttccacaccagaaatccatgtccgggtgtgaaacattattactgctaatgtacatagtgctgtcaagtttcattatgaggcccggcagagttcagacctctatttaggccagaatacagtgaactctgtcctgatggttctcacatgccatccagcacaccgggacattctcaacgctgctcaggactccagctccggccagatgaaaatctgctcctgctcattcagcaaatggtcactgaccgcctaccacatgccagacactgtgcaggggtgagggcacgcagcgagggctcagacatgatccctgtttcccgggagcttaccctccagcaaagaagagaatgtatgtgtttgaaaaactctaaggtggaaatggagctgcagaggaagtgaggggagttttgaggagggagtggaggctggaagctcagtgagccttttgggaaaaggtggactctctgctcagttttggaggatttgaacatgtgaatatttaggcgagacagatctttgtatttaaatgagacttgtgattttgctttattttcttttattttttaatgaaaattttaaattttatttttaaaaataatatctagtaaaattgactgttggaggcatgactgtatgattcttggcacacagattcgtataatcatgactgcaatcaggattcagagccgttccatcacaccagcccccaaaatcccttacatgtctacttacagccacactttctgctctagtcacacaatcactgatctcttctctgtgtctgtagttttgggtttcggagaatgtcatataagatagaatcatacagtgtgtaaccttctgagggtcacttccgtcaatcagtagaatgcctctgcaattcattcaagctgttctgtgtttctataattcattgtttgtattcccatattgtatttcattgtttatccatacaacgatctcactcttaggtatttaacctatggtcacacaaaaacctgtgcacaaatgtttataatctcttttcataattgccccaaactgtaaaacacctaaatgtccttcgatggctgaatagaaaaacaagacttttgtggtcaggcatcgtgattcatgcctgtaatcccagcactttgggaggccaaggtgggcagattgctcgagtccaagggttcatgaccagcctgagcaatgtggtgaaaccctgtctacaagaaatacagaaattacctagctactaaggaggctgaggtaggaggatcacttgagccccggaggttgaggccgcagtgagctgtgattgtgccactgcactccagcctgggcaacacagcaagaccctatcttgaaaacaaaacaaaacaaaaacaaaaatttgtgattttcactgagagaaagtaaattcttgttaacttaggcacaaaaaagtgcaaaatgatttattggtccattcaactagaaaggatggacttgttatcttgcgtgtctagatccaggctcaaacggtgtcttcaggtcttcctctcctttccatatttctccctgttaaggtgagttgtttgcctccaggagatagggaatgaactcatctaaactaagtattgattcacatacttttttaatccagaaagacagtgatcccttctagttgcaataaaaaattcccagagaagaaatgtgtttgaatgagattgagtcacgtaccgatccctgaaccaatctctgtggccagagatgccctccagggttcgtgggggaagatctattatcaggaaatgaaagtaaccagaaacaacagctatgactgcatttccagtggagggaggtgtaggaacaaaagctaagaagtggaaaatcacaagactttactgggataccatgagtggtttgggtttgctccaatgcaggatactgttaagaacagttttaggatggaaggttggaaaaattaaagttgccaaggagcatggattttatttttggacagtggggatccatttcagggttttgagaagggtggcacatgatcagaactgaggtgtgggaacatttcatctggcaagtgggcttgatatgagtatggaggatgaaatgtaggaatctgaatagcagtacagatgttatagtgcaggtaggaacaaagtgaaagacattttggtagcaagcaacagaaataaagcctgattagcttaatttaattaaaaggtaatgaaggagaaacaatagaaaatattgtttggggctttactagaccttttaaaaatcaaagtataagttgagcaactaatcttggaaaggtcataaggtgaggcaacattcctcgacgaaggagagtcactattacattggtttagagccaacaattcctggtctgtgtgtcttacctatcaactttcaaattcctaggagacagaatctaattgatccgccatgggacaggtgcacccctcccccttgtatatatttttatggccagggaaacaaataagtgttctgatatacataagggaggactttttcgaagatccgggcttattgtatatccataggcacatcgctctgccccagaagggatgcagtcccgtgaactgtactggtatagaaggaagcctaggtttttgcgagaggaaggaacatgaatatttttcagttcgtttagaacagacagtccaaatgagcagccagtagatcggttttatttcatttacatttaaatgaatttgaatgcctttagctaagattttcaccactgttatcatcttgcacctggctcgttttactcattgatattatctgcccagttctgaaaagcatgagaaatttgtattctttctgataaatcaacttggtgtttgccctgaaaaaagcaagtagaaatggagtaatggaagattaaccagtattctgatgggtcaggtccccctcctaatgttcttacagcaacaggaacattagctgcagacatattgccatttattgtaattatttgcataggatctgcctttcccttaaactctaaatgattgcagagaaaggaccacacaatttttacttacctctttaattcctatactttgctagcataaagtagatgttcaatggatgtttattgaagtgatgtgtttactaagaagtagatttgaagcctttctatagctgtccttttggtatatttcttagtggatcaaactcttaatttgtggtccataatttatggttttggttttagcattgaaattttcatgccaaaggaaacacctcagtgctgggacaactgggatggttggtcacactactactggatgtcaatcaaaaacaatgtgcttatcataggaccccttctaactctcatgatgccaccatgaaacttcgcaacagtgctgtgtggttgttatggactgaaagtttatgttgaaaccctaatccccagagggatggtatctggaggtggggctttgggaggtaattagggttagatgatgtcatgagggtggggcccttgcaatggaactaatgcccttataaaaagaggaagagccaggcacggtggctcacccttgtaatcccagcactttgggaggctgaggtggacagatcacttgaggccaggagactgagagcagcctggcccacatagaaaaaccctgtcttcattaataatgcaaaaaattagctgggcttggtggtgcacacctgtaatcccagctactggggagacagagacatgagaattgcttgaacccgggaggtggaggttgcagtaagctgagatcacgctgctgcactccaggctgggtgacagagcaagactctgtctcaaaagaaaagaaaagaaaaagaaaaagaaaaagaggaggagacatgaagtagatctctctccaccatgtgagtacactttaggaagacagccttctgtaaacaggcaagagggctttcaccagacaccaaatctgctggtgccttgatcttgaactttccagcttccagaactgtgagatgcaaatgtttgttagttaagccacccacactgtgatagtttggtatagcagcctgaactggtgaaaacagcggccttacccccattgacacagaagtgagctgagtctggaataacttgatttccttaagggtataaacaccaacagttgtggatttaaaactgaacttcagtttgcctgtctctaaatccactctctctgcaactcacagtgctcccagagttcagggtactgagttatgaattcttatcctcagggagttgacagtctgggagaggtgataacattgttcaggctatgaattacacaagtccaggagcacccttcatatcagcttcatcaaacatttgtgttttattttgacagttgttttggcaaatggtagtaaagggtcttcagaaagaggtgtctttttaaaattagtcctgagtggttgggaccaacataaataaagaaggtgccctctaagtggtgtgtgccacatgaagaacaggggttgagagttggaagaggatgcgtctaacctgaaggagtcaagtaatactttgtggaagaggtattatttgagatgatcatgaggggtggccaataagcctgatgcagggaatgaacaggaattacagctgcagaaaaataatatggacaaagatttgtggcctggcttattgtccttgctcagccttccttgtgtttggtgtcaagtagggaaaaggtggtcctcgggtggagattaaggtatccctttttgaatcaagtcaataaatggtgaacatgctgtgctcaatggcaagtctgctggataaacataaatgacagaagggaagatctgacctttgctcctggtgggaccaaatgtgtgaaagtggaatcctcagagaatagcaggagacaatgtgttgctaagtgctgtcacatgaggaatggattaagaaaaccaagagaggccgggcacggtgactcacgcctgtaatcccagcactttgggaggccgaggtggcagatcatgaggtcaggagattgagaccatcctggctaacacagtgaaaccccgtctctactaaaaatacaaaaaaattagctgggcatggtggcacgcgattgtagtcccagctactagagaggctaaggcaggtgaatcgcttgaatccaggaggtgggggttgcaatgagccgagatcgtaccactgcactccagcctgggcaacagagtgagactccgtcacccccacccacccccccacccccccgccaaaaaaaaaaaaaaaaaaacagaaccaagagaaggaaagattattaggaaaccccacaatgaagaaacagcttgaaatcagccttgttaaaaacaaatactgggtttagactgaagaggatgaggcagaaaggcattctgggtgggaggaacagcatatactaagagatggggttaggaccaaatgcattgtgtattcatgggagtaggggaagatgaggagagaaaattaaatatcgtagagttggaaaaataaagaagtgtgtggtaccacccccccatttttcagagagggcaactgaggtgtagggaggttaaatgagtgctggtgcgccttaattcaaagcctatgaaatctgaaagattttggttcaaataaccagttgactgcttaactcagctaaaattatttttttaaatggcagaaattctaaaacataaaagtagcttaaagaagataggcattgaattctttcttgtgcaaaggttgtctagggctggtgtggtattccacagtgtccgggacccaggctccttctaccctgtggctctgccaccctcagccagtggcttccacatcataattcaagatggctgctactgctccagccatcatatctgcattgcaactagaaggaaggaggaaggaacaaagacgggctcacctccttcttttacagtacttcctataagttatacatatcataccttctgtcttcctattatccagaaaattgtcatagggtcatgcctagctactagggaagctagaaatgtaagctttattattggaggttctgtgcccctctaaaaatagaatttctgttactaaggcagaagaaaagaggatattgatgaacaaccagaagtctcttgacccgtatagcttttcacaccattataaaacccacctctgttttctctctgtaaaatgagaaaatctgcacttagttctttgggtgagaattcaggtaacatatggaaagtatctggcacaccattcaacatatattagaggctaaatacattttagtcccttatccttaagtgatcgctcttactcacatattcagggagacaggacaagattctaggtctcctgatttgaagaccagagttcttttgtagcagcatggatgagcaaatatcttaattgtcttctagtttatttgtttaattgattaatataaagatattttccctggtcaggcgtgggatgtggtggctcatgcctgtaatcccagcactttgggaggccgaggcagatggagcatttgaggtcaggagtttgagaccagcctgaccaaccccttctctactaaaaatacaaacaattagccaggtgtggtgttgcacacctgtaatctcagctactcgggaggctgaggcacgagaatcacttgaacccgggatgtggagtttgcagtgagccgaggtcgcaccattgcactccagctggggtgacagacaagactgtgtctcaaaaatatatatataatatgtattttccccaaataatatcgtataaaaaagaacaacatattaacgatgtaagtggagttaggaatgttagagtcccattggcatatcacccccgacctttcctctctgcctttgagttacctcactggatgtctagttgtaattcacagaaagcaggtagacacccactggacagagagacaaagtagggctcatcatcaaaaggaaaaacgaaagaaaacaaaaagacagagagttgagacttttgttcattccacaaatttgcattgagcatctactttataccaggtagtattctaggttcttcaagggagaaaaagcagcagaaggaaaaaccaggcaaaatccctgcttttatgaattctatattccagtatgtgaatatccagaaattctgaaataaaaatcgcaccttgaattgaatgtcaattgatccatatcatctcattctatagtttttggttggaagagcaacatgcacgcacatctgccacttggagatcttgaataatttggcagcataggcacaggtgattgagtgaacttggaaatgcacgccacgttacatacatttttttctgctcatttggattagaagctcattatgtgagctggttccactggctcttgtgccagctggttcaaagtggttaggtgatccttagtcatgagaggttaatggtgacgcatttggtgctattttaacagtgttataaatactacccagcatttccagattcctcaccccaggttccaagagcagcctgagattcgaagaaccactttattaatggtcattcagaattccaataactcccaataaagtagaattaggacatgcatcttagaccctactctatacaccctgcttctagttgaaatctttggccagttgggtcaaagtttcaggtatgctctgtggagttgggaggaggagagtcatatttacagaaaaaagctttgtcctaacctacctcaagttttagacatagcggttgtattacaaaagacagcatatagggtcctctccttaaggagtcacccttgactcaggtgtgctccctgaatagagttggatgcccagggtggcacatggattacaggctttgcaccatagaagcttcatctaccagtaagcccagtccagggggtgctgtgagctctgaacaatcaaatgagctcctcctctctccttggggtagggcctagacgagctctcattgcctcccttcggggactggaattagtagccaaaatgattctccagcatttaaaagaaagcttttgaccccaaattttaggaggaagaaagacaattatataaaaccatgacaactactgctacccctaccatagtttagcagacacccataatgtgccaagcactctgctggcctttatcacgttgtgtatctcattagacgtcatttagtgtgatccctataattacccagtgacatggctgttatgacctcacttttacagaaaaggaaacaaatactctgagaactgaggatacttacctgaggttgaaagccacaaaattgaattctaactcaggctatccaattcttgcaatattgcctcttggcagttgttgtactggaatcaaatatttagtgtgcaggatcctagagacctatgcctgctcattcattttttcatttattccacagttacttttaagctctggcttaaaagtcaggacacaccctcttctaggtgttttagagttgcagtgatcagaacaaagacccctgcccttaagaagatttctattttgtgtcctaaaatctttaaaattcagtattgctcagccaagacaactaacattatttttttaattgaccacaatagaatttgtgttgaaagaataaacaatacttttctccttataaaaatccttttcttctttctgtttctttatgttgtggtttctgagcccattttagagtatctctgtgttggagttattatttttctgtcttgacttttttttttttttttttttttttttttttgagacggagttttgctcttgttgcccaggctggagtgcaatggtgcgatctccactcaccacaacctccacctcctggattcaagtggttctcctgtctcagccacatgagtagctgggattatagatgcctgccactacgcttggctaatttttggtatttttagtagagatggagtttcaccatgttggccaggctggtctcaaactcctgacttcaggtgatccacctgccttggcatcccaaagtgctgggattacaggtgcgagccaccgcgcctggccttctctgccttgatgtttaagttctggctctgctgttaagactttttaattgttcacggggaacaggaaaccaccaatgagtactgtatatgaaattgagcaccagggcaaagaggaaggtgctgccgtcaaaagacagcgcaaggatattcagaggaagaagagaaggaggaggtggatgagttgggaattgaaaactggcaaaagtagagtgaagttgtactaaagagggatgaggattcatttgcgcccatgagggaatagttaatggaagatgagaaagcactaagatagacatcaaagttgaagggatttgcaaacaccaggagaatgcttgtaagagaaaaaaaaaaaacaaaaaaaaaacactctgtgaaaatgaaagtatcttgagaattgaaaagaggttaaagaaaactgactgtgttttcaaaaacatgtaaattaaatgacaaacgaagaaactgtgacacccaagcagttcaaggaggcatttaagggacactgtgatccaggaaacgtccctgggaacttcagaaatggcaaagtagatggaaaattaaccgaaaattgagaaacactaaatgggttatggtggcatttgtgaaacagtaagagaattaaagtctaagggggaaatagtgaataataaatatgtctagagaacatctcaaataattagattttggaagttaaaggagacttatgactataagacgaaagagataaaatagaaatctggaggaatgagatattttaagtcatagttaaagaagcttatgcagcccattatggttggctgttcacacaaggacagagggactctggaaatgagtatactaaatggcaaggggaagcatggctttaaaaagcattgcatttgtagtagggtgttagaaaatatgacagggtggaaaaagagtgaaaactgcatggaaaatttgcatcaatgttaactactatttattaatagctgtataccaggcactgtgctaggcattttatgcgaactatgaagttaggttaaaccatatgaaactgtcatggctagtctgtatggtttaacttaatccatttttgcaaaaaaaaaaaaaaaaaaaaaggaaatggaggctcagtagattttaaatacgctgcccaaggtgccaggtactgtctcactgtaaagcctattctctttcctcgatgtcatgaaacctcaacaacatagaagcagcaagttattcttttattcattctgcacatgttcagcaccagctctgtggcgcacaccctgtttagcactagaaatataatactaagcaaggcagatgaggtccctgcttccatgattacagtctaccagttaaaaacaaaagcaaaagcacaaagagagtctagaacagctgttcattagaaatataatgcaagtcacatgtaacttaaattttctggtagcccattaaaaaagtgaagagaagcagataaaattaattttaataatatattttatttaacccaacatgcctaaactactccaacatgaaatcaacctaaaattatttatgagaccttttactcttttgaaaaatacgaagtcttcaaaattctgtgtgtatttttacatggatggcacatttcaattcagactaaccacatttcaaatgctcaatagctacacgtggttggtggctggctatctaacgtgatagcaggcctagtgagaattggacaattctggccccgtttatattcaatcataatataggaaatataggaaatattgtctacctatttttcaatgttatctctgatcaccatgcatcaccattcatagagcacaaaacacaaggggaagaggaatgtttatttaacctggacttcagcttcatacacttaatactgtaaataccagaggaaatgtgtatatatatgtacgtattttatgtatttttttatatatataaaatatgtaaatatatatgtatttagtgttgtgactgtcactggcaataaaaaacaacttagcactttaccaccagtggatgacaacacagaagtcgtcttggcaaatcactagagtcttccccttctctatttgccagcatgcttctgtgtacttattgctcctgatggagatattgaagctgtaatttgaggcttagaagcagtcagaatttctgacattttatctgaccactaaagctttatgatcaattttgtagagataagcaaaacaatgacaagattttactgtttaatacaagtgcccagcaggtgttaatgggaactgatcaatgtggtgtaaaatggtatttccctaggtaaagaactctgctctggagcaagtttaaatgggaagaaagcccatggaaatatggattgtccttcctagaaattgggtgggggaattgaaggtaataggtacttgctccctgccaacttcataatgaaattactgttcagcagaaatttctgttagaggtttttttttcccccctcccaagggactgaagacttttaatagaaaaagacaatattaacattgagtatatggagtcattcacccagaatattgaatcttagaggaacacagaaaaatctgaagcatgaggatttctgcatagttattttcatataatctgaagaacagtgtttgcgtctcagtaatcactctgctaattccatctgattttactaccaaatggaagaaaagggaacaagtggagaacatggagatgggaaattaaagaaggagattttaagtaaatccaaagaaaggtgctcaactgcgtatgctaccttcttgattaaaacaatcactgttttggctgggcatggtggctcacgcctgtaatcccagcactttgggaggccaaggcaggtggatcatttgatgtcaggagttcaaaccagcctggccaacatggtgcaaccctgtctctactaaaaatataagaattagccgggagtggtggcaggtacctgtaatcccagctactagtgaggctgaagcaggataattgcttgaacctgggaggtgaaggttgcagtgagctgagattacaccactgcactccatcctgggtggcagagtgagaccctgtttccaaaaaaaaaaaaagttgctgtgacattcagttcatgttacgcaaccttgtgaatggctctccccaggagcaagtgtctttatcgaaaccaaaacatttgttccctgatccagcatttccaaacagataacaaactggatatttccaaatttcttgataatttactaaatttttcagttttcccacatttggggcgctaggtagactcaacctgaactacattcaccccaaagtgttggataattgaaacctggcttaagatctcattgtactcaataagaaacacctcagtgagttggccaccctaattatcaacttagggcagcaggtacagagtgactggtaacttattttcgctagctgaggtaaaggccattggtggtctttgtcggtagtttttgtactgaaattccattgcagttgcctgcctatctgtccaatctcttcattccacctgttgctttctttgaccgtcgtctctattccttgcttgcgttactacaaagcctcatctgtttgcccatctgcctcttacaaacttgcatttcaagcctccattccaaataaacacaagatgaagtctaaactcagtctatatagtacttgcttatctgactcctgcgtctgtctctagcgtcctctcccaagttactttcccacttgcccccaacttattgtgaactgacggcagctcattgaacacatcatgatgtttcagggttttctgccttggactttgcattttctccatgtgcatgagcaagagctgctcaacttttccttcctcttccttctcagcacaacccaaatccctttaactttgtttcctttttccagtcatggaatcaccatagaattagccactgcttctcttatgctttccaacaacttagtccatatctctatttttacacttattgttcttcgttatagttattttgtgtgtccctctccccaaccttgaaaaattaagtatttttggtcatttttgtatcattttcatggcatagttctggtacagggtgtgatacataggagatgctcaaacatgcctaatggatggaagaatggatgaacgtattaatgaatgtattgacggatagatggatggatggatggattaatggattgatgaatgtattgatagatggatgaatggacaggtaaatgtattgatggattgatggatagatgaatgactgcattgacagatgtttggaagggtagatatatagatggatgaatgtatggatgggtggatttccctttggtgatgatctgtcaacatacttgccaaacattaactgagcccccacagtatgccagacaatgtgacggggctaaaaataaccctgggaaatggaaccaaaatgtcagcttaaaaaataaaaacagcttaacttaggctcaattagttactttgaagtcctgctaataatgaggaatttgactccagttctccactaaacagtccatgcaaatatcttctttagagtctcaataagaggtgtgaggtggagcacacctagctgtgtgtatctggaccatgttcatttagttcatcaaactccagccaggaaacatcaaaggggagaaggaagagagaaaaaaaagtttcaattgtctagataatgaatggtttttaagccgtgaacaaaaatgttcaagtcccctcaagtgcagagaagcattttcacttctgcccctattggctgcaaatctgagtatatcactcctctacttaaaatctttcctggctcaccatgaccttctgaacaaatccaaacccttcagtgtgtccattatgatctggcttcagggatcctctgcagactcatcccactgcacataacataaccatctgccttactaagccgtttcctacttcctctagcgtgtgttactacctttgctgactctttacttaagatgatgcctctgcccagaatgctttctcctgcctcaaccccttcacccattaagattccctgggaagccctccccagattccccaggttgagttagggacccttttgtctgtgttgtctcaccttcttacatttactctccatcagtgaataagtggcattataggtactgtcattgtttatgtgtctatgccattgaattataagaatgtgggtaagaaagaagacaaacactgtgttttttatttctgtatctataagacttactataagccctgacctatataccaggcatacagtaaatatgctttctttgaccgtcgtctctataataaatagagtaattagttgttaaatcaagaaaatatccttccggcaggtgtggtggctcatgcctgtaatcccagcactttgggagccagaggcaggcggatcacctgaggtcaggagttcgggaccagcctggtcaacatggcaaaaccctgtatctactaaaaatacaaaaattagctgggcatagtggtgggcacctgtaaccctagctacttggaaggctgaggcaggagaatcatttgaacctgggaggcggaggttgcagtgagccaagattgtgccaatgcactacagcctgggctacagagtgagactccgtcttaaaaaaaataacaaaaataaaaacaaaaaacaaaaaacctttctaggaagtgataagagataccccaaataaaccagatagaatagtgattatcctttgttccttctagaatagcagtgttttagttttctgtttgttaaagtatttgattgcagagaacttgaagaatacaaagatacacacacaaaaaaatgaaaaatacccataacccttttagacatagacaagccctgtttttatcctcttttctgcttctttaacattaaatagtaagcattttctctgcatcattaatttgtcttcaaaaacatgattttcaatgacccgaatggtctgttgaataaatacgcaatatttgctcttttccttttccccaatttcttcactttgtccttggaaaccagattctcccccacacaacacccccatcagtcgcttctgcaccatgctggtccagggatgtacatgtgacccattaggccagtgtctcttcttaaaatttcttgtagcctagttctcttcttcttcttctttttttttttttttttttcactttttagcatctctggatgttaatggaatatgaagcaagtgacacagtatctttctggggaagtctttgaatgcttcaatccaccatattggatgtatcttgtgtctgctgagtggccaccaccatgttgtctcagatgtctttaacgacatcacatttttctcaagctgcaaggagagcggatcccttggggaacctctcacccgaaatctgggagatgaagtctgccttggctctctgagttcagcctgagtacaggccaaggtggctttgaggagtgatgagggtataaatgttgtaaggcagatagatgttacctgcaatgaaaacacctagaccaaaaattaagtttatacatgttatataaggtagattctaggagtcatcgttgatgcctctttctcccttcccctcatctaatctttcactaaatacctcctaaatatctctccactcggtcttgtttgctgttgctttttctcttcctccttctcttcttctttggccacaaccagagtcaaagccaccattatctttgacctggtttgtaagaatagcataagtagtccctctgtacccgctctggttcccctccaatctattctctacacagccttcaattgacatgatctattacctctttgatgtcaccctcgcttctatgtcttcccatagttttttttgtttgtttgtttttctgagacagggtttcacacttgttgcccaggctggagtgcaatggcacgatctcggctcaccgtgacttctgcttcccgggttcaagcaattctcctgcctcagccttctgagtagctgggaatacaggtttgcaccaccatgcccagctaatttttttgtatttttagtagagacggggtttctccatgttggtcaggctggtctcgaactcctgacttcaggtgattcccctacctcagcctcccaaagtgctgggattacaggtgtgagccaccatgcctgcaccttcccacggttttaagacagacatttaacatggtctctaaaatcctgcactttctgttcctattcatcttctcagcctcacctgatctcacattttcctgtctttctctgcttcagcctctctggtctgcattcagttcctggtatgcacaccacagagtctttgcacatgttgcctcttttgcctgtttgtgtcttttcttgcctagttaatgccaattgagccttcaggtcaagctgcacttcctcagccttgcctcacccctatttcactttcttatagcatactctcccgtcccttgtatcatttgtcataaatctgtgtttaatcaattcatgactatcctcccccttagactctaaacttcttgagggtgggaatcatgttcattttcttatttaccctgaaccaactagctgagtcctgacatatagcaaatgcttcatatatattagttgaataaataatgaataatggaatgtcattttttcaacattgaatgccatgtggtttatgagcaagcagcttccttcagggaagtttgttagagtataatagaatgtgttttcagatcttcctgtaagaagatcatttgaatataggtctatgaatctggcaggacaaaaagcttacattccacgtgttaattacagtcaattactaaagcatggtcaactagcaatggttgcatggttattaatacttctgcagagaggcttcttgtgatgaatatagcattgtaagtttataatttttcagtattccattaatggtggcatccacttatttgttcgattgctctaattctttcctaaaaatttgtctttctctcttcccctttctagatttatggtcaatgttacatgggatggcaaagacttatccttcactgaggaaggctaccaggtgcaccccaggctggtggtgattgtgctgaacaaagaccgggaatgggaaaaggtgagcatccttctgtgtgctgaatgcaggggagggaagaaagcatgggcaataaaggggctcacagtgcttctttctcccacgcatttcctgttgagctgctctagatcccatctcacagccaagagcacgtctttcttgcaacaaggcagactaaatctgtaaggtgcaattggaatgctttctctgggtgaactgtggtaattgtgtggtgcgctgtatgtctgttctcaaatcccagtaggaaaggtctgaactaaggataatttaaagacagtgaagtctgggttgcagcattacactaataagtgttgactatgtagcaatgatcatagaagtttgcctaaacttcctaattgtgtaccatagtcattgccatatgaacgaaccctctgtattttcatgtactcagtcttttgctttaaataaactaattttaaaaacttaaatgtatcacttctgtaaatcatgagttagagagggaggttatttttcttataaagcatattttcaactacatgtatattagctattgaaaatacaaaaaatcgtttgcaaagaaaaaaatcatcatcttatgtaccatacatgtcatgacctgggtcagagaggagagatgtcacagggaatttacagatgatctcatacatacaatgacaatatctggttcagttgccctccctcctcctccataattaaatgcttaagttagtcgctacaatttcgtataaagagtagaataaaagggatcagaaagcctttgttgttacgttgttatcttatttttttgttatgttttttgacaagcaatgcatgacctctgaactactttagcatcttgaaatttatcttcacttagtacatcaaatggaggcctgagtgaccctagagggaaggaagatataggatgtgctgtgggagacataatgtaattgactgaaatcagggggaaatactatacaaacagaagcattgactctggggagacaatgacagattcctagaaaagaacagtgaggaggaagcttaggaaagttttgcatcctacacccagcaactataaaatgcacagcctttcgagtgcacatgggaaatccaccaaagtagactacattctggagcataaaacaaaagtctcaatgtgtttagaagaattgaaataatggagggtgcattctttgatcataacagcattaaaataaaaattagtaacaaaaatatatctagaaaatctccaaatatttggaaatggcaacacacttctaaacctataggtcaaagaagaaatcagaaagacattagaaaatactttagtcagaatgataatgaaaacacaaaatatcaaaatttgaggaataagattgaaggcacactaagaaattcatagctttaactgcttataataaaaaaggaaagtgtgaattcagtgtcaatgatttaagcttataaatttagaagttagaaaagagcaaagtgaacaaatgaagtagaagaaaaaaatcataaatacacaagtaaaaatcaacaaggtggaacacaagccatagaaaaaaatcaacaaagccaaaagctagttctttgaaatgactaataaaattcacagtcgctagcaataatgatcacacaaaagaaagaaaacacaaataagccaatattaaaaatgcaagagggactatcacttacagacactacagatcctacaggcattaaaagataaaaagaatattatgaaaaatttatgacaacaaattcaacgatatagataaaatgggcaaattctgaagaaacacaattttctacaactgagatgtaggtattgacgatctgaatagctcatatttgctgaaaaactgaaaatatacctaaaaactttcccattttaaaaagacaaaagagaaactcctggcctagatggcttcgtctatctataacaaacatttaaaagaaataacagcactctatacaaagtttttcaatatgttactaatcataatgtaataatatattttaaaaaggataatacatcatggataagtgggggctatctgaggaatgcaagattagtttaacatttaaaaattaaattaatttaccacattaacagagtaaagggggaaatatggtcatttcaatagatgcggaaaaagcatttgacaaaattcaatatccagttatgataaagatggtaaattcctcaatctgataaagggtatctatgaaaaacctataatatatatatcgatttatatatattatatgcacatacgcatatcatgagatgctttatttgacaatttttaagtttttctgtcttattctaagttagactacggtgcataaaatatatatattaaataagcttatatcttatttaatgatgaaataatgaaaatagatccacataggcacattcaaatgatttttgatcaatgattatgacaacagggaaaaggaaaatctttttaataaatggtattggataaacaggcaatctacatggaaaaaaaaaaccttgacccattgctcacattatgcatgcacacataattacctgaaatagattacaggcttaaatgtgaaagataaaactatctagaagaaaatgtaggagaatatttttgtgatctgtgagcctcagatttcttaaaccaaatatgaaaaaccattaagcagtaaataaactgtacttcatcaaaattaaaaacttttgctcatctaaagacactgttagccactgtgcccagccctcttttttattttctaacacttgtaattccaacactttgggaggccaaggcaggtggaccacctgaggtcaggagttcgagaccagcctgaccaatatggtgaaaccccgtctctactaaaaatacaaaaattagctgggcatggtggtgtgcacctgtagtcccagctgcttgggaggctgaggcacaagaatcacttgaatccgggaggtggaggttccggtgagccaagattgagctactgcactccagcctgggcgagagaacgagactccacctcagcccccctgagtagctgggattacaggcatgtgccaccacagaggctaattttttatatttttggtagagatagttgcaccatgttggccaggctggtctcagactcttgacctcaagtgatccacccgcctcagcctcccaaagtgctgagatcacaggcgtgagccacgcgcctggccaaaaactgtgtgtgtgttttttttgtttgttttttaataaacgtacacatacacacacaaatcttatccagcaattttactcctagttatttatcccaaagaaagataaacatatatccaaaaagtaatacttgtacaagaatgttcattgcaactttattcattatagcaaaacatcagaaataattcaatgtccatcaacaaggaaatgaatgaacaaattatggtatattaataaaacagaatggcctagtaatatgtacaacaacatggatgaattgaaaaacattatatggaatcaaagaaagacacgaaagattatattacgtgaagacatgaaagattatattgtgtgattccatttacataaagttcaagggaggcaaacgttccctatggggttagatatcagaatagtggttgcttctgtgggtgagtgcagttgacaggacaggggcacagggaattttctggagtgatggcagttatttcctatcttgaacatttgtcaaaaggcatcaaattatgacacaagatccattcattttgttgtatgtcattgtgcttagtttaaaaaaaaacctaaatccgggccgggcttggtggctcatgcctgtaatcctagcactttgggaggccaaggcagtcagattgcctgagctcaggagttcaagaccaacctgggcaacatgatgaaatctcgtctctactgaaatacaaaaaattagcccggcatggtggtggtgcctgtaatcccagctactcaggaggctgaggcaggagaatcacttgaacctgggaggcgagggttgcagtgagctgagatcgcaccactgcacttcaacctgggtgacagagcaaggttttgtctcaaaacaaaacaacaaaaccttaaatccttcagatcgggatacccagcacaattaactaacagttttcactgagctttcatatttaaccccctgacatgaataccaattataataacaatatccattgcttattgatcacctcttgtattgatccttcagttgatccaccggagccctgacttcatggttcgtctattcatttttttattcaacaaatagttattaagtgcctactgtgtaccaggccctatccttgatgcttggagtccatcataaacaagagaaaaaatattttctgtactcaagaaacttagatcttagtgtgtatatggagatggagtcggctgggattctatgggcttctgtcatgcttaaggaaagtgttagcatctagttaactgtccttggttttaacctcctttcttccctcttatacaccctgtagcccaccatgcaagtgatttgcaactccatgaatgtatatactgggttccttcatgcatttgggactttgaatatgcttttgttgttgttgttgcctataatattttcttatatcattactttctcttatccatctttcaaatcctgattttttttcctcttacacatgtaaagccaaaatgcaattcatgttttttttctaatcatccataggaggtagagagttggagcctttctgccttatgttgttgcattttggggttttcaaccttttgatgttacacaatctgcgattcacttttggagccaccaaatcattccctttggttggttttaaccagtcctggagcaggcttgactcacacctgtgaattttctgtgctaccttagaatctgactcatcttccagggagctggtacacaaggaggccactgcagtgcaggtgacagctgcccttgatacactccatttccagatacagaagatgccttttaatattttgtgggcctttcttcaaattcctgttgaaacatagcaatttcccataaaaggcagctttgggaattgctgctgagttgagcttagaatgcacaaatactgcctgtagttgctctatcctcttggcactcaggggatctagtgcttcagaaataactccgtgtgcttctgtctctaagaaagagaaagccagtggagcaggtaaataccagtcgtgttacccttaaagctgcccccccagcactacacgctggtacagcaggtcagcagaggggaaagactgctgaggagggagctgttattctgggactcggaggcgatttcttttcatctccgaggtcagccagtggcgtcactgaaagcagcagcatgtaatgagggtgtctgggaaaacacgacaagcccttagaggggcacttgcttttttccaggcctttgtaggtggctggtgtggattatacagacgccaaacaccaggcctgcctgtatactgcagacacagaactcagaatggagcagactttctctcacaaatcgggacttccatgccttttctctctcccttgttcttcagtgattttggtctgccttagagtttgatgagtccaaggcttcccagagatgctcaaaaacaaaaccctagatgcctcaacctcagcctcagaagaccctacagcctcaaattcctaggtgtaaggggtcttcctgccaattagcagtctaggctagtacaaccaatgccacgtgtatgccagctctgtggccagcagttcattaggtaccagggatgctacaaggatgtgtaggaaactatgtgtcttctcaagtagctcataatagagaattaagccaaccctggaacaaatggctataagtgctacataggcggagagaagggtgaacttgggccagtcaagaaattctctagccgggcacggtggctcacacctgtaatcccagcactttgggaggccgaggtgggtggatcacgaggtcaggagatggagaccatcctggctaacatgatgaaaccccgtctctactaaaaatacaaaaaaaaaattaggtgcctgtagtcccagctactctgaaggctgaggcaggagaatggcgtgaacccaggaggcggagcttgcagtgaacccagatcacaccactgcactccagcctgggccacagagtgagactccatctcaaaaaaaaaaaaaaaaagaaattctctaagtgagaatttctcacttagagaaattctttgtaaagctagaggtattggagttgagccttgagtaataaattggattgctctaggctgaactacttattctacctgaaaaaaaatgctttgagaataattctggttaccattttagggttatagtagctttgtttattttattatttatttatttatttcaagacagaatctcacactgtcacccaggctggagtacagtggcacgatctgggctcactgcaacctctgcctcccaggttcaagcaattctcctgtctcagcctcccgaatagctggcattacagacacgtgcagccactcctggctaacttttgtgtttttagtagagatgaagtttcaccatgttggccaggctggtcttgaacccctgacctcaggtgatccaccggcttcagcttcccaatgtgctgggattacaggcatgagccactgcgcctggccttacaatagctttaaaatgaaaatatatgtgtgtttatgcatacacctatatacacatacaggctagcttttaaaaatttgtttaagttaacaaataaaaattgtagatatttttagtgcacatgacgttttgatatatttgtacactgtggaaaagctaaactgaactaattagtgtatcctagacaaactttaaaagggatatatattgagaaagagagagataaataaagatttttgaagttttgactttaaatgtaaataggacaaaacacataaatattaaagtaaaacaagccttttattccccagagaagatccaattaaagatgataccgatgttccagaagacattagggagacccttccttgtgtcttcctgaaggaaatgtcccattctcgctctgatgggtctgtttttctttttgttttcaccactctgtttacatttggtttcaggtgcattttgcacagaaatacaaccagatctctccctccagcccagatctgtctcacggcctccagacttgcctacagcaccacacgtggctgacccacagacacccaatatcaccttgtccaaagtcaaactcatcatcttcctcccacggatatgtttattcgcccgtaccccaacacagaaagctttcttcttatccccggagtgtcccccaagccctagtattcagctgtcacctgctcctgatgttcctgccccttcaaacatttgtcctctttgctaaggacaccctttccattgattctatatctgggtagctcaaagtgggtctgcccttttccacttcattcctgcagacctgtatactaattcgtaagagtgttaacagcttgctttggcattgtttgcttgcctattcatcttcgcttagactagaatccccaagaggggaaggtctgttcctttcatctgtgttttttcagcttcaccacaagggtttgggcctagtgcacaaatggacccctctatgatctgttggtatcgacgacttcagctgccatttattaagagctactctgtaccaataactatgatgacaattttacattcattatctcatttagtcatctgagtaggtatttgtttaatagcacttctaaagtaggtattcttctccctgcttcagagatggaagttctggttcagagaaccagagtttctctctggttagtgaccagcttaagatctcccagctggtgtgtgatggaagaaggatgtaagtggaggtccgcctgcccccgaaggctgtgttcaccaccactacatcatgtggaacaactggcagcgggaaggaggtattctagaggagaaatttagggagttcctcctcctacccttagaaaggtgtctgcttcctttcctctcactggatgcaattgattctacctgaacccagctaattagaactcagggtataggcatttattgcatctcccagaccttgtaatttttaacttttttttagagacatggtctcactctgttaccaggctggagtgcaggcacaatcatatcccactacagcctcaaattcctgggcttaaggggtcttcctgcctcaacctcccaagtagctggggacacaagtgcacaccaccttgcctggctaatttttatttcttttgcagacacaagttctcgatatgctgcccaggctggtctcaatctcctaacctcaaacagtcctcccatcttgacctcccagagtgctggaattacaggcatgaggcaccgcacccggccccttctattttttggtctacagtagtttcatcttccaatttgtctcattaagggaggggatgcaccccatatgttatgtcttgtgtgaaataaagtagattccagttataggattcctagtacagatatgataaaggagatcttacaaaagctatgattgctctcttgagtctgtggttctgactgtggtgtatcattgtgctatcaggtctagtgaggcatagtgatgcgtggggtgcaattattacatgatgtgatttgtaattatagaatgctatagctccctcctatctaaattattgtattttagctccctctccttgccatctctttcccatcactactaccacatttagcctagcagggcccagtgagtttcaagatctcaagaaaacatgcaggttgttagtgtcagtttgcttctgtgtgtgtttgtgtgtgtgtgtgtgtgttgtgtgtgtgtatgagatatcagtagtcttcaaaaaagttcatccagccagaggatggaagtatttatgcaaacattgttcttggcttctccgcacacatcccagtgaagattgtgtaaaagaaatcatggagaaaaattgcaattgtgaggacaccagtaaatgacaattgatagaacgattatgtggattgctaaaattgaagaacattgtgacacattctaccggcagggagaaacatattacaactctctttgcttagaaagacaatagcagcccattggtaaagccatgaattctggccacggctagcactgagagctcatggtgtgttttcagtctctcctttaccattatatctctggtattcaatagcagaggctcaataaggatttggagaatgaatggaaagactcttttccccattaacttccccaaatgaggagcatcttttagtatgggctttttatacgtgtagttccttgggctacctagattagaatcaccttgggaaagatgtaaaggccttagccctgcctcaagtctatggaatcagcatttctgattctgaatctgcatgttttataagcctccctagtgattctcatgcccattaaagatgtaaagctactgctttagggcatagacttactctgtgtaaccctgaaatggttttatttaggtcatcctgttatcaagattcttgcttcttagcttttgtgcttctttcttcctttggaatatactgctcagtagcaatgcttaggagaaactacagaggaaaaggaaagaaggaaattggaatcttgttgcatcttgaataacttctggcaaatgagagaataacaaggcaaataaaacgctgtttatagatgtagttcagtgcctgttacctagatttttctcaatagatattgttattaaatgatttttttgttaaaaatttgtcccatcaacagagataatagaacttagggtattatgtaatccatatttattcacacacttatttgtcaaagaaaatttcctgagcactcactatgtgcaagtcatatctgagggttgcaaggcagataagacatctggttttcaagagacttagagtctaacggggcactaagagatgctcgtaactgcaggagagcatgtgaggtgccataaagatgttttggcaactccaggtgtttagagaagagagatgttatagggaggcagaagaatcaagggcgtttgtatggaggatttctcgtttgaacaaggtctcacgagaataagcaagatttggatttctgaatatgtgtgaggaggccattccatgcagtgggaaaaagtcaggttcagaggcaagagtgcccaaggcccatctggagaagagttcaatgtgattggaacatagctgtgtggtatgcagaattcttagaatggtctccagtgacacttggccttttctaagcctctcccctgggagtatgtgacatgatgagctgtcactccttggttttattaggccacatggcagaaaggacttctcagttgactttgagttactcaacaaggagattattggggcgagcctcacccaatcacatgacccctttaaaagtagaaagttttgtgcagctattaggttggggcaaaagtaatcgtgggttttgccatttaaaaaaaacagcgaaaactgcaattagtttcacacaagcctaatagttgcagaaagaaatttggagtgtgagaatgcttagtctgacttctacatttgaggatcgagggggctccatgataaggaatgcaggggcctctaggcactgtcagtccctagctgacctcagacatataaccccaaggaggtgagcttgcccaacaatctgagtgagcttggaagtggattcttccaagatcctccagatatgagcccagcctgggtagtgccatgattttggccttgtgacaccctgagcaaaaacccagctgagcccgctgggacttctgacctgcagaactgtgagatcataaacaggtgttgtttcaaatgggtaagtttgaggtaatttgctacacaacaacagactagtacaaatcttttgaaggaaactttatgggggtaaaggactatgctagaatttaaatgataggttatggcacttaattcagtaatcttcagggcactattgaagagcttgagatgagagaacaacataaaaaataatcatcactcacatttgtttaacatttattaggttttaagcatacatttaatcctcatatcaggactgtaatacagatacaactattaccctcttttgcaaatggagggaatgaggctcagagaaattcaataacttgctcagagtcacagagctagtaaatttcaaagccaggatttggaacccaattgtctgcactcttagacatgagctacactgcttctttaaaaggaaaatggtgattgtcaagaatctgggaaattttttaagggcctatttacgtggcttgggttagagggaagagaggtatggggaggaatagtggccgcggaatctgagagaaatttcagaaacagaactgaaagccatggcattggctgcactgattctctggcagatgcatgacagaggggaattagatagattaaaaaaatttttttttaggtgtaagtctctaattaggtattttcagattaggtatttctggaagagctttgccatgcctgtaaatgacattgttcatctctcatccttccctgtcatcctccttcctttcttctcttcttttctttcttctcccaaatccatatttaaagtcaagttcctttttataaaatgggtttggtaatatcaaccttagcagagtctgtgtggaatttaatttgtttccttatataatgatcgttaagtttctcaaatgatgtgagccatagagagggaaaattgagccattataaaacatttaaaattatcatctgtgcatcaggatttagcaaaggtgaatataaataaaataaaataatcatctgacttccctagagtcacgcatagtgactattttaaatactcacacagtacaatatgttaggtcacagtgaggaaaatatagtagatctctagcaaattaacacattcaactgaaataagtgatgccatctcccaaagcatgtgtgtgtgcaactgtgtgtgcgtgtgtgtgtgtgtgtgtgtgtgtcttgcactggttcttttgttgttgctgttgttgttgttgttgttgcagttgtaacatcaacccaactccaaaaagaacagcagttgaacaggcgctctcctgcagagcaacattctgctgaaagtttttcagatttcagaacttaaaacaaaaaaaaatgcagttcatagaaaagacatctctatgggaacatacgttgatagggatactaatgataaagatgattgatgatgatggtgatgacggtgatgttcttgatggatgggatgatcatgagggcagcagctaccattagttgagttcccactgtgtgtcagacaccatgcagagtgttttcaatggataatcttgtttcagtctcccaacattctctgcattttctcatatctaaaagggaggccataatagtactgacctcctaggttgttaggataattaaacaaggtgatatatcaggtgcttagaacactgacacatagatgccagttctaagtataattatttctatcctcatgttataggagagaaattggaagcaacatgggttgaatgacttgtccaaggccatacagtggtaaaggcaggacttgagcccaagcagtattttaatagagccagagtcaaacattcggtcatatggaacattcttctccatcccagtcgcaaacccaaattgttaaggatctctctgagggtgatgggagcatgattaagctgacaggtggtataaatgtaagacaaaagctgcacccttgctagttttccattgccatcaattatgaaaatgagcaaatagattatttaaatgatctcagatgagtaaattattcaaagagcctctcagtcagaagtatttctagaaactcctgaatagaccaatgaaaaccattttggttttctgacagggtcatctgctcatctgtgttgtagagaaacgcaaagccctgaggaagcggggaaagcaggagagagagagttgggggagagggaggcagggagagggctagggagggatagcaggacagggaggggggatggggggagagggaaagagtaagggggagagtgagagcgggagggggagaaaagaggagagagggagaagagagggagaggcagagaggtgggagagggagtggaagagatagagagggcctgaagagggggaagagagaggggaagaaggggagagagaggggggagagggagagaggaagacggaactggggagaggaagggggagagagaagggggaagagggagacgagagagagagaacaaagtaacagtggactttaaggcaaattttcttttctaattatattcccttgaatgctgattcctttcagaacttagagtgccaccagggtctctgggtgggtagggggcttatgaggtaagacccaccttcaactggagatggcaaagcttcatctgattggtatgttatgttgaggttcaaagtgagcttccatttggggaaaaataaaatatttctaaaataagtttgaaagcaagtagaggaaggagattgactgtagtagttgtctgaatatgacgtaaataaatagtaagcatttgttgagcacctattctataccaaaccttacagtatggccttctgtacttattatttcactttagccgcataataaccctgtgaagtgagtctctgatttcatatttgagtcatgcaaacttagagatgttctatgatttttaaaaaattaatagctgagaaaggattcaaatttaggtcttgtgagtctccaagtttagtgcttgttccagtactttgcacagttcctaggatgaatgatggaaattttcatataggttgtggagattcacagggatggtatctgccttggaagttgagtggaagttgggggtatgacaatacctaggcttttgtgtggacttaactcgtattctttaggacaaagtaactatacactatgactgtctctgatgggattgaaccattttcccatccatttatccacccatgcacccagctagtcatccaaagattaatcatctaataaaccatccatccattcatcagcccatcagaccaaccgtaattcatccagccatatgggcatccattcactcttgaacccacccacttacccactattgatctgtttaccaagcattcactgattactgactcagtgccaggcctgtagtaggtacaggcgaagcagagatgactaataaaatatccccgggattttagggaatgttggggtgatcagacccaacaccaggctgtgggggctacaaaatccggcagagtcaaaggaatgggaaaagacaggttaagagtatataaggtgggtccaggaggccaacgctagtgtatggaggctgcaaaggccctgagctccggaagcccacactatttattggtgatcaaacaaagaagcaggtggtgaggacgtgcggatgtgggggtaaacaggtgaggacatgaggacgtaggggtagaaaggtagcagtgcatcaagcatagctgtgatggtttagcattttctttgacacatatgtaatatgctctgctacctgagataatggagaacatatttacaagcctgggagagtaagaagcaaggagccagcaagtctgtgcacattccagaggccattccagtgcaattccacaagggattttatgccctgagccttggattgtatccaagccacgaggggttttatgccctgggcttagattgtggtgtggcagggcagccttccaccctttggcacagagcttggtgttccaaaggccatgagggggtttagagcctgggcccaggacacgttccaagactcttttacattatgacagagaagctagtcctgcctcagctcttctaccaacagggaacttataatgtagtgggagggacagggaaatgcactgctagttacagcattgtgaaatgagcataaacaggagaggtgcacatggcacactgggacacctactccagcctgggcactggggaggtgaaaaaacttcctgaaagacctaagttaggaccaagtcctaaaggataaagaagagctatccaaagggtgacagtcatcttatccattctagtaactgaaccacaaacattatttttctttatttcacattgcatctgatagcagcagctagatttctcccctaccccacccacaattactggagctcagtggctgctgtctgggcctgcttctcactttctttccattgtctctgttctattatttccccatttgcctgctgatggaacagacaggaataacatctgtccctaagaaaatggacagaacagagagctgctccccccagcaatctgcttctggctacaagtggctctgtcagcctgcctctgtagctacagtttggtttcctcatctgtgccattggcagcagaagcttcccattccactaccctgtttttcttggcattggaacctggtttggaacagggggagaaatagagataaaaagaggttgcatattctcagcattggtctctaagctgtggaggatttaatgtgctttctagactctgaagaacttgtaccttgagataattacccatatgttgtaaaaaaaatatgatgatgattatggcctaggggctatagattcaccactttgattcccccacacacccttttttaagagacgagaggctgcagtgaggagccacctgtagtcccagctacttgtggggactgaggcaagataattgcttgagcccataggtcaaggccacagcgagccatgttcatgccgctgcactccctggagtggctcactgcaggcctctacctcctgggcttgagcaattatccagcctctgcccctcaagtagctgggactacaggtgtgtgccaccacacctgcctaatttttttgtatgttttgtagagacagggttttgctagattgcccaggctggtctcaaattcctgagcccaggcaatctgcctgccttggcctcctgaagtgctgggattacaggcatgagctaccgtgcccagccttgatcctcttttaacagacattcaagatgagtatgatcactcctgccccctccctccagttacatatgaagaaactgaggctctaagatgattgctgatttgcctaaggttacaaagcaagtatatggcaaagtctagattctagctcaggtctgctagactgcaaagtccattttgtttctacagtaccttatggtagagatgggtggcgttcatatatcagtagtgaaggctgtcagtgctttaattataaaaactcatgttgggggtccccccatccctgcacagtggatgtgcccccagcgttggcaagaaggactattacaggtacaagattccctgctgaaccacatgtctgtttctgagctcggctcagagcatcccactgagatgtatgcaaatctgcctcctaatcagtctcttgcatttttgtgcaaaacgaatcagcattcctctgcacatctgaagctgtaaatcagtccccacccctgcagtaaactgttcctttattccttattactccaccgtatggtttgttatctagccattgtcttttgaaaacgtgctttaaaactcatcgaaatcatattcctggagtctatattccttccatttaaattataattctgcaaattagaaagactgagtgggcctgtttgagatgggaagagtagaggctgagccatcttgacttccctggatgtgaagaaagactccgttggaaatgcccatgagaaaaaaatctaaagttggggaaaaacaagagaatcaactcgtattcccttaaagggagttgtagaatgactcatagaaaccaatggcctctcacttacgttgtctttaactttaacattgaaacaaacaatttgaatcggaagaatcctaattcctgttgattcctaccgtgctggcctctatgtggtccagcagattatagctgatggcatatgttttctttccacaattaaagtgtgtttgaagaaactaggacaggcagatctaacataggaaagcagggcaacaattagttttgggtatcagatcctgacatccatgctgtatacagggaaagcagaaacatttacctgcttttaataggtgaagagactaagatttagagacgagacttgttcagccttcttctgcaagaatagtaaacatttcactccacttttttgttttgttttctctaagaccaggaaagattccacagatgtttcttttctgtttgtttgtttgttgttgttgttgttgttgttttttagagatggggggtgtctcactttgtttctcaggctggtctcaaactcctgagctcaagggattctcctgcctcagcctcccaaagtgctgggattacaggcatgagccactgcacccagtctcattccacttttggcattcaggttggtgacttgaatcaatacagcaagatttgggtttctttttttgtttgtttaaatgtatggggtatacaagtgtaattttgttacatgcatagattgtatagtggtgatgtcagggctttttgagtatccctctcacaaataacatacattgtatccattaagtagcttctcttcagcctcttccctcagcctcctccctcacacccacttgcctttctgagtctccattgtctatcattacacattctgcatctaactgtatgcattatttagctcccacttacaagtgagaacatgcagtatttgtccttatttctttttctttcattctttcttttttctaacacctgacacagggtcttgctttgttgcccaggctggagaatagtggtgcaatcatggctcattgcagcctcgaactcttgggctcaagtgatcttcccacctcagccccacaagtagctggaactataggcaagtgccaccatgcctggctagtttttttgtttttattttgttttgtttttgtagagatagggtttcgccatgttactcaggctagtctcaaactcctgagctcaggtgattcccccacccctccacttggcctctctaagtgctgggattaaaagcgtgagccaccacatctgtcctagtatttgtctctctgtgtctgagttgcttcacttatgatcatggcctccagttccatccatgttgctgcaaaagacgtgattggattcttttttatggctaaatagtatttcattgtgtatatataccacattttctttacccgaagatttgagtttcattaccaaaatgacatggaggctttgcattgaggcattgtcatctcactgaaaatggatgaggattcaaaaaatacagatgggacatctgtcaagttatactataaatcagtggggacaaaagctagaaacacagatgtgtctgatcagaagcccaaaatacaaaatcaatgccaagagatgaagtgactagtctacgtagacaaagagagaacagcatcatggtcaggagaagtgggctggcgacttcctcccctgtttcactgagcatggcaccggttaggagctgagctgtttggggttagagagcgagtttgatcaacatttacgctgttgagtttggccaggggtaacatttgtgagactcccgctaattctggaaatctgtcattctttgtttccaacagcaaaatggagctaatgataatacccaccccttggggttcctgtgaggatattaaagctactatttattaaatgctttttgtgagtcagaactttagatgcatgatctctcttaactcatacaaaatcctgatgatattggcactattattgcccctattttataaatgagaagtctaaggaacagagaacaagttaatttccgctaacctgaaccgtattctgaaccccatttgtctgactccgaagcccatgctttgactactaacttctgctactttcttcaatcaaattctacaaagcaagtgcaattgtgccatgctgtgggagatagagaatttaagtgggaagcgaatggagcttagttttccttgcatcattccaaaaaaaaagtgcctaatagtttttaaactgtgattccatcacaggtcctgagccaaccactttatgtacattaccacattttatgttcactacaaccccaaatggtacatattattttatagatgagaaaaatgaggaccagagaagtgaattgattggaacatggtcacccagccacttcatagctcagaggcatcataaatgatatacatgccaagtatctagcatgaggcctggaacgtagttagaaagatcttaataaacaggaactattatgcatatacaaagtgcaatctagactctagacttctagacttttaaatggcacttttagggttgttttacctttttttttttttttcattttcagtggatttctaaaagtctattgacagtgttctcttttatcaaaggacctgggtccaaagttttagagacaagtgtcttcaaggagtcctttaagtcctgcatatgtatgaatatattgcaatacatacagttaagcaagtcctcatccaggagccagaaaactgtttctggttctttcacatatttgctgtaatttgtgaatgaggcttggtggttgacaggtgaggaagtggtggattgactcagagctgggtggaaggtggtgccaggtgggtgtgacaggaggacaagatgggagcaggaaaattgtgggcgtggcaggaaatctgttgctgtgataaagagatctgggctgtaatagggaaaaaatggaaagtcacgaatgagcagattgattgggagaaaatagaggggtccagagcccagaggccaaaatgacattggaaaagagacatgagaatagtccttaaatttgaaagttacttgagccaggcgtggtggctcatgcctataatcctagcacttagggaggccgaggagggtgaattgcctgagctcaggagttcgagaccaacctgggcaacacagtgaaaccctgtctctactaaaatacaaaaaattagccaggcatggcagtgtgtgcctgtagtttcagctactcaggaggctgaggcaggagaattgcttgaacctgggaagcggaggttgcggtgagccaagatcatgccactgcactccaccttgggcaacagagcgagactccatctctacaaaaaaagaaaaaaaaaaaaaaaagaaaaaaagttacttgaaggaacatcagtttaccgctctgaaaaattgtaataatatctctttcacatctatgtgactctgctgtgatggtcaagtgaaatgagaaaataaccagcaacttctagcccataaagagctatattaactctaggacttttgtattattatccacataatgacacgcagctttctggctaggatgtgtcttccagtgtgtctattatctgaaatttctatctttttttttctatttcttttcattttttccccaatacagcttcttagccaagtgaacactagcaagtgtatgcataaggtcacactgtttgacacaaggatccaagaaagcttgggttacatttatagttatgaaattaatggcatgcattaatcgtgcagaacctcaaactagcaaatggaattaaaaataattgccaggcctttggatttattggtagagtgaaaataacaccaagtggcttttggcaggaccgccttctccgtgcacagaattatattaacagatgatattttttctatccaaaatagagagccgtaagtgaaaagcagatctgtctcctcttagagcagggaaaaaaaatccaaatacatttccttagtttcattttggcatacaagccctaggcctggaattttggtaaaaacaatgccttgttcctgcctgttctggagttgtgccagtgtcctccattcagcttacaagaacatgcacattgcaggtgggaaggaaccttgactaaataccttctgtgggccagacatctgactgctggttcacaaacatgagttaatgtcatccttctaagatccctgtatataataaaacacctaatcctggttgagcagggactatgtggcagatagttcaataagtgccttgcagttactactttatttatttccatgagaataatatgatgtgattactcctattatgcccacattacatataaggaaactgatgtccaagaagtaaagttagtcaagttcatatagctggtaagcagaagagctgggaattcaggtccagatgtggctgactccaaaatccacatcattttcagggcctattaccagaagagataattatagttgataattgactgcaggaagatcatagttatggtggtcatgttggtacctctgtgtgctaacttgtctgttttatttatttagagacagagtcttgctctgttgcccaggctggagtgcattggtgtgatttaggctcattgcaacctcttcctctcgggttaaagtgattctcatgcctcagcctcccgagtagctgagattacaggcatgtaccaccacactcagctaatttttgtatttttagtagagacagagttttgccatgttgcccgggctggtctcaaactcctggcctcaagtgatcctcctgccttgccttcaaagtgctgagattgcagatgtgagccaccgctcctggctaacttgttcatttcataggtatttgtgcatctattatgtaagcagccctgggctgggtacgagggccataaaggcaaacagaacacagtcccaccctcaatgagtccactggggcagacagatgagtgtgcaggtctcacactagctagtgaggtagggaaaggagaggctacctgcccagttttatgggattagaggctgcttcccagaacagctgccctctgtgttgagttctgaaggacacataggagagtgccaggcagagagtgggaaggggttttctgggcagggtgagtagcgtgttgaaacctggcactgagagaaaagctcaatgtactcagaagcctgtgattagttctgtgtgattcatgagttgatgtggggcagggctggaaccaggagttggttgtcaaaatgaggctgtcatgaatgcagagggaagggaaggcctggggaggaggccaggtcacttagaccatggtcaggcattttcacttgattccagctgcagtggggaaccattaaaaggccacaagctggggagtggaagggccagatacacagaggtatttaaagtgacgatttgggctaggcacggtggctcatgcctgtaatcccaccactttgggaggttgaggcaggcagatcacctgaggtcaggagtttgaggccagtgtggctaacatggcaaaaccccatctctactaaaaatacaaaaattacccaggtgtggtagtgcgcacttgtaatcccagctacttgggaggctgaggcataagaatcgctcgaacccgggaggcggaggttgcagtgaactgagatagtgccactgcatccagcgtgggagacagaataagaccctgtctcaaaaaaataaaaaataaagtgatggtttgggctgctgtttggagaatgggatgaagagcaaatctaccagaagcaagaaggccagctaagaagctgagtcataaaccagtgagaggtgaaggcctggatgagggtggtggctgtgagttaggaaagcagtaaaaaatgttcaaatattagaactatcaaggcttggtgattgatttaatatatatgggggtggcagaagagagatgaattaatggatatttccatggttgggatttcaagaactcctatatggcagatgggagagaaactattttttacggtggaagataagaggctgagttcttctctaagcctactgagtttgaggtttctcggaggcagtagagaagaatgggggaaaggcagcagatcaggggctgtcaagagaggtgataactggagactgtggagcagaagaggccgaggcctgagcctggatgttctgggggcaagagggagaggaaagacaagtcagatgtgttcagagaaggagaagcttgcattttggcagagatgaatcagccaacgaggtgggaaacagttgggtaatggtagtgtcctgacagtctagggcagagaactcaagaaagatgtgagtagtcccattgtcaaatgcagaggaggggcttatgtgcagtgcacctgttggatttagtgaaaaccactggaggtcttaggtcagtttgagaggcaaggacagtgcagaagagaatgtgtctagagcccaagggctgggatgcgtgttaggctagaggagagatgcctcctttattactgaaagaggggagaagaaagacatgtgtgcagaggcaggtgagtttgtgggtgatgtgggttgtccatagagtctgaaataagaggcagattcatcagctgggagtggggctggagctggcagctttgcagtcttgtgggcaggtgtgaaggtttgaaatagtttctagggaatgggagagatgcaattaggaaaaaggaaagatttttagccagagagggagtcctaaaatttgaaatgacattaatctatgtggttatatgatattctccacctgtacttgctgctttacaggtgtggaagtggtgggattgactcagagttggggagggtgctgccaggtgggtgtgataggaagacaaagtgggggcaggaaaattgtgggtatgacaagaaatctgttaatgttatggataaagaggtctaagttggaatcgggaagaaatgaaggcatgaacaaatagactaattgagagaagatagagaccagggatgacgctggagaggagacataagaatacctgaatgagagctgtggattttctgaattcagagtcatttgagtcaagcagttctaagtgaatttcccccatgggaatgggtggctacagtggactggaggttctaaatttagagtcactcaagtcaagcagttctaagtgaatttcacccataggaatgggtggctacagtggactggaggtggtcagtggagagatggtcaaaaaaactggccttcagttttatccaaatgctctgacaagtatggatgtgtttatgaaatgacatcaattacttgcaaataggacaatttcaaaatatgtaaggagtactaagtcctagccatatgtggatgaaatcaccaatattatccccaggtgttgagtcagagggatttcccaaggccaattgccaatttcaacttaaatgcaaccaaattccaatgtgcacaaagggattgtagcccaatatccaagggcttcttcagtcttgtcccatggtatccctttattcctctttccctctcttctcctttatatatttgtgtttcttcctgtttggacaacttcctagttcacaaacatgtcattaaaactcagcttctaagcttttgtgcatgctgttctctgatcctacacatcccttctttccactctgacttttcaggtcctttgcaaactgcacaactcccctccattgcactccttcatgatttcttccttccctcatcagatctgcctctcacttctgaagccctctgcatttcttgcacctttcaccctttggctgttagcattttctgttttattgtatgattaattcagagggcattgtattttatcttcctcactggtgagtggatcctttacagataaggacttagagcaggggttgacaaaacccctaactgtttatgtaaagggctggctagtaaatattttaggctttgtgggccatactctctctatggcaagcactcaactctgcatttttagtgcaaaggcaagcgttgaggctatgtaaggaaataagcatggctgtgttccaatcaagctttatttagggacactcacattcaaatcttatataattttataattgtgtcaccaaatattcttttcatttttttcaaccatttaaaaatggaaaaggaaaacccattcttagcttgtgggctgtgcagaaacagcttgcccttgggctgtggtatgctgaccccaggtttagggtctattcactgctgtgttaccagtgtgagaacagtttatggcacatagtaggcactccatgaatgaatgagcaagatgaatgcatgtgatctaaccctaaggaactgaaaacctacagaatagttctgtttattggttgtaacacttggagtaattaggaatcctgagattctgcttttggctataatttgtgtgagtttgaaaggttttgatgtgacatagctcataagtatcatagttgaacttggacttgggtcttccaactccaaatgcacggttcttttaaactgctgtgtttgccactatattaataattcagtgggaaaagcaatgctgagaggcttcctgattggtcaccatgattctcatttctcccagtggctccatagggctctcaaattgttgattactgtctgagatggggataattggtttgggtgaaattggattgacggtggtgggttacttaggcttagttttcaaaaacagcaagtcttatccatcccatcccaagggaaccctcctcttcccccagtgccttagaataatcacgtttttaactgggcaaagctgtcgttaagcttattactgttttctcactattaaatcttctgttggctttagtatttcaaatgatcctcttgttggaatactttagagctcagacaagcctggagcaaagtagttttgggccagagatgagcaaagaaaaatgattgtcaaaataccatcttatctaaggaaaattgaaattctcatcagtgtgcatttcatcataacgatgcatttcacccatgcacaacggctttggttagcatcctcataataactagcagggcctcaggcaccaacccctttcatttggaagaaggaaaatgtccatctcaaaaacttaaatttattattttgccccagatacagaagaacaaatgcccatcagagacctgctaccaagttccagacatttcacctctcacaacgcaataacttttcacaggcgagggggatgaaatgctgttccactgattgatacctccaggttctgtaaccttattgcaaaactctgcagacacagtcaatgaggttaactttgaatgttcagggctgagatccaaatggaattggctttttacataatgctgagtgaggaaatccatcagcttttgacttgttagatccttcaagtcaggtttgatgcattgaagtctcgtgcttccttagcctgcagtttaattacctggaacttatctccttttataaactgttacacactcagccccacattttaccacttttcaaggttttcatttaaaaaaaaacttgccatagagtaagagaagtcatatctatagtcatgttcagtcataattttcaggctggtaagaatgaattgattatcacaataaataaaaggctttttcagctgtcagcccaggatcacagtctacctctcttagccactttctaactcttattggcaagtttgctgagggaaaaaaaacttcttaatatcattcaggtaaatactccccaaaagagctgtttactctgccagactgcaaatggcatttcatttattttacaattggatgttatgctgatctttgaaatttacccagaaaaagtacattagaaggtcaaacaaaaacctttaccatatttctaaattgtctttatgcaggtattaaaaaataataatagttatcactgttactgtaacaaaggactgtccttaggtcaagttctcatccaatgttatgtgtttaaccttccccagccccaattcctgtttctgtgattgtcctagttaccttcacatctcctcctaaactttttttgcagacctatatgcattctagttttctcctccaagaagcagccccttaagttcaaccaagtttatgtttgggtttttataataacagatgcagatatagaaacagaattgtgttgtgttggccaacaatatctcaaatataacatgatacagaatgaagatgaaatcctcctttctaaggccccttacataatggatggagatgaccacagaggcaagggagaagtccaatcagctgctagagcattaatgacattcctcttggttgaaacccccaaattacctaattgacacatggttcacatttgaacagttgattttctctgcctgatctgctgttctgatcgccttttggatgtccgtgttggtagcagtggaattcaacatcaagcctgcaaagtagagctcagtgcagctctgctgttagaggtattttctgtggtggaattcaaggtcctcagaagagtcaattcacaggcaaatggaagaagtaaaactgtcatgagtaaaagcacactgtaagaccacctctggctgctttctccccacctcctgtgctccacatggaaagaaaatgttgccccttcccaaagtggaagactgtgcatattggggcgagaacctggcttctccaactctcaggacatcactgtgctgcatggtgctaattattaatactgtcttcccaactgatccatgaaatattcccttaagaaaccaaactgctcatgtttgccttaatatttcccaaagcaaataggatggcagccttggaaatatcaggcagtggtaacagctcctgccctgaagtccaagctcagattccaggtcttctcacttgctgtttgatcttgggcaagtcacttaaattccctgtttgccaacatacaaaacgagtctaataatggcgtttttatcagaggattgtgagggtaaaatagaaaatgcccgttggggtgatcacagtacctcaataaatgccaacaattatactcgttaattgtttaataattattattgcagcccatggaagacggactgatacggaacttgcacaatgaaggactcccaagagcaagttcaaaaaattaatccatgattatgaaagagctccttttttatttttgctgatttttcaagtctctggcattatattactccaaggtagaaccaaaagagagaaaacactattaactttttagctaattacaagaacccatcacttttaagagcacacaaagaattaaaagtaatccaaagaaataggactcctatctttccccagggatctggcaacaaaggaactctggaggactgaagattatacatgaactcctgaagaaaatgatggctctttgttccaaagatttttccgcttttaaatttgagattgaacaagcattgagctcttcccctgttggctgagcctcaagaggagaatggaagcagagatgcgggttgttcatggaaataacaatcaaaacacgtttctatgaattaccagatcagtactgggttctaagacagttgatgctgttatccataaagatactagattatcttgagagcagttattacgagaggaaaaaaaatctacttctccaatgtgagctgtgtaacaattaggcaattctgaaatttcaactgagaggaatttaattaaggctctaatagctgattaaactcatttagatctgctggcaattgccagtggttacataagtaacccaagaagaaagatttccatcttgttcttatgctttatttaatcctgtatgttagtcataggtcttcccctcctggtgctccttaaaatggggtccttagaccacacggagcagaatgactctaggacgctggttgaaaagtcaggatcccacaccttatcccagatctactgattccaacactccagagatacaggagtctgcattcttaatcagcttccaggaaaggttcttattcatgccaaagcttcataatcccaccacctccaatcgttgcatttaaaacagtgcattcagaggaagcaggcactttacctcaatatctgaaaagcagttcttagtttcactctgccggtagccatccaaggctcatggcagtgaagacagagcaggtttgacccacacctgctctttagtaatttctgcatagaaacttgtttgtgcataccacacaggggaaaattgagttccaaagtgacgcttgatttcagcagactggttttctgggatactctttagatcaggtattggtttaaaaaacatcactgaactcaactgcaaagtcctccagatacagcatatgtcaacctaatatcaagccacagcagtggctcagatatctttattgttgtttctggatcaattacatttagatctgcttttggtttcaagcagcaacccaagacccagaattacttatgtgttaacctgtgatcggtttgtttgtgtgtcagatgtgcattcagcggcatggaagtgatgctaatccatgttgctacttatgataaatatggacactaaatcattttaaatttccttcacggccatttatctcatgtcctttggcagactttatatttcaggtggagagaaattggtctcccgtttgctttgtttttcctccttaacatcatcttcctgaagagttaattactcatgttttctccagcttgggagtaaatcactgcttattttctggagtgaaacatactccgaaggtttgcaagctcaatgtgtttgttttaaagcctgtttccccatggttatgaaaccacccaatgagctaactgggtccagccagactagagcacaggcagcctgaactctgcttctgttgttggttttaataaatttcctgtctgatttttagttttgcaatttctattgtcttgtctccaaggagagaagatgagtaaacaggcaacttccctttttaaactctgaattgtaagtaaaaatggatgatatgctacagtcagaattgaattcagttcagcggatacttcttgaactgcattgtgggtgagcactatactatatcgaacatggatcacgtggttgaggaagactggccagccatgacactctacaaaaccataattcgaggcaaactgggccctcattccccacccctacagcccatctcttttctgttgattttacactttgagttcacaccagcctgaccatcatggcctgtgtcatccagatcctgcagccatctcccagcttgtcactctgccttccgaatcttctagctacaaactctatctctgcactacattgagaagaagtgtttaatccacttctaattgggggattgatttcagtaaggtcttcagtaagtcctcatccccatcccttacatatgtcacttgcccataggataaagataaaaccccataacaggcaacctactaactcccttggtctttctttttttttttttttttttttttttgagagactcttgctctgtcacccaggctggagtgcagtggtgcaatctcagctcactgcaacctccgcctcctgggttcaagtgattctcatgcctcaacttcccgagtagctgggattacagacccatgcctggctaatttttgtatttttagtacagatggggtttcaccatgttggccaggctgatctggaactcctgatctcgagggatctgcccacctcagcttcccgaagtgctgggattacaggcgcgagccaccatgcctgtttcatatttggaagccacttcctgttagaagcattttttggattctcttccagattaggaagctgtgttcttcaacagcatcctgtgcctgctcccggcatagcatttgtctcacttcattcacttcattgctattaagctttgacttctctccaccgagactggaaactctagggataggatagacctctctgaggactgttcaccaccgtagccccagggcttccagtattacccggcacagtggaaagcactgaaggcatgtgggctcatgaataaacaagtgaggggaaagtgtgttctaaaggcaaagaaaatgcaaaaatgaattccagatggagaattaggttccatgggagtattggcatttgagctaggcctgaaaagagtgggtaggatttcagtagggggagataataaggagaagaattccaggcagaagaaatagtgtaggcataggcaggaaagtgggtgtcgttcagggtgtgttttgtgaaaagtgtatgcatcattgtagcttcatatcctctctgtgtgtgtgtgtgtgtgtgtgtgtgtgtgtgtgtagaggttcgagtatatgtgtttgtgttaggtatgtgtgtatttgtagttgtacgtgtgggtgtgagcatatgtgattataatgtgagcgtgggtaggcatgaatgtacctgtatataagtgtgcttttatgtagaggttcatgtatagatgtataggaatatgtatacatatatgtgtaggtgtactgatggtattgcttgagttcttataatagtaaaaactgacattcactggacacttatgtatcagacacttatgtatgcacggtttttagtgctattttaattgtaataaacttcctatacacaagaggaagtttgggaaatactttttatctctattatgaatttttccatgtttaattgtgaatatgtgtaggtataagtgtgtgtgcaaaggcagatgtgtgtgtgtgttagtgtgacgatgtgtgtgagaatgagagagagaaagtgagaaaaagagaatagtgaggttgattgggcctgtattatagaagagcttttactatacagagcagtctggatttgattttgtaggcagcatgagacatggagggacttgagcatggagtagatctataattttggtgtttagatatttgttttttaggaggtggcttcagagaccaggagacctgtgatgaggttattttaattgtctcttgtaagcatttcataaatagatcaaataagataaaacactcagatctctttgaaagagccacgcacatctattaacctaatttcttccagccttttgcagccttggcaacatccctctgaatttatccggacataagaggtgtatattaacttgagacatacaatttctggagatgaaattatctctgctctaagaacatattggctgaacattttgataagtaatcactgccctttaaaaaaaatctttctaggagctgaagagcaattagtttcctaaaagcactgtatttaaattttattaataggaattaaacatcattacaaagttaatctaccctttttatatttcttttagcaaaatcacttttctccatcagcggtcaattattattattattatttttgtcgtcacaacttcagtatatttctgaaaacactcaaaggcttatcaccaaaattcagtttattttaaaggtaaagattttttttctcctcccacacaacctattttgttgaattgagaactgcttttaagtaccaaaaaaattcataatagagataaaaaagtatttccctaacttcctcttccgtatagggagtttattagaattaaaatagcactaagaatggtgcctgatacataataagtgcctagtgaatgtcaatttttactgttattataagaactcaagcaatgccatccccactttattgctttcttctctcaatttcttagccagtatttattttctgataagttgttctctcatgactgccctgttctgatagttccatcaaaagtcccagggaaaactctcattggcttagcttaggtcacatgcacattcctgagccagtcagtgtactgatttgccaaataaaggacacgtgcctattcgttaaattagggcagcatctctccaagggaaaatgaatatgctataaccaaaaatctgataaatgaatgacaggtaagcaaaacagcataaggctattgtgaaacccttgggagaaatgtggagaaaagcgtgatttatggctaaaactactgacatggtaaaaactgtgtctaaattaaactaaagttagtatcgagaaaagctcttatgaagttaaaacatgaaataatctaaattctactctaaaattgtttccccattgatttaaacaatgacaaaatagcaatacatagcacatagcattgggcattcctttatgggctttaatacattaatttagtcctctcagcaatcctgtgaattatactattaacatcatcctacttttcaggtgatgaaactgaggcaaatagatattaagaaatttgcccaagtggcacagctcacaagtggtacagctgggatttgaagccagagtggctggctccaaagtttaaactcctggcaactttgctactctgtgtctgagaacatatttgctgtttttaaaaaactctcccttttgaattcaaaaacagtttttgaataaactttttaggttaactagttttatatttacaaaaaacttgcaaagatagtccagtgacttctcacatacctaatgcccagtttctctgattattaacacctgacattagtatggtatatttgtcataatgagtcaattcgtatattattgtcaactaaaacccatgattttttcagatttccttagtttttatctaatctttttctgttccatcctgatagctgatccaggatcctatatgacatgtaattgtaatattgccttaggctcctcttgactaggacactttcttagaccttcttgttttttaatgacctttgacaatttggaggactactggtcagatatcttctagaatacccctacattggaatttttctgatagttttcttataattacaccgaggttataagacgacacaggtagaacaccacgccattatcatcacatcatattaaggatatgtactattagaatgatttatcattgtccatattggctttgaccattgagctgacatcacatctgtcacatttctgcattgtaaagttagtcttttttttttgttcagcagaaaattctagttgcattttttcacagacttaaaaatgagtcctgggttcacatcctggttctgccatatgaattggacaattacttaaaccccatgcctcagtttcctcatctatgaaatggagataataaaagtagcatgttattcatgtatctatttttaggattacagaaattattaaagctttcggaatagtagaaacggaaagacttatttttatcatctcatgtaatctttttttttttttttttttgagatggagtctcactctgtcacccaggctggagtgcagtggcgcgatctcggctcactgcaagctcggcctcccgggttcatgccattctcctgcctcagcctcccgagtagctgggactacaggagcctaccaccatgcccggcaaattttttgtattttttttttagtagagacggggtttcaccatgttagccaggatggtctcgatctcctgacctcgtgatctacccgcctcagcctcccaaagtgctgggattacaggcgtgaatcttatgtaatctttataacaactctgtggccttgttgtaacctttaaaatatgaagaaactaaatttcaaaaagggaggtagtgattaagctgtgctctagaggttttcactgactaagtttaaattcttactgtgagccttatgatctgacctgagcaagaaacataatatttttaagccctggtttcctcatcatgcaatgaggataattatagttatctatgtcctacagttgccttgaggattgagtcatataatgaatgaaaaacccttagcactgctcctggaaacacatagtaaagccctaatcagtgttaacaatggtctttgtcattattgcccactgtgccccagctaggaatggacaagtcaggatttgaactcatgcccttctttagagaatgaggaagagccagctttgagaaaagcctcagatttgagtaccactgttttttgtgcagcatggagaattactatccaagagggctctattgaccatgttcttctttcctcagtcttctaactggttctcagaaccatcctgccaccttttttagagatagcttgccatttggctgttttctgctgtcctttcaccctgggtgcaagactgccctaatatatggttgccatacagaattaaatgtcaagtaaggagtgccacctttgcccctcttctaattatgtactcattaccctgagctcaaatcaggaaagatttgggagggcagcttatccttgcattttacatagagtgctatacctgaaagaccttagagattatctgattcaaacccactcccctcattcctgttacagtgaggagaatgacacccaatcagtgaggtcaaaagtcaagggaatgccattgaagaaactcagatctccatttgtcaattagttcttctgctacagaggctcattttcctgaagataagtttaacaaatgttgaattaatgataatagttccacgtatggagacctttctgtgtgccaggaactgtgcattaagagatgtttgttgttattatcttataagtaagcctcataacagcatatgaaatggaagtgttgtttttatttggtgattgagtgaactgaggttcaaaaagattatgtggcttgttcaaggtcacatggctaaagcagtgacaagatttgaacctgttcatctgtctgatctctaagcctgtgctattaatgattctgaaccctcttgtcctgtgccatgtaaaggagagaagagaggggttctgtagcaatgaagttgatgcctgaaaactcaatgggatccatatgtgcatatacatgtacatgtatacagcacacacacacacacacacacacacacacacacaagcgtgcttgcctgtcctggttgtgtataaatataaccagaagtttggcaaggtgtcctggaacttcattttccctccaagctccaaaaatagcatgtgattgacaaggactgtatgatttcacttgctctgatgcattgaaaccttattcctggaagcactgctggaggaaatggattgaaaccttactcctggaagcactgctggaggaaatgtggtgcaaccctggtattggctcacacttcagaatagcttttatgagtcaggaatgctgatctaaagttacagactcagctgagtgtggtgttcacttttatggagaggattgggaacaggaaaaaggtccagtttagagaatagcagaagagtcaccatcacgtccaaggtgggagcagagatatttttggctgccatcttcaaagtgcacagggtccttccattttggatataacttctaaataaaggcatttggagcatacatactccatgccactgtggaaatggagacaagcagaaacaatatgacagtcgaaactgaggtcttcaggattcaacccattggttctttctttctccctgaatactctggtggctggagtccctttttaaaatggtgttaggatgatgctgtttgctttctctggggaaatttaatacccaaaggctattcagacggccaccctcaatggctctgagtctcgggggctgaagttgcagtaagagcaagggagagaatacaggtccttgatacttccatattttgcctagggtacaagattccaaagctgaggcacatatggacacattaatcattctaacactttctgactcatgcacatgtaaaaaatacaggctgtatgtttattcactccaccaaaaactacccattaagtccctccatgtggcatgccctgagttagaagctgtggacatagaaaccaatcattacgcatataaaattcctggtagactgggaaatcatagtctcataagtaaaacatatacataaacacatagattattgtagattattgaggtataatattgtgaagcaaatgatgtttagatatttaaatcaaattaaggatttatgaataaattatataatgggtttttttgctgtaatatagaaggagtgagtgggagtataaatgaaacaagattggtcatgagtactaattattgaagctggacattgggaatacggaggttcattatatgattctactcttaaatacatttgaacatttccataattaaaaaaaaattggagtaggcaaagaagcttccatcttcaggcaggttatatatggacatatatccatggtgacttctataaatctttttccattctggccattgaacttgattgactcttagtccatttgggttgctgtaacagaataccatagactgggtggcttataaaccacagaaacttgtttctcatgcttctggagactgggaagtccaaatcaaggtgccagcagatttagcgtctggtgagagctgcttcctggttcatagacagcaatcttcttgttgcatactgatatggtggaaaaggcaatgggtctctctggggcctctttcataaaagcactaaccccattcatgagggctccaccttcatgacctaatcagctcccaaagacccctcctcctaacaccaccacattaggggttaggatttcaacctatgaattttggagggacgcaaatattcagtctgtagcaaacccttaaggtaaatcccaacttcttaatagagcctacaaggctttgcattttctggtctccacctatctggagtgctctttccttctctgctcctccacaattccttcccacaactgccacgatgcaactcatcctgaatttccaatttcagcttaagtgtcacctcctcagggaagatgtctctgatatcttttctcctatatgctctcttagacccatgtttcatttcttcctcccaatttgtatgaacatatgtttttgtgtaatcatttgactcatgtgtcttctcaattagcacaaaaatttcatgcaagcaaacattttatcacttccattacagtattctcagtgtctagcacagtgcttggaacctagtaaccactcaacacatatttatggaatgaatgactctgctaaacctgtctacaaacactggcctcagttatagtcccttgtaaataggaatataggcagggaaagtgaagaatgtctgttctcctttatctggtatatacgatttagtagttgagatttttggtgtttgcagtggggtgccgaagggtctatcagatgagaaaagaaggtaagagctcttgggacctagggcagtgttgacacagcagcttcagctcctgatcgagttctctctacctaccactcatcttcaacctccttggctgacccatggatacttggatgtgtcaggaacagggagtagaacttggagaagatttaggaagttattgcactctgggggctcataaacctttgcaacttttctctccatgagcgagcgttggactgaaacttttgcctgactcccatggtgtgggggttgtgatgtggtcaatgacatcaccaaagattctgctagtctttgccttaatttacattatcttgggactttaggaaacatgtctgcaaggaaggaagagtgttggagctataacgtggttactgtagctcaattcacagaaacactgtacatagcgagaaagcacctttgggttcagaaagccccacgttataactctggttccaccacttattgctgtgtgagtttgtgcaagtcacataacctctctgtgtttcagtttcctgaactacgaagttggaataataatgcttaccatgtagagtttgtaggaattaaactaagtggtgatattggcacatttcctgactgtacaggagtgctcaaaagttatgtcattgaggttataatataaaatgctacggtggagatatgcgcaaagttctatattactagggaaagcaggaatgattttacaggtaaggtgacagttcagttatgttttaaatgttaacaacaatagtaaaataatagcagccaccatatgtgttacatgccatgtcaggttttgtgctctatatttttggtactttttggctcattcaaaccttactgcagtcttcaaggtcataccctgttgctctcttcattttacaaatggagaaagtgaagctcagagaggttgaatgactttcccaaggctactcagctagtggatgaagccaggatttacacttagttctgtttgacttcaaaagccattctcttacccactgaactacccaccctctctcgaaggttgtgtttgagtcttccaaggcaaatggaaagaaaagggattggtataacatgttccaaaaggaaacacttgtatatttctttatctatttgcatatttcagtatttttggtttgatctatgtcgtacaactgactgacagttccaagaaggcaagagtcattctgttttagccatcattattcctaggctggcactgggacatcgtaggtcttcaataaatctatgtcgaatgaatgaagaatttgatgcgctcagcattctccccagcctgttacatatcatagcgtgaataaatgaacatgtgtgtgtgtgtttaaccaaattgctctactcgccatcctatcttaaaaagaaatgtatcagcaatgctggacaattttgtaattagccacaggaaatgtttctttatagccagcaaaaattttccagcccatatgatgaggtaatcttagagagcactgattcttttctctcctcccaccctgtcacctctcctggtgtccggcatgtttgaattctctttaagggtttgagattcatttctggtgacacttaaacattacaggaggagaggtgagtgggtctggtcaacacagacaagcctggatttggcacttagcttttcacacgaggtgttttcctcgaggttggtattacaaataaagcggtgacctgtggtgtcaagcaatggcgtgtgggagcaggaggagaagggagaaagagcggtgcgggggcagcttcctcccagcgtgtatgtgaatagcgccaataagctgtcaaataaaattaaggttcaaaatatacagccttcaatttgattgcactaagatgccgactgctgctccgagggaatacaatcgattctattttgacaggtcttgatgtacgctaagcagtgacagtctcccctctgtgcaggattaataaaagttcaccttaatttgcaacttaaatagaactgtatctggggtcaaaatgatgcttttaatttccccacctgctccatctcttctctgtgttgtctcaacccccactcctcttcttttcactctctagcttcatcttcctctccctttttctcttttccttcatcttagcacctttttcttctttctccttttcactttctctcctttatacttagaaacaatatggagtacctatgttgtgcttttgcctttcatgcattgctttattgaattcccatggcatccttaggaagtagggggaattgtgttcattatacagatgagaaaacagaagatcttaggattaagagcttgcctagtacagctagtaagtggtacagtgggagaatcaaacccagacctctctgattctaaaagtctatgctgtttccttgccatccgtggtcctgaactctggcagaacattagaaccacctgcggggctgtaaaggtatcagtgcctgggcactgcctccagagatgcaggttgattcctctggggatgagggcggctgggatggagaactgccctatattctgttttctctttatgcccgtttgtcttagcacagaagtagatgcatatgttgagatatgtggcagaaaggcccttgagacggatggatgtctctggcagggaaaggatttgcctctccagaaatcagcggcggaagaaagcacagctgtgtctttgtgtttgtgctgcaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaagtgagtggcaggaatgctgtcacctgaacgtgcccaaccctttgaaatagcatggatcatcgatagtaacaatatgtgtacttgaatcacaaaatgtcatagaaaatacacgtcgttatagtaggtataatacaataatcaatttaaaaaagacttagataaattcctagagatgtgccacacttgcattcatttaattccaccagcaatatgaggtgagtagttttgcccattgtaaatatgataaaaccgagttatgggaagattatgaaacatgttcaaagccatctagctaggaaatggaagaggtaggactcaaacagtggtccaactgactccacagacatgtttttaacccttaggttgaatcaatcctccccttcagtctttctagtttaatttaatttattcatttatttatttttgaacatacatattcaaaaaatatctttatatttttaatatagaaaacatttttgtatattaaaataaatataaaacatatcttaatatattaaaatataaaacattatatataaatatatagaaattatatattttatatatttaaatatataaaacagtatattttatatatttaaatatataaaacagtgtattttatatatttaaatatataaaacagtatattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaatatataaaacagtgtattttatatatttaaaatattataaaacatatattttatgtattaaatatataaaacaccatatgtttttatatattaaaaatataaaagatcatatatttttatacattaaaatatgtaaaacatcatattttatacattaaaaatataaaacatcgtatttttatatattaaaaatacatatggttggacacagtgattcacatctataatctcagcactttgggaggccaagctgggcagattacttgaggtcaggagttgaagaccagcctaggcaacatggctaaaccctgtctttcttaaaagtacaaaaattagccagctatggtggtgggcgcctgtgatcccagctactcaggaggctgaagcatgagaatcacttgaatctgggaggtggaggttgcaataagtcgagatcgagccactacactccagcctaggcaacagagtgagactctgactcaaaaataaataaataaatgaaaatagaaatatataaacattatacatttttatatattgagatatataaaacatatatttttacatattttatatataaactatttttatatataaactatatgtttatagataaaatatatagttaatgtacaagtttatatataaaatatatatttatatgttaaaatatataaaacattttcatatattaaaatatagaaaccaatatatttttatatattaaaaatatataaaccatatattttcatgttaaaaatatataaaatatatatttttatatatatataaaacatataaaaataaggcctgttttggtttggagaaaattttatcaatgaggtcacaaatgtcagcctctttgaagttgaaatcctgaatacatcatggaataaataaatatgcccctactgttatgttagaaatgtataaaacgtatgtttttatatgttaaaaatgtataaaacattatatatttttatgtgttaaaaatatataaaacattacatatttttgttaaaaaatataaaacatatatttttatgtgttaaaaatatataaaacatatatttttatgtgttaaaaatatataaaacattatatatttttatgtgttaaaaatatataaaacattaattttttttatataatgacagggtcttgctctgtcccccaggctggagtgcagtggtgtgatcacggctcactgcattcttgaactcctaggctcaagtgttcttctcacctcaacctcctgaatagctgagactacaggcctgtgccaccatgtctggctcatgttttaattaatttttttttttagagacaagagtcttgctatgttactcagcctggtctcaagctcctggccttaagtgatcctcatgccttggcctcctgagtcactgggattatagatgtgagccactgtgtccggcttcctttagtctttttaaaaataattatttagtttccacttttctggctgtccctttccttccccccacacattcttcttccatctcttttatagatcccagatctatgcttctcaagaaggttaaaaacgtctctccatttgggagtgaacacacaccttgcatgttactttctgatacaatccaggtgcaaatggaacttctggcagtttctcagctcagcaacagccagcaggcactgcatctgtgtcatttctccttttgttatgattgaagaaagagctggcattgtccattatgaggtccccttaatctacaaaccctctggggacacagaaacctccatggccacctccaaggccctgatcctggtatttcctaatgcaaacataagcaaaaacaccacctcacaggagactcacagaagaaaaaggcctgctgttggaaactttatttgttttctgagtcttttctgatctgtttcttttacctaattcttactcatcctttaagtgtagctcctgcgtccccaagctgggttagctcttcctacttccacagtacctgggtgtatctctctctaccctcatcacctgtctttacagtgtatagtttgtcttctccctggcttctgagccacctacatatagggaatgtgacttattaatatttgcaccctcagttacaagggcacagcatgacacaccaatgtttgtttcatgactaggaagagagatttttacttcctcgtttcaaactccagtctcagctattatcacacaagatgcaagtgcccagatctcagtccttgagatcaggattttaaagatataatatgtgattgctaaatgtattgtgaaggcctgttttggtttggagaaaattttatcagtgaggtcacaaatgtcagcctctttgaagttgaaatcctgaatacatcatggaataaataaatatgcccctcctaaaaaggcccttgctttctccagtgtccccactgtggctccctgggatgaagtttttttttgataagcagtcccccagcctccactctcctggagatgaggaagaggtggggcccaccaaggaagggcaagtgtacatcccatgattcatgattcataattcatcatgattcataattgtgtgaaacagaccatgttttggggtcaggaatgttttaatgatttttgctgaattcctttacagtgaaataacacagacattgttataagtaaaattgttataaataaattgttttaatacagaatgaatgaatgtgcattaagcacagtttgcatgttaggcacattgctgggcacaggggatacatggatgaacagggagggcaaaagactaggacctttccatcatggaacttacgtggttagaaaacaattcgaccaggaagaaatgggtgaccccatgttgtaataaaccttgtgatgaacagaaagagagtggtgtgagaagagagtacatcggggtatgtggggttactttagctcacacagataagatttaaggtgatatatacaggatgagaagaagccagacatgtgaatatctgggcaaagccttccaggtagaggcaatggcaggtgcaaaggccctggggaggaaaggagcttgggagtttgggaaacggaatgaaacccagtgcagtgctagagagtgatgagttacaaggaggatggaggggatgatgtgggaaagttgtcagaggatgttctaatttgggtgggtgttctttgagcagaacttggcccgatgaagaaagcaaagtggctggcacaaagcagagtctaacttcagtgggacacctcccctatgataacaataccctctgtgtttcaatagggcaatcaactgaggccccgtgtgctccagaatcaataataggagtttagagtctttaaaatcaaaagccctggagctgaaaacaagtagatccccaagtactgagtcacatttgtatgaggaagagaaatcaaaataaattgctgtctttaaaagaattgacttttctactgaagactatcaacagcttaacaggttcaaattcacgtttttggtttctgtgaggagatagtagcttgcagctttccttcttccgcttggggatatgaggagtttactgtgtctggatgaaatgaaagtctgactcgtgagagcaatagagaattgctaggatccactaatcccaacattaaagaagattagatcaattgcatttcctatagggaacgtctttgaggaaggctgatcagttgcaaaaagaattcctgttagacaacatgattgtgtgaaacctttttgtttctcacttctggcaaatggtgggatcttctaagaataccaggtaaccggaaatgagctgagaaatcttcctttctggtctgttagttgggtgataaagacatgcagagaaaattggaaaaatcatttggcctgatgtgtagcgagaaatggccatgctgtcaattaagctcccaaactgtcaaatcattggtgggaagaaaggaaatttatttttaagtgctggatgagatttgtctgagtctgcgtggtggacaggagccaacccaggacctggacacagctctgactcgcatggctgtgctcacatccaccggctatactgggaaattgtagagctggtaaactggacaatttgttggatccctttccccgtatttgtttttgtgagtcattccctctcttgggtggtggtggagcactaagagagatcacatggggaccatttctcagtctgtgtagttaagtcacatcccctgcacacccacacaagggctgtaataggaaccaacagacgttcccaattacaagctggtctgcaattccataattactgtgataaattcaactattgcctttgctgcgtgcctttttcatcctgtgtccccaaggcccagttccatgtcttgtgcacagtaggcacttagtgggtgcttgttgggtgaaaatgcgtcattgatcatttgtatttagaaatatacctcatgttcagggatatgggtgagataactcataaactggctgaggtttccagggagaccaaagaatgccactatatgcctgtgaccttgaatcttaaacctggggcacctaaaacttctctctaatcttccggaaatcttgaccaggtgaaggaagagcctgtgataggggaagaagggaaggaacatagaatgaaggtgatacaaatgaacagaggtagggaaagggcatcagtgcatggccaacagcgaccagaaagaaaaagagaattcgattttgacacatttttcagagccatgtatactaagaaggaaatggtatctggacattccatcaactttaatgtacttaggacacatttctatcatatttgtggcagttttaactctagcccaaccccctccattctgggtaattggtggagatggagctggcacatatcccatgactgtacagtgttgaggtcactaatcatcacatgtaaatatacacagatgtggcctcctactacccccccactaagggtggtggatcacagcaggtcatccagcctctaggcaagagagtaaagtctctatggtggtctgggttgacagaagcagagtggttgagtacaagtcactgacaggatgtgggggtgggatacaatggtgaagagagtgattcaagacaggcagtctgtgatcctgagataaaggaaagcattgataagcaggtgtcatttacaacccacttctgttactcaaaattatgttttccagcttgagtatggtgtcgcacacctgtaatcccagcactttgaaaggccaaagtgggagtatcacttgaggccaggaggtccaggctgccatgagccatgatcacatcactgcaacccagcctgggcaacagagcaagagcgtgtctcttaaaaaattgttctgtcaaatctgcccaccttcatggatatagagatgatgtatatcatgtaaatcaatgttgtttgatgcgtgtgtgtgtgtctgtgttgccaattacataagtagtatgtacttactagataatttggggaaaaaccctaaaaatgtaaaaaagaaaacatgtttttcaccgttccaaaatagcttgcttctttctttctttcctttcttcctttcctcgtttcctcctttatttctttctctttctttctctcttctctctccctccctctctttctctctctctctttctttctttctatctctccctctcccccctttttctctttctgtttctctctttctttctttctttctttcttcctctctctctctctctctctttctttctttctctctttctctcgacagagtcacattctgtcacctaggctggagtgcagtggtgcgatcttggctcactgcaacctctacctcccagattgaagctattcttatgcctcctgtgtagctgggattacaggtgcatgccaccatgcccagctcatttttgtatttttagtaaaaatggggtttctccatgttggccaggctggtctcaaactcccaacctcaggggatccacccaacttggcttcccaaagtgctgagattacaggaatgagccactgcacctgtcctatgcttcatatttcattgtttttccatacagttatttcataagctcatctgtttttatatagctgtgattattctgtttgtactactgtgtaacctacttttttcatatgacatggaagcataagaattttcctgtgatgatgttggatttccatagacatcactttagtgcttaggtaacactccaatgtgtggatttgccaaaaatgggatattcaaacagagaacatattcatgaaatgcataactcaaagacagggttgagctaatgggatgtccattaatcaagcatattgcccagaagaaaggctttgatcttatgtgaattgtctaagtactttttgctatccgttggatagaccagtgtttcctttctttcttttcttttttcttttttttttggagacagagtttcactcttgtcacccaggcttgagtacaacggcatgatattggctcactgcagcccccgcctcctgggttcaagtgattcttatgcctcagcctcctgagtatctggaactacaggtgcctgccaccatgcctggctaatttttgtatttttagtagagacagggtttcgccatgctggccaagctggtcttgaactcctgacctcaggtgttcacccgccacagcctccgaaagtgctgggattataggtgtgagccaccatacccggcctcctttctttttaaaggtatttttctggtttgcctgggtgtcctttgaatatgtcttgttcaggtgaatacagcaaggtggctggtacaaaacagtaagtgtagccttggtagagtatacaatagcctttaagatagtttaaattttaatggggtctttacctgatcaaggaccttgcttttagaagtgtctccttttatactacatgtcacataggtaggtagggaagatgttattaatgagccctcatgtaacatttggctctatcaagagaagttcagtgcacaaaatcaggcatggaatagaacccaggtctcctgattcttggctgaggtgttgtctgggtaccttcacttctcccctttggtttcaagcctctgtaattatagaatgaagcaaaaccttgctttctctgagaatttcacatcctcctctcttccattctctagtaagtttttatgactcagtttagatctgatgactaaactctagtctaaagttgtgtatgttataaactcttaaaaatttaagagttggtaatttttacctgtttaatgggtgtacaaatatcaactaattcagaaaatgtcatgaagattaattcaacaattagtatgaagcctttaggatagtgcttagcaaatagtaattactcaataagtgttagttcttgtcatgataactgctataattaaggacactttctgcttttgctgtcatgtactcacagtgtgtccttgggaaagccacttccccttttcaacttcagtttactcatctgaaaaataggagaagagtacagctaatgattgtgaacaaaccttccagtgctaacattctgtggtcttggggtttttctttacagcaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtaagttatcttttcatcccctaggctcttactcagacaaagggcctgcagtcctcaggaatgttagcaggaaaagtaaagtactgttgttctctctctctcttttttttttttttttttttgccttgcatccaggtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctaggtgtgtgaatttcatagtgactattgctttcctataaggaattgtaggaaatcttgtttgctcagaggatgggaccagaaaggaacttgtttagctctgtttggccatggcagcatatttcagaggatgctgcatttgaattatcctatgaaagggttaggctttgggtccccacccaaatttcatcttgaattgtaatccccagctgttgagggagagacctgatgggaggtgacgggatcatggggatggtttctccccttctgttcttgtgataatgagtgagttctcatgagatctgacggtttaataaggggctctcattatattattattattataaggggtttaataaggggctcttcccccttcgcttcacttctctcacatgccgccatgtaagacgtgtctgcttcctcttctgccatgattgtaagtttcctggggactccccagccatgtggaactgtgagtcaattaaatctctttcctttataaatttacccaatctcagacagtttatttttttgagatggagtctagctctgctgcccaggcttgagtgcagtgttatgatcttggcttactgcggcctctgcctcctgggttcaagcaattctcccacctcagcctccccagtagctgggattataggtgcccaccaccatgcctggctaatttttgtgtagagatggggtttcgccatgttggccagactgatatcaaactcctgacctcaagtgatcctcgggcagttctttatagcagcgtgagagtagactaatacatcctaattcactcccctccatccccagttcacatctttcatttgtcttaaacttggaaaaagctgctgaaaaaaatatgatcacatattcagatactggtcttgactctgtagaatgtaaattaatagatatattgcttagaatattgaaaacatttaaaaataaagctgtccacagttaatttaaaccagctcatagacctttattcagcatctacatatccatcctccatcccacaaagaacagcagtcatttatttgctagatgtaagagtgaaaataatgatgactgcacgatgatttatgccaatattctgctaataggaatagtctgaaaagtatatgctgatttaaaattaatcgaatcatattttaaatgtgactacccattaagccaaatagtttgtaaagaaggaaattcttgtgatttttttaaccgttttgtaaatttatgtttttacataaaaggtgttttttttttttaaatcaaggaagagctatgttttctatcatctgcttttctctagcacttggactgtattgggtagcctggctagagttgaaatttcatggaacatagtaaagcattatttttgtctttaaaggaaagtgttgtattaactgtttggttatcataaatgagttttgactgtaactatcttgttgaatatcatgaaattcagatcactaattcccccttggcactcccatataagtgggtttgtcccaaattagggaaggttaagacaaacgtgaatctctggaggaaaactgagaggggaaaaatatgtataatttttaaaaaatttcaatagctcaggggtacaagtgatttttggttatatggacgaattatatagtggtgaagtctgggcctttagtgtacctgtcacctaaatagtgtacattgtaggtaattttccatcactcatctccctcccatcctctccctttctgagtctccagtgtccattataccacttgtgtgctttttcatacccataggttagctttcatttagaagtgagaatatgtagtattagattttccattcttgaaaaacccatcccccagttcacatctttcatttatctcaaacttagaaaaagctgctaaaaaaataagatcacatattcagatactggtcttgacactgtggaatgtaaattaatagctatattgcttagagtcttgaaaacattttaaaaataaacctgtcggtccacagttaatttaaatcagcccataaacctttattcagcatctacatacccatcctccatctcacaaagaacaacagtcatttatttgctagatgactatcatatatttagaatgatggcctccagtttcatccaagttgctgcaaaagacattgcatcattcttttttatggctgagtagtattccacaatgtatatataccacattttctttatgcaatcatcagttgatgggctcataggttgattccatatctttgcaattgtgagttgtgctctgataaacatatgtgtgcaagtgtctttttgatataataacttcttttcctttgggtagatacccagtagtgaaattgctggatcaaatggtagatctacttttagttgtttgagaaatctcccccctgggaaaacagttatattaaagtcaactaactttcttatatttttccagagacaaaaataactttatctcttaaagcaaattgtaaactgaaaccaatttgtggacaccaactccaagcccattgtcttattcttccactgtcttcatttatatgtaatgttggcatccagtgaaactttcatgtttcgttctcttcagtgaaatattgactaacaggattttggacactgccttacattcagagcgctatggatttactgttttcatttttgataatccatttaagctgttaaaatgcttgccactctctggatttgattttgcactcgttgcttcaatttttgtaacctttgttggagtaatgtggaccctgacaaatacacacctcattatgttccttttgtccctccgtctgacatggattcagatactcgtattttaataagagagcctcactatgccaggaacaatgcaaccagctgatattgacaacacatgcagaatcttaataattcttaagtggacattcactctttagtcactcctagtcatgtttcccctcattccctttcagactctttggcaggaatcctttgtcctggaggttaagaaagggttagaggaagtgagttcatggatcaaaatggaaagaaattgtttcttttcacacaaaaaagtcttgtatctctttagtgagctagagagaactctttttccaattcaatcagagagaaaaaaatatcaattggcttgtcttatgaaaatgggtcgtgaatattgaatctggcctcaacccagtttctctagatttttatcttgcttgcatttgtaaaacatttccataaaaatgtcaagtattttgctaaatttagcaaaacctctctttccccacacttttcctgctgcatttttaaaagtaaaataaattgtaaccagaggaaactattttcaaagctgtttttacccagtaggcttaatatttttcctagtcactaaattacatccctatttgattgactgtgcacccccttatttacggtcattatctacagattttgaaagtcataatgaaccagctaagctacatttttccattcactggcttagtcatctggaagagccaaaacattcaaaatctgattttattgctgttcattatttcctattttctctcctccacaaactccattaactcacatcagaagcacttgcaggtaatgcctctaagcttttgtgtaaaaatgtaaccagtggctcttcaaggacagagatggcatctcctgtaatatttctatctagttaattctgaagagtttccaaacaagttggattctttgatccaaagaaatgctgacctggtatctcctcgattgcagttccttcatggacaaatgttgaatctgttttaagccattagaagatgtaatagagagttatctaaactatttctgggtcactccttagacactatagatgttgctttaacgatgtttctttgttctggagcatgtgtgtgcattcacgtgtgtggtatcttagaatagcaacccttcagggcactgataggtacttaatttactaaaacaagactactgcagcagagtcctttgatccgtgctgtgctcacaagttaaggaacagatgtggtcaattccaagtggggagacatgtgggaacagttgcttcatcagtttccacttgattttctgactagcgtgttagtgacaaggatgcacctaccaaaaaaagttcactgcaggtttacagattcttacatgcacataggataattcagttatggtcccttctaatgtttaaaaataatgttttcacagcctgcagagaaatagacgttaccagattaataaatgtgctttttcaaaaaccagcacgcccttttcagaaccatggacagcgtattgttgccccagtatttctggctttaatcctggaatcacacagctattccactcagtatattgtctgtatattgtgtgcctcacacacgaacaaacactttcatgtatatgcttatttgctcatcataatgatcctcctccaataagacacactacgcaactcggagaattattttatctctattcttgaatatgaagtacttataaatctcctaatcatttatttatctaatttcctttttggatacaactcagtattaaattgctattatttcagggacataatattgtttattactcaagctaaagttaaaataaatttcagttgcagtttcattgatttcttggagcgcatcttgtgttacttaagtaagttgtgttacctgttgctttttaatatatttgcactatcaaatgcattagaaagcattcctcccagcttttaaattatccaatatagctaaagttaagttcggacatattagtttcttgttatacattaaactcattaaattggaatttgtggtgacctctagctgtgttaagtagtcatactctaataagaaggtggcctgctatcaacctagctctttattattataagtagcttcactaggaaaacaattttaaaataataatatgtttactattcaagaagtattattggacttattttaaccctcagaaaatatttgcttatgaggaaaagggttttaagttcattggtgtctataggcaatttcttccccatgatacattcaggtggagatgtattcatttttaaaatttattttctgttgattttatagcaaatctataccataaataaaatggctgcagtcagctaattttcatatcctcaatcaagttgaatagtaatcttattttacataatatttcttacctttctagagtgttacaaggcttagagccttatgacttggcctgcccttctaagacatccacctactgcctaagttacatgcaaatgagctgatgaaaactacttttagtggaaataaccatctatccatctactattttattgcctctaccctttaagtgatgcttttttattgaattatcatgtgaagataatatcctcaattgactttcaattgcatttaaggctgctaccaacatcaacaagattaataaagctgtaggaatctcatctatctgaggcaaaaggtgaaatggagagtgtggtagattataactttccaatatttctgtcacccatgattttataattcttttccaacaggttataattctccctttatttttggaattccctgcatatcatctttctagcatgaaaaaataaaaataaaaaccataacaatttgcaggagcctatggtttactatttgggtctagtcttttttcttcctagctttagccccctggatggttctataattacaaaggaaactatggcctgtttatttgcattctaacttgctccctctttcttatcactcttttttcttctgattatccttgacctaatttgtaaaatgtcctatgctcttctctatttttattatattatatgcaatcttatacttcaaatattttgtagaataaagaatgatttaaaatgatgaataaaaaatgtctggctggccaggagcagtggctcacgcctgtaatcccagcactttgggaggccgaggtgggcagatcacctgaggtcaggagtttgagaccagcctgggcaacatggcgaaaccccgtctcaactaaaaatacaaaaattagccaggcatggtggcacatgcctgtagtcccagctactcggaaggctgaggcaggagaattgcttgaacctggggggcggaggttgcagcaagtcgaaattgtgccactgcactccagcctgggtgacacagagagtgaagctacatctaaaaaataaaaataaaaataaaaaatgattagcttcttttgaaggatcagattcaaattagagaaaatatttttggcgagcctgcaaatggatgtctgggcttcctgctggaagtgaggaagagataactaaccacgtttccattcctttatctgtttatttgcagaaccattcagcgcctctgtctgggtgatgatgtttgtgatgctgctcattgtttctgccatagctgtttttgtctttgaatacttcagccctgttggatacaacagaaacttagccaaagggaaaggtaagggtaccttcatgagcatgattcaatgttgttgcaatttcatttacctttaatgaaaatttcagttttagaacacattactctagaccaggcatggtggctcacgcctgtaatcccagcactttgggagaccgaggtgggtggatcatgaggtcaggagttcagaaccagcctgaccaatatggtgaaacccatctctactaaaaatacaaaaattagctgggcatggtggcacacacctgtaataccagctactcatgaggcagaggcaggagaatcgcttaaaaccaggaggcagaggttgcagtgagtcgagattgtgccactgcactccagcctgagggacagagcgagactcaatcacacacacacaaagaatacattatactgcgttggtgtaccatcgtatgaatggttttgggtcactgatattgcttgtaataccagaaaagtatggtttatgtacttcaactgatggataaaacaaaatgaaatattttaatcttgtcataacctgaagtcaatagttgttaggtgaaaaccactgatgttcaatttgttgggaaagcagatttgaaggaacttttctgacaattaatttaaaaaatgcttgtcaaatgctaaaattgtcatgggtttcaacttcagtctatgcaaagaaaatgactttataaaatctagtttaagaacattcctcaaactactgaatcaatttacattagtttgacaataaatataactatgaagtgatatatttccccatagggttatattttcctgttggtgatgccaggaggaaatcaagtgtgctaaaataaaatgcattgatcttagtgcattgtagttgataaagggacaatcagtagataggaaataaaattgggaggcattcgttagctataactcattaaaaggatcccactctagccagggtttatgtcatacacgttatgccattttgagtgggctttcctcagtgggcactaccttctaaatgggtgttatcagaaaagtgtcaggaccaaatctctttcccaaaaaatgacttgatatggtagaggatggaacttgaagtctcatatcccccaaaaagcagagcactttaatgtgatggatacatattcttttcacttagatgttttaatattggaaatactcaacaggtcatgggaatctattaggaacctagttttattgaaatctttcaacttcttcctcaccattgaagagtggtgattaccacataaaccatcttcaatcaaccagatactaaacaatgccataaataatgatgttgtgtttaatgggagattgcaagccttcatttaaagggtaatttaacctctaagaagatttccaacagggtggaatctgagacagtttctgtgagtgaccacactgtgatacagtagttccttatatttgcataatcagggcttgtgctgttgtgaatttacacattttctgatgaatatttatcaaatgggtactacgtgccaggaggcactatactgctgccagagataatgtggtaaatcaaatagagattttctatcaggcagtttagaatttagttgtgaaaataacatgtagacacacaaactaataataacagattataataaatatcaagaagaagaaaaaaacatagtgacatgatagtgatggggtgcagacactacgttagataagatggtccaatgggaaaggatgttcattgagctaggacctgaagggtgacatacaattttatctgtcaaaaacagttacagtcatttcatgtaaaaggaacagcaaacagaaaggctgaaataatcttgagatgctcaagaaacagaaaaaggctgagggggtgcagtggctcatacttgtgatgtcaaggctttttgaggccaaggcaggagaattgcctgaggtcaggagtttgagaccagcctgggtaacatagcaagacctcatctctacaataaataaataaataaataaataaataaataaataaataaataaataaaataagcctggcgtgatgatgcgtgcctgtattcccggctactcagaaggctgaggtaggagaattacttgagcccaggaggtttaggttgcagtgagctatgatcacaccactgcactgcctagtcagcagagcaagaccctgtctctattaaaaaataaaataaaaagatgtgagtgaatgaggtagacaatagtataagatgaaatcagagagataggcaattgaccatgggaagcatgtcagactttcttcaaaatacaatggagggaggccaggcacggtggctcatgcctgtaatcccagcactttgggaggctgaggtgggcagatcacttgaggtcaggagtttgagaccagcctggccaatatggcaaaaccgcatccctactaaaaatacaaaaattagctgggcgtggtggtatgctcctgtagtcccagcagttcgggaggctgacacaggagaatcccttgaacccgggaagtggaggctgcagtgagccgagattgtgccactgcactgcagcctgagtgacagagcaagactccatctcaaaaaaaaaaaaagaaaaagaaaagaaaaaaaaaaaacaatggcagggagacaggtgacatacatgtacagagcaaaaaggtcactggggctactctatccagatagtgtgtggggacaacagttggaagcggggacggggagggcagttaagaaggtgtcacttttccaagagaaaggactgcaatgacttggaacttgtcaagaacaacgaaaatacagataatcaggtaaatctgagttacattttggaaggtaaaaaccacccacagcccatccttgcaatacgttctcctttgcctgaagcatgctggaaagactattgtaaaggatggcatcagttgtgcaaactcctcagcccttccattctctccaggctctctgtttccagctcatctgctgtggcaactcttgggaaatgacagctacttgtttctttgtacaaaatggttttctgttacatttcgctgcactttatgggaaaagttatatggcccagtcatagtattcatgaatcaggaattcctagaagtcttggaccgatccttctgaactgcctacatctgattcctaaatagctgtcatttctgatcagtgtgcatccctaaaaaaactaaatcgttcataaagttgactggattaactctaagttttccccaagaatttcctgcctcttgagaataagcccagaagatcacaaaactagccaaatagaaacaggagagattgagaataagagaattaactgctttctctttaatgggttgtgtcatggatattataagtacagctgtagcctgggtttggcctccaatgtgcagagagcttgcttttcctaggcttcctgcccagcacttcataacttccattaatgtgaatttgcttctgccactttatttattgcccactctgcttatattggcaggtgacatctgagtagatcattttttcatatcttcatttacttaaatgacataaaaattaacctcctgttaaagggaaaccttccctatgaaattagggcatcagttgatttttttttttttttttttttgcccatgcagaacaaagacttgaaaaccctaatatgtgtgttttacagcctgcatatgccccatcgccataaattttggcatatcattctgtctctttagttaagtctgttgcaaggaacatttaagaatcttaaaagggctgcatagctattgcgaggatatactggaaaaagtgctgtgatatgacatcagtgttcattttccatgaccctgcaatgaaatgtcttccatctgtgaagtgttggaagaattaagatctattgttccattccttaatgtctccatttggagagggttttagtttggtttaattcttatgttgtacacactttacatctgagtttgaacaggagcaattgctagggacaatcggattagaataccaaacatcagtcccgctgaattgcatggttcttatacgatagcacatccgatgaatttggaagcagtccccatgcacacatttttgtcaggctctctttatgtttattaagaaggctggtttcctcaaatgggaatcaaatccaaatttaaaacaggtcataacactacttattcaaacccccattttgcataaccattttcgtttcctttctttttttaaagaaatgtggcaaaaatccagttagatagaaatgtgagaagaatgctaatttttaaagaaaaaaataagttattgtggttctagggcaatcacaggacacaactatgatataattccatcttctggcaaccttcggtgctgctggtggctgctgcgtggttgtcatacacaaacaggcatttttttcagaaaatgctgagaatgtccttttcatcttctgcagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaaggtaaggtcaccttgctttcctctccatctgagggttggtcttaactgctctcctttcaggaggaagagattcaggtgcctctcattgagatccatcaacttgaatgcacaaaagccagaaggttttttctctttaactcaaattgtcctctttctcaaagtttttgaaacagaacattaaggttagctctcctagacctaaaagattccagatctaatttggaagcctggcttccccgagtggtcgtgtttcctatttatatgatctttctgatggtgcttgtgaatgacctatgactcaagtgcttaggttgaaattcatcctttcgaatgtgtgatgttaaggaaggcccattttcctggatgagaagaaattggggtgaaggagcactgtaggctgtgggtacctcatctatgacctgaaaaaaagtcatctttaagccctacccagagacaaaattatctgacagctcctcttttccatacagccaaatcagtctcagcatcagcgcttctgactcacctgaaatgtcttcaaggcacacaaaaggagcagagagtttttttctttctttctttctgtttttttaatttcccactggttctttctactcagatatatcactaatcttcccttatagggctgtacttcccacatcagtaagacaggagtaaaaacacctgctctctcattctccagtgaaatgaaatataacaagggttgcagggtttgagtagctattcagaaacacacattgaggaagaaaagaggtaaactgggtgcatcctcctattgagactttagttcaggaaacatcctgacttgctaagctcagcaagtgttgagattgcagcaccacaaagattttctgttctgtgtgtggggataatttgtctctcgttataaaacctcgctaacatatctttttgacataagtctacatatatccttttgccattcatcaacaaactgctgaatagaaaatcaatccatggaaagcttttacagcttatccatgatacacactgtggttgaaagaatcttgtcaagagagctgatgaggggttggggttaaagatggagtcatttccacaaaggcatgagagtgcctcacctctctctgatggcttccgattgaggcttgagtaagggtcactttacttaccatggcacacaaagccctgtgttatctcacctgctcccacgtttccttcctcttgctccatccctgtcactaagtttatttcagctcagtgtccttgtgcctcttaggccctctgcctagaatgttcttccccaatcttctcatggttggctcctcctggaatttctggccttagggaagacattacctcctcagggaagtctttcctggctactgtaataaacttggcagaatgagctcaggctcccaagaaacttaaattctagtaggaaaaaaataagcaatacacaagtaaacatcaaggaagaaacaaatttggaaatttggggcaggaataagtattataaagaagataaagctgatgagactaaaattgtctgggggaagaggccctcagggatgtagttttgatagagttattttgcactttggaggtgctcaggacactcttgctgggtgaatgaatacatgcatggtatactggacactgtgcataccccacctggatctcctgggatcccttttgcagcgctgtgtgcccagccccacctttctgtgctttgctgacaaagcctcacttcagggatcctcagcagatttttgcctttgggcactggaatggtaaatgcctggcaatttaagttccctcaatctttgtggtcacctgtaaccaaagactaatctgtgtgagaatacaaaggctaagctgctcccttgcttcgaagcaggaaaaactttaaggtacgaatcactctctggagctccctgcaggacgggactgagatggagacttggccttaaatcagacccttgatttctcccccttctccagtctttcctaactttatcctgctcccctgctgacttctcctggaacccttcactagtaaatcatgctcacccccaaatccttcacttggggtcagctactgtaagatccccgcctaaagcgggtggtatctcagaggcagcagataacacactgtgtttagagtcagaaaagttgtgtttcctctctgcctgtttcctctctgccactcgccagccagccgtataatgtttttaaagccatgtcacctcacggtgcctgctttgtctgctttgtaaatttgggagtcacaattgcagtaaggatgaaagaaagccacatatgtaaatgtatcttgtagcatatgaatccctctgcagacatgaagcgctattgtgcaagtctgtcacattatgggatcaaaagtgcaattcctagaagtgattggaggtatggtggaagcagcaggaagcaatgtcctggaagagaggatttttcaagaaagtggttggcagcatattttgctttttgttgctatgttcaaaggcaagggcggggggaaatccttactacatagttttgggtctaaataacatgaccacttgtgggaaaactaattaaaaccactaataatttgactgaccttcactgacttggaaacacccagtaacagataccatatcctcaagagacaaagctcagtctccatgctgaaaacattagaggcaagctgatagctcttttaattaaatgtttgatacaatgagataaacagcaaaattcctggagtaaataacctatatgctcccagaagattaatagaagatacaccaagaaagtctgcaaaaaaaaatcaatattgaatcaatttattgtacactgtggttggttttgtttttgttttttgtttttgtttttttgttgtttgtttatcatgaatacctgtgtaacaactcaggtttacaatgcttttaagccattagtgcttgctgtgaaataatcatattggagcccatggtgtgctcagatgagctgggacttaaattataaataggtgaattcatgggtaagatgcttccctaggaattattaagagaaaattgcaatgttgatagggatgctttccaaaatgttgggaatcactctgacagaggaaatccatctctgggaggcagatttatgttgtgggaagagcaatatcatgtttggggtcaaatggacctgggttcaaatcctggccttgccatatgattggccttctgtatgtcagtatccccttaggcttaatttcctataaaagagaagacattatctcctttctggcaaggttgataggaggattagaaataatcctcacaccatgcctggcacatggtagatgatcctgtaatgtgttatttccttcttctaccctcctcctttccactcccccctctcattcctccccctctccttctctttgtctcccttctcctcctactccttccatcatcttcatcatcgcctgactcaaaccattcttggcttctggggcctgaaatgttattgcactgagttggtcttttgtgacaaccaatggagggaattgaggcaactgctctcagtggatgagcccaggaatgtgttctcaaggagccatgctgtctctgggcactgtgctgctgctgctgagtggtcccagttcaggcagccaggcctcctcccagctgatcctctctctgctcaaggacacacctgcttgctgctcacatcaagaagcacgtgggacttcaccaacagaagactgtactagaaataggggctccagttgccagatgtcccttatttacaggcacagaagacagatagatatttttaataaatgggtagtttttggttcacaaaaaaagaaaaaatatcttggttaattgctgcatttttctggaaattttatctccaagtgttgcatctctacctcctccatcatcaaatacttgccatgttttagtcacttggatgaccttcagacatgcctccatattggatggaaaaaaaattagaaaataatcctctgttctccaaactgtaaggagacaggcttcattgtttggctgaaatgtcgtgggtaacaacaggtgatctatcccaagcattagaggatgccaggtgttctttcaaacactataagatttgttgcaaaagcaatctccaatttacagatagagaaattcaggctcaggagcttaactggttgctccaaatggcgcagtttctaagcagcagatgagaacctgaacttgtctcctgtaagtccaaagccaggtgaaaccagttaacctacacagcaagggaaccctgcagagaagccaggggagttcctctgactccagatattgtgattacattgttctgtggtcttgctgacaatggagacctctgtcctaccccttcctttgctaaagcccatattggattctttctgcttgcacgtggaactctctgggagaaagtcttgctaggaatcattctcgcagcaagcacggagtgtgtcctggatgtagaccctgggacttaatagatgagccatccttgccccctcactgtttttcacgctgtaggtcatgactctttagtgagccatgaaattaatctaaggattgcagacatttttttaaaaaaatagaacataatggataacctcagagtatatcacagatagaaagaatgagtgctgtgaaatttcacacatgtgcatggagtggtgatgggaaacgtattgtgagtcatgctttaaaaagtttgacagtcttcagtctagtggaaaaggttcctggagcttggtgtcaggctgaattttgtgtgggtgatggtactatccaggccagagaagcacggaaaccatcacagagactgaatatctatctctgttactgtgcaacccagacacagggaagaaagtgaatttttaaagacctatgcagctcctctgcaacagacggggagtgaagtggaaggcatttagtcaaataggccatctccggatatctctggagattgggaatggctgctacaaggagatttatgaacagcactattacctctctcctcccgagcaggcggctgccatgaggatgagcctgggcttggccttttgagcttttggtgattagttaaggcactgcttggtggagtgactgcaaaaagcattttgctgttcacatacacacacatgcacacgtggacgcacatactcccagggcaaggcacaccctggcaggaggatctcatttggaaaatggatggccacttctcccaaatccagttatgactgcatattaggcagcagcatgcctaatttagggaaaacgattttcaactggaaattttaattaacagtgaagtgaagtgtgagtctggaaaaaagaataatgtttctagctggtttgactcttgggtaaatttggacacttaccctggcggttcttagttctgtggaagacacactggtctggaagttggagagactgctgcattgtggtcctggttctgacactgattttctgggtgctcttcccctcctggggtctttaaatctttatgtctagatgaggagagagtcaatagcaatggtctctgaggaatgatagagttaagacctcagcctgtggtcagacgcatccgggtttgaattctgggccactgcttggtagttgcataatcttaaatagatcacatagcctctctgagcctcagttttcttatctgcaagaagcagcctctaagattaactacctggcatgggtttgtaaggattaaatgacctgacgtttgtaaagttcttggcatagtgctggacccaactaggttcccaaaaagtgttagtcattgttgttattactttctagttccagaattcaatgtttcatagaaaaatgaggttcaggttcctttttcactcataatgataataacagacggtaatcatagctttatttttgaatgctttctctggtccaggcactattccagttacttgacaaatgtatgttgagatcttcatggtggccccccactctacagatggaaaataaatggaggcagcatgaagtgaatgtgttatctagggttccatagcttgtatgtgatagaacccaattttccaaccagccagttcgagctcctgcttataaccacagcccgccaccatctctagtgtttagctgtatttctggaactcagatccagttctattgattcgactctcattgagtcacctgaaacatcgaagctgtggacagacagaatcatccaatccatcagagaagactggtgatgcatggactacaggcctttatggggggcttgagtgccgagtgctgcgtatccctgatagctaaagatcaacagggactctggctcaacaagtattcatggagcctgccatgcactggcaattatgcctggggaatgttaggcactagataaatagtgcctgcaggagtgaatgaatgactgagtgagtggagaatgaatgagtggtaatatatagtcattttctgggtgaggtgaaggtaattataaatggagtttagagaagggagtgattggtggagatcacagaaaatttcatcataaagtggataaatggactggactaaggtagtaccttaagttcagctcattcagcatttctaagtactgactgtgtgcctaacactgtgctagtctctgtaatggcactgaaaagttcaactcaacaaatacctatggagcacccagccgggctctgtgctaggatctgagcagtagtacagaagaaaacagatgctgtgtccaccctcctggagctcacagactggctgaagatgtgactaagtagaaagaaagaccaaaaagcaacattttattgtcatcctgccctaatgcatgcatttacctcctaacaccagacaaaatgatcactaatttattatttgttctctcctccccctcctcccttctctttcttttcctactctctctcttcctttctcgttctctctccagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggtaaggatggcagtttccttttcaccacaggtctgcgagcgataaaccttacagaaattgactctcggcatgcctcagttcctatctgctcccattgtatttctggagagtgactgtggtccagatgggccccagttgagggcagtttttgttaatctaatgagcatcccaggtttccttctgagttgggtgaagaaaaagcaaatccaggatgctttgaaatgcacagaaacagaggggtttcttaaactgataaagaagtttgtccaactccataggatattttaacaaatagaaagatccaagaaggccaagagtttaaagtagtgaaaacaaagatttttatcagattttaggtaggaggttttctgagtgtggggaggagtagcttgctagtaggagctttatgaaaaaactaattgtataacattgatgaaagagaaagaaaagatgggagaaaagcaatgagaactcaaatcattcaagttacagttagcattcctctctgtctgttggcattgtggagtgtaacacagactccatagctgaagatgtaaagaaaagatagcacaggggttaggagtttaggctttggagagagagtttctcatacctcatagcctcatatctaacatgggaataataataggacctaagagagaaaatctgatggaaagccttttggatgggaaatagacagtacctaaatgtgagtgttgttatttattgtaaaggttagattctattccatggactcttctgaaaagtccattgttctgtggtcttgctgacaatggagacgtctgtcctaccccttcctttgctaaagcccacattggtttctttctgcttgcatgtggaactctctgggagaaagtcttgctaggaatcattctcgtaggaagcacggagtgtgtcctggatgtagacccaggaatgcatgaaatccattttagaaaggattaaatccaataaaaatgattttattttaaatgacagagttgtttaatgaggggattttgattatccagaaaattagctcatatggggcatttcagttgtcacagattcctgcatggaaacatgactgtaggtgcattctccttgtggcttaataaataacctccttttcggctgttcggcaagcccattgtgaaggccttgctgctggctttgtgtctggtagggggagacagaggcccctctaaagcatcaaagcccagatttctgcatagaaatcccggtagttttggctgtgagcattctgtcctttcagtctgtgcctttggaatgtctttggcatctcagcaggggctgggagagcatttattcagaagttaagtctatgatttctgaaaaactcattcccacagtgctcattctggtttggaatgatttctttaaacttttgaagtataacaaaaatgcagaaaattcacaaatattaaatatgctgctttatggcttcgtacaaactgatcatccaggtcatcactccctggaaccccgccccacaccctcttccagtcaatatcttccacccgccacctgcacttctaaagccgtagattcttggtgcctgctgttttaacatagaaataaagccacactcttttcttttttgtcgtctttggctcaacattgtgtttgcaagattgttgcatgtaatttcagtgctttcattctcattgctggaatgcagcacacatggatgtctctgtcctaatcttgatggacatttgggtaatgtcctattttggggccattatgaataatgcttcttttgttaatgagtgagcgcatttctgttggtatacaccgaagactgcaactgctgagccatagaatatttgtgtcttccactttcacagatacctgaaaagaccaattgttgatgactttacagtttagccatgggtttgggatttttgtttgtttccattgtggtcttttaatcaacatatactgttgttttggacagaccatgagcacaaatgcagatgataatggttggagacagtggttgatgcctagctggctttctctccctccatttattaaccagagcacaaaatgggttgttttctttctttttcaatcttttttttaatataatagcaaaaaggagagaaatggaaaccattcgtggccataaattgtacaaattggtttctggaagccatataataattataacatccatcttagaaaacgtgggcagatggcagattcattctatactcaatctcccatgtgggggatgctttgcattgttactttaaactcagaaactagagctgaaggagtacaagtcttttttttttttttttttttttttttgagacggagtttcgctcttgttgctcatgctggagtgcaatggtgcagtctctccccgctgcaacctccacctcccaggttcaaacgattctcaacacactcagctaatttttgtgtttttgtagagacagggtttcaccatgttgactaggcacatcttgaacttctgagctcaggtgatcctcctgccttggccttccaaagtgctgggattacagtcatgagccactgcacccagccacaagtcattttttaaaaaataattcaatatactcttagggatgaaagcacagcagttatcattactggagatttaatttcattggagttaatatttggggaaaccacatacatgtttaacaggctccttgattaattatttaaatttttttttttttttcagacagggtctcactctgtcacccaggttggagtacagtagtgtaatcatagcttattgcagcctggacttccctgggctcaggtaatcatcccacctcagcctcctgagtagctgggactacaggcaagcaccaccacacctggctaatgtttgtgtttcgtgtggagatgaggttttgccgtgttacccaggctgatttcaaattcagaaggctcaagccattctcctgcctcagcctctcaaagtgctgggattacaggagtgagtcactatgcccagcctaaattaaattttgaatagataagatatttatatacgtcaaaaataaaaaagtacataaaaagaaaaaaacagtgaaaagttttccctgcacactattcctcatctagtacccctccatggtaaccacatttactctgtgtatccttccaatatgttcttctgaatctttctatattaatgcataaaaagccataaagttattttttatagagtcataatctttcattatgcaaatataccatattttatttggtcaggcctctattgttggacatttaggttgtttccaatcttttgctattgcaaacaaagctgtagtgaatatctttgtattgcgtcacattcagtgtagaataaatttcttgaaagagtgggtcacagttgcaattttaacagatattgccaaatctccctccaaaggaaattcatacttaccccatcagtgcatgagagagcttatttctccaaagttttgccaatacaatgtgtaattaatctttcaaaattttgctaataggtaaaaagtatgctgagatataaatttgcacttttctcagtaaattttggccatatttatatacttaagagccatcggcaattccttttttacttttattaatatttctattggtttgttggtctttttcttattaatttatatattggacagatgagccttttgtgatgtgattacaaatattttccctatttcttttttagtcttttgagcttgcttttttttttccatgcagattttatcttttttgtagtgaaatatatcaaccatttgcttatggctgttgaattttgagacgtaattcaaaagtctttcatcattctttattacaagataattacctcgtgttttcttcttttttggttgcattttttaatatttggaatttttcttggtgggtggtatgagacatgacttcaactcctcagatgattatgaaaaccagaatatgagaattaccaccacagagctacaccaagatccgatcaactttgtgttgattgtgtcttctcaacgtcccaccacgagactgcggtctttcaggtgtccacgtcaccacactcacaggccttttccttccttttcacatctcctgtttcctttttaaaattttcattatgaaatatattgctgtttaaggaataataataatacaatgaaatcttcttgtacctaccaccgagccttaaaaaaaaaaagtcattctcgtcctttaccacgaccagcatctgtagaaggttccatccctctggaaggttgaagaaggtaacctcatctgctcccgaattgctcagcttttgaacattcccccaacaccctagaatccagcaagccttgacttagaacatccagagcatgtggctcagctgctgggtctcactgctccacccacacgtttcagtaacatctgctgcctagcaaagccacgtgcatgcacaccagggtcagtgaaattgtgggttgtaattttctgggagagtcctgaacaccagacaggctttggattactgtcaagtgacagtcccagctgggtttgagtctggactcgagcattagctagctgtgtcctgggacaagtcatgtcacctctccaagtcactttctagtttccccatctaagaagtgaaatggttgaattctttgatctctaaactagttcatgagattcttttatctgtgtcaaacacttaggaagactcagacaaaccacatatgcaaacaactgtcagttttgcagaaaggatttagaatcatgccccaaaattgggtgcctccaagcctggccaatggaccaactgtacctgaatcacatgattacctgtcaaaatgcagattcctgggcccaggacaaggctttctctctagctatggagcctgtgaatctttattataataagcatcattccccgcagcacgccacaccacgtgattttgagacacacgaatatttgagaactactgttttagaagtccaacacactattcattgtgcaacagagctgagaactactattttaaaggagttgaagaaacacattttattgggataggcatatacagagtagacaagccaaatgcttgtctttggaatccctaattttttgaagaaaggcataggcagagaaaaacttgaaagctaagttttactgtttattgaaattcataataaatggagataaagaaattatcagacaaatcagtgagaaaaaagggtttgatgtgtaaacatcaacagagatgggatttttcaggcacagatctgttgtgccttgtgggactcctgtgaaccaaaggtggatgagcgtcagtgaccccaggtttctaggctaatgcttctcaagcatagcctgagtctgaatcagaataggtgctaataaaaatgtagattgctgagccccactgagccagttgaatcagaatctctgtaaggaggggtctgaagatctgcatggtttaacaagctcttcaggtgactccgatatgccctaatcaaattttaagaacatccactctagaagagggagctgaagctgaaatgagtggagacagatttagatttacaaatgctcagtcatcagaagctgatgtcctccaagccattttggcatgggggcaaaactgcaagcgtcgcacatatgccagatttaaattaaacaacgtccctagaactccgaagagcctaatatttcaagacacagtgggatagtttgtgtttttcttttaattgattttcatgtacaagtctgggtgtatacatttatggaaaagtcccaatttccttagaagcctcagttttcagctctcaggatccccagtcccctgtgcgatttcattctcagcacaatgttaaaaaacaggtctctgttggtttcctttacatgcagtagttagaagaattggaagagaggattgtcttttttcccagtattttttattgtgataaaatatgcatagagtaaaatttgccatcttcacatttttaagtgtatagttcagtggtattaaatgcattcatcgtgtggtacaaccattaccaccatctgtctccaaagctctttatcttgtaaaactgcaactctctatccactaaacaaaaactcctcaacccccttttccctagcgcctggcaaccaccattctactttttgtctttatgattttgactgctctaagtacctcatctaagtggaatcatacggtatttgtctttttgtgactagcttatttcacttaccataatgttcatccatgttttggcatgtgccaaaattttattcctttttaaggctaaacagtatttcatcgtattcaggtaccacattttgctcatccattcatctttcaatggacacttgagttgtctcagcattttaactattttgaatcatgcttctgtgaacgtagatgtgtgaatatatttttgagactttggttttttttgttggtatatatgcagaagtgaaataattggatcatatgtcaattctatttttagttattgagaaacaaccatactgttttccacagtcccatttgcattcccaccaacagtgcacaagggttccaatttctccacatccttgccaatacttgttgttttctgtttttctaatagtagccatcccactgggtatgaggtggtatctcattgcagttttgatttgcatttccctaatgattagtggtatcgagcgctttttacctgcttattgggcaattgtatttattcttttgagaggtggatatgcaagtcttttggccattttacatttgggttgtttgggttttctttttttttttttttttggttgttgttaggttttaagagttctctgtatattctggatatcaatcccttatcagatatacaatttgcaaatattttttcctattccatgggttacctttttatattctagctattacattgatagtgtcttttgatgcacatttaaaaaaaaatttagggagtattgtctttttaccaataaatatttttctaaaaggcttgagttgtcctcagtgacatgtctgtaaaaacaaaagaacagtgtagtcccatctccgtgtatgtgtttgaaatgtcttcatagaaagttttgcattgaaaaacaaatgagcactgaattcctatcctagagcacaggtttgcaaagcctgtgggatttaggaatgtaccattttttttttttttttttgaaacggagtttcgctcttgttgcccgggctggagtgcaatggcacaatctcggctcaccacaacctctgccttccgggttcaagcgattctcctgcctcagccttcccgagtagctgggattacaggtatgcaacaccatgccctgtcaattttgtattttttagtagagatggggtttctccatgttggtcaggctggactcaaattcccgacatcaggtgatccacctgccttggcctcccaaattgctgggactacaggcctgagccaccgcacccggccaagaaggtacatttttattagtgcttctagtgattcagatgtaggtagtccatgtctttgagaggttagttagttgactattgagaaatggagttctgtagtgactaaacaggacaaggaagagggaggatatttcagaaggagggtgcaggatgggtggagatgtggcaaaatgtgagtttaggtttaggcatattaagttggaagtgcctttggaacaccatcatcatatgtccaggcatctttgcacttaatgtgacctgacaattagtgagctacagacctgagcacttcatatgcctaatctcaattaatcctcacaacacccctacgatctgggtaccattaatatcccttttaagagatgaagaatgtgaagctcaacaatgttaacctaattacccaataggctattcagctaagtaactacattgcagaattagtaagtatagaagttaggcttacttccccacttggaaatgccacctaggcagttggaaatacggggttatggttcaggggagaatttaaaactaaagttagatattacatatgtgcatatattatagagtacatatcatattaattgatgatctgagaactgataaaatcacagcattatcatttctatgctcaaaagaaactggttcagggatattggcattcccaaggcaaaggtaaaccaggagagtataagggttgtcactgaggttcagttgctctgcagagcaaattttttcaaagatgccatttgagcaggttttatttgctgtattttatcagtcaaacagaatcagacacaaatggttcatttccagctgctgaattcgaaagcgggcatagacatcagggttcagtgagctgttctaaatggggtagcgtcatctccagagaaaatcagatcaacaatgacctggtttctgagatccacccccacactgcaaacaaagctcaaaaataattgcttccacatcatagagttagaaagttttttccttaataaaaactcaagtaaacacagacatcttttttttttttgcgggggggtggggttcttggaattatttcctggtaagctctattaaaacaacgttaaaggattttcaaggccacctataaaaactttttttaaagtagaaaaaaatgtctgtggggggcaggagttaaataaagtgagatcataattctttaaactcagagacggaaaaaaaaaaaaaggcaaaaaaaacagactaaaaagaaatatatcaaaatgttatcggagatgctgctaggtgattgggatgatggactttacatctttttacatttaacaaattttcagcaacacagtattacttgcaatagctagaaaaaagtttcttctgactataattctctattttttcctgcatttcattcttgtattgtcaacgcatatatacaattcatacaagttgagtcggtgcatatgcaaatttgttttgcttttctcaattaaagtagacagttctgttgtttagtttccacatttaaggaccaggtgataatttcattgagctagaggaatattaattaatttagcttttactgctttgtgttttcatcatgccttaactagcactgaagggtactacaagaaatagttatttttgaaaaggttgctgatacggttattacaggacagcttgtggagaatgtcgtcctgtagcatccctcacacttctgtacgatgaagagcattgctttgttctgtttgaggcacgctttgatcttgttgacaacacaattcttataacaacttatggttttctttttgcttggattaccgcacaattcagagcttaatgcatgattcttctttcacaattgtggagcctttggcctgaaaatctgtttactgactttccctaagactgagctactattccacttctgaattcacttaactccaattgctttatccgtatgtgtaaaccttattctattctattacagtgagtgtgagctacctgaattgctttggacacaaagcaattctttgttttttaaatttttttattgtgtgtttttatttattttattgtttatttcttttttctttcttttttgtttttgttttgagacagagtctcgctctgtcacccagactggagtgcagcggtactatctcagctcagtgcaacctccatctccgaggtttgagtgattctcatgctgcagcctcccaagtagtgggattacaggggtgcaccaccacacccggttaatttttgtatttttagcagagacggggtttcgccatgttggccaggctggtcttgaactcctggcctcaggtgatcctcccacctcggcctcccaaagtgctgggattacaggcgtgagttaccgtgaccggcttaagtgaggcatttctaactaacagattccatttattgggagcttacctgagtgccaggtactgtgttaaatgctttgcctccattatctaatttaaacatcatgacaaacctatatgacggtgaccatcaagattttcatccacctttgaggaaacaggcattgagagattaagcagcgtgtctgggatcaatcttacgccagagcccctgctttgagtcacaatgtaaaaaaaataaaaaatatgactgttctcataatattccacaattaaggccgtttctaatggcccaccattatgcaaaacctagtaccaatttcgtcatatttttacttcaaaagttctccttttttctttaaaatctttactactgtttcaaaaggggcaatgtttcttcttccattgagataaggaaaataaatgaatgtgtggagcaagagcgtggaggaaatgaatttcttctattcgagccaagccacaggaagcacatggtcagaaaattcctcctggggaagaactgtgaagaagcaggaactccctggcaggttctatatccttagggatcacctcttgtttgtttttgtttgtttgttttttgagacagagcctcactctgtcaccagggctagagtgcagtcacgagatcttggctaactgcaacctccatctgcagggttcaagtgattctcgtgcctcagcatcccgagtactgggaccacaaatgtgcaccaccatgtctggctaatttttgcacttttagtagagacagggttttgccacgttgtaccaggctggtctcaaactcctgacctcaagtgatccgcctgtctcggcctcccaaagtgttggaattacaggcatgagccaccacacctggcccacctcttgttattgcttgctgaactcacatgggaacttcaaacatgtgacctcatttcctcctgattcaactctgccagataatcattttctccattttatagaggaggacactgaagttcaggcagaagccacagttcgtctgaaggttaacatctaatgagtagcagtgccagcattcagttgaagacccaacatcttttctgacccatgatgttgtgctaaccctctgcttgtcctgagaagggaacagctctggcaagggttgtacctatctgttacaaggtcgtggggttaggagatgcgaagttgctctcacccatgaagcatcacaggtttggaatagctcagcttcctttctccccacagtaaaattataaacacatctccactgacccaggtgctaaaaaggtcatggtgttaatgtatcagccctgtgtgttctcttgctgcagggagaagtgagttttcctggcactgggctcactcagaccatggaaagcctctaacacaggttaggagacactgtttacaccccatggaaagtgcccggggccaaccccagacagctgcctctcccaaagcaagccccacctccttcctcccatagagaaatgcaggtggaggagtgataggaactcaggtactgcaccttcaggtgtccccagtgaagtagtttcctagagtggccataaccaataacaagcatggtgggttgcaacaacagaattttattctcagttctgggggccagagtccaaaatcaaggtgttagcagggccttgctccctctgaaggctctaagcgagggccattctttgcgtcctccagtttctggtgcctccaggtgtttcttggcttgtggctgcatctctccaatctctgcctccatctccaggtgaccttcttcccttggtatgtctcctcttcttctaaggactccagccgttggagttaggacccaccctaaatccaggatgactttatctcaagatccttaaacaattatatctgcaaagacatgattttcaaataagggcatactctgatgtcccaggtgtacatgaatttggaggtatactcacctaggctgtagtgtggttttcccaacatcacctcctgataggtatccgacatcagtgctgccagtggaggctgtcctcaggtgtcttggggaccaggggaagaggccatgctgcccagtactttatctgggtgtgctgtggggagtggtggtgtattccacaggaatgcacagcacacaggtatgcaaagtggattcttgcgtgtgaactcccaccatcaggtggtaattgtgctggccaatttcccataccttccctatcccctgcctcctggtctcagttgtttaggtagccctcactccatgccaggaagtttttctttttgagacagagtctggctcattcacccaggctggagtgcaacggcgcgatctcggcccactgcaacctctacctcctaggatcaagtgattctcctgcctcagcctccagagtagctgggattacaggtgtgtgccaccatgcccagctaatttttgtacttttagtagagatggggcttcaccatcttggccagactggtctcgaactcccgacctcaggggatccaccctcctcagcctcccaaagtgttgggattactggcatgagccaccacacccggccccagcagcttttatgagtgtattacctgtaactcttagtttaatcttcacagcttctctgggaggttggcatgcccagcatctccactatacagacagcttaagtcatgacgcaggcacagtgctggtaagcttcagagctgggatttgaactggctctaggagctatgcccttaaccattatgctatattgcttctcattaaaaaatgtatcctcattgtaaaaaaaaaaaaatgaaaatacagataagcattcctttggcttggcatctcaatgccaatctgttgtctgtttgatgtacgttccatttctccaagacttttattatatgcatttgcatatgtttttgtttttctgagacagagtcttgctctgttgcccaggctggagtgcagtggtacgatcttggctcactgcaacctctgcctcccaggttcaagtgattctcctgcctcagccaccagagtagctgggtttacaggctactacaggggtgcgccatgacgcccagctgatttttgtatttttaatagagatggggtttcaccatgttgcccaggctgatctcaaactcctaaccttcagtaatccacccacttcggcctcccaaagtgctgggattacaggagtgagccaccgtgcccggtctgcatttgtatatattaatatatgtccacacagaataaaattttattctgtggaatgctatcaaactctatgcagtatgtcacagtttggttttcagtgaacgatatgttttggagagctttccattttttgccttcattctctttgactgctggaaagaactccatgatatgcatgcatcagaatatttttaagcattttcttctcactagactttttttgggggggtgggatgagggctatcagtcatatggctgtgttaaggatcgttggggagtcctctgtgtacctctacaagtggttttctaggaatgaaaccaggacatagaatttctgggtggaagtatttatattttcttgaagccttcaaacttacgtagtcaatttatttgatttgcttatttttatattttctgagtggcctcttggtgcagagagtggattttggggtaagaaacgcctactttaatattctgtctctaataccagctgtgtgacctttggcaaattaaataacctctctcagcctgtttcccacatgtgtaaaatcctatttcctggaattcctctgagaaataaccaagttgacttatggaaagtaccctgcattctatctaacacataatagcattttcacaaatctcgatgtttttcggaatctctctttcactctcatgttttctggcccctgagagtccctgtctttcagtcctcctgtgtgacaagttccgtgatgtcgtcactactaacagtatgatggggtgcttaaaggataagcatcctggattcgaattcccactccagtgacatccagtgttgggaccttggacaagttattaacatcttagactccagtattccacttttataaaattatactaattgtgctgccttcacttggaaatgcactgtaaagattaaatgagatattccggcaaagagtgcagtgtccagcacatagtaaatgttcaagaaaagtctgaacaaagaaaacctttttgagccatctttctaatattataaaaacgctatgcttcgtgaaatctgcagcagaatggttaggtctgacctcaacccttgaaaagtacaatctaagaagctctataaagagtagcattccagaaagaaccaatactgttcctatgtcagagcatgagttgtggtgaagaaaatacagcatcgcatagtgctttgcaattcaccaaacaaattcatggctgggacttcattcaaccagtgcataaacataggagacagattatgttttccttcctgtcagatggggaaatcaaggcttagagaaatatttagactttcccaactttccacaaagtatgcagagccagttctctgaccctgcatcccagctgaggccttgcactgggggagcccggcaatggtgtcctgaaggcacactgctttggtgagtgacagaccggtctggaaaaattgggcggagatctctgggcctcagtgtcctcatctgaaaaatgaagagactggattacatactgtctcaactccttgggtatagtcagtttgggtccaacgttacatttaacagaaacaaagtacttacagctagatggacttggacaatcatttcaatccttccctatctttgaaattagcagtcaatagacaaagtgggtacattcatctcttgggtattctttctctttctctctctctctgtctctgtctctctttctctctgtctctcctttctctccctccctccctccctctctccctccccctctccctccccctctccctccctctccccctccacccttcctccctctctccccccactttttccccctctccctccccctctccctccctctccccctccccctcccccctccctccctctctcccctccctccctctctccccccactttttccccctctccctctccatctccctctctctctctgttagttcattttcacactgctgataaagacatacccgatactggataatttataaggaaaaagatgtttaatggactcaaagttccatgtggctggggaggcctcacaatcatggtggaaggtgaaaggcatgtcttacatggtggcaggcaagagagaatgagaaccaagtaaaagaggaaaactcttctaaaacaatcatatctcatgagacttattcactaccacaagaaccttatgggggaaactggccccatgattcatttatcccccactgggtccctcccacaacaggtgggaattatgagagctacaattcaagatgagatttgggtgggcacacagacaaaccatatcactgtcctcactccttccccgttaccttcttctatcctctttttctctctttctttccccccttttttctcttagtttcttgcaatatatctcactttttattctctccctctctgtaccttactaacatctctttctccttctctgtttctcttcctcactttctctttctcatcgtttttctctctttctgtctccgtcttcgtgttttgcttggtacctccttccatctggatctcttcctcctccctagttctcttcctctcttctatcctctccccttctctgcttctctctgcctctgtcttacaaaatcactcaggatttattatcagctaaaaaaataaatattaaccatccatcttttttgcccaattcacagtgaatattattggtaaaaaaataagccacacaaaataaactgacaagagctgaaagcacacagggtgaaatttggtattgactaaaaatccatagatgactcaaatcttcttagctaattttggatctctgtacaattttgacccaggagaaatggacttgacttggtggaaataataaccacaaaagaaaactcaaaatggcagaagttataaattagtaaaatttgttgtggtccaaatcctgatcgatgaagcaaatatttataaaatttaaacacaaaagaattgaccccagtaaaaatgtttccaaaaaagttggaaacaatttaactacgctatgcaagacatcgatcgaggaattaaattagcttaagggagtttgctttgaaaaatgcttcctttgtgaaaattcatcaatgttggtataactctgactttagagtttgtattcacaaacccagaatcaaaatgtgattctaggccattttcccaaagccagttttagaccattctgtgctgatggcaggtagtccctgtataggttgagtgtctcttgcccaagtaaacaatttcaaagcttgtcatgcctcagtggtgccatttctggggatcatgaatgcccttccccgatgggtacccggtggtgatccacacctccactgcttctctgcataatgataccaccactgccagataatctcctaaatcccaccagcatctgcaattacaagcaaaacaccttcacttccattttaatccatccaacagccagccctgtaataagttattatttatttcccatcttacagatgagaatactgaagctcagagaggtcccatgaccgggcttcactcatggagctggtgaagataaatctgaattgtgttccctgttccacagttgcccaaacatgccaactgacctcaagtgctaatgtgttcctcttcctggcaagggtttggtttgatctgaaaaaaatatattcagttatcatcaaagagatgttttaattttcagtaacacacacacacactcatgtgcacatgctggtttcattaattcatcaagacaagcagtgtcttgttaaaggcttcttgaatgttaatgaatgaataattaactttaactatataattagcctttaaatgtgctgagacccccagagagcatctgcaaacatgcataagaagatgatgagctaaaaccggaaacttttgattaggaaatgtcaagccgcttgataatacaagttcccatccctaatgtgtccatgcctctactgtggggtatagtcctccccagggtagggacaattagatttgccagtaaacagtcttggggctaggattggactttcaaggccattgtgcaggtataagagagacccactgactaaaggaatggggtcagatctacacacttgtgaaagctgtagcagctcttgagagctgtcaataaggatggcaggaaaccactaggttaaagtagcatggggcacatgtgacatccgtccttaccttgcttctttgctaatttacagagaggaggtcttatttccccctcttgttctgaattactgtcatttctaatcatttgtgctccttgaggactgccggtgatggagaaggtaatggcacccgcacagccactaagatgcctggcagggggtgagcctgtcatgtagccagcatagcatggcattcttttgagctccagcactgctccagccctcatggtgtgaagccaaggtgtctttggtctgtcgcagacattggagaagagggatcgctcctctccaacatcttctatagggagtggaggcagaaaggtggcatggaccccagtgtgtcagatggtgtctctgtcctcatcacaggcaacatcccacagttctcagacctgacctctgaacgtcctcctgcccagtgggagaaacacaaccctggtacctgggtaggaactgagaatgtggcacaaagacaaattcctcttcaaaaaaggaagagaacatgcaccaagcagagaagagtaaatgggttcccttagctgtgtgttcttaactgggctttcagttggatgctcttggttctaaggaaccagcccctcagtggtgttccaagccagtgctgcccataccaggctgcagcctaacacgtcactctgagtccagcagtcgcagctcaacccctccaaatgccattggtccacatcagaccaatactctgacactgtctactatggaaattaagcacttgaaatatggcgggcttccgtttcaggtggccttttttctctttcttaccctccatcttcaacaagaagctatggccacctatacctacatgtcttccgatggactggagtagactatgttaggggcaagagttttctatggaggtaactgcagccccttagatgactctgtggctgttgggaacgagacagatgaagtggaacaacccaccacgactattgaaactccggccgctctggccccatccttgcctcttctgtcaaaacatttggcttatttatagctaaaaccccccatctgaattttctaagtaatagagctgcctccatttactctacaagtcttatggatagcatggcttggtcacagtggttatgtcagtggtctttggtgtcagactgcataggttccaatgccacttttgacacgtatgggctgggtggtagtgctgagtcactttactgctcaatgcctcagtttctccatctgacaatggggatggcagtagtatgcccatccctgcacaaggagaaggaccaaaaaatataataatgcatataaagtatgcagaactggatttctcctataggatccataaaattggtgagcccctttggcataaaatctgaatttgattgaatgcatttatgtgtttcgagcatttgttatgttctgagcattgcacacatactttacttatataataacactttattcccagcagccctctaagggcaaatattgttggctccatttttctttcttgtttttttttttgagatggagttttgctcttgttgcccaggctggagtgcagcagtgcagtggtgcaatctcggctcactgcaacttctgcctcccgggttcaatagattcgcctgcctcagcctcccgagtagctggaattataggcatgtgccaccatgcccagctattttttttgtaattttagtagagacggggtttctccatgttggtcaagctggtctcaaactcccgacctcaggtgatccgcccacctcggcctcccaaagtgctgggactttaggcgctagccactgtgcccggcaagttggctccatttttcatagggaaaactgagcctgagaaatgcagttgctttgcccaaagtccctgttgacaaatctcagagatttaggggatttttttttctttttaacaacaggaacaattattttttccaatagaaaacggatcaaaagtagactttttgggtcagagcaaaaagggagacccagagtcctgctccctaagccttccccttgcttgccacagaacagctagggctgtgccgcaatagcccataggcacgtgggaccccctacattacaatctaaattaatgaaattaaatgaaatttacaactcatttgcactaaacatatttcaagtgctcgatatccatagtagatggtgtcagagcatttccagcattgcagaaagttctattggacagtgttgtcctagagggttttataatataaagtctggaaatatcaccaacaagccccaggctgccttaggctttctgaaccttgtctgcttatagacagaatagaaaaataataacaataataatatcttgctactggacagttgtgaggcctcagtgggatgatgtctgtgaaatgctaagtattattttataaaacatcttgcagacaatggccatctctttttttaaagtgattattagtgattccatttgttattatttattttaattcatagtttgttcctgcatcagtttgctcaggataatggtgtgcacctccattcatgtctctgcaaaggacatgatgttgttctttgtcatggctgcatagtattccatggtgtatatgtaccatattttctttatctagtctgtcactggtgggtttgattgaggttgatgccatgtctttgctattgtgaatagtgctgcagtgaacatatgtgtgcctgtgtgtttataatagaatgatttacattcctttgggtgtatacccagtataggtctttgaggaatcgccacactgctttccacaatggttgcactaatctacactcccaccatcagtgtataatcttttctttttcttcacaaccttgccagcatctgttattttttgactttttaataatagccctttctgactggtgtgagatggtatctcagacaatgaccatctctctgggaggggactgtgtatgccccaggatatttttaaacacgcagttgtctgtagcccattgtgtgtaggccccagctctctagaatctagaaaccagttcatgtggccctacagtttcctttctgtgttgtaatcacttcagttctgacatggccctaagatgacagtcaggccatggagggctggcccaattgtgtgcctccatggccagacccctctgacagcatgaccaccagcccaccccagtcatgccaatgtgtaactgctttggtcagagtcaaccacatcttttgcagctgtcctgcctctgacttttcagcattgtgcttttataaactttgttcccaaagaaaacttcctttattccttgtactcatatgtctgtctgttgctcagctcaaaaagacctgtcatgaaatatggtactgatttgaagatgtctatgcctgtccataaaataccaacttaaactgcttctggacaactcttatgtggttgctaggtacgtgtgtagatttccagcctagcagcacctcagtgcacagtggcttagcaggataggagaaggtttcaccccatgaattccaacagagggccctaatgtttgaatgtgcccatgtgtacatgtgtgtgtgtatatgtttattttttgaggaatggagagacgagagttgggtggtacttagaaagtctaaataaaaccaagtttctatatctccatggcaacatggatacgggaagtattgacgttgcaagtatctcagctttatcaagagaccaacaccttccacggccctaagtccttaggatacatgtgttatccagagtttcaatttccctatggatagccacagaatgtgactgttggctcacacaatcttagaataccacagctgaacaagtgtctcagcaagaccacaatgaacgccacctctcacagaggagaaaccagaaatccaaaaggagaaagtgactttcctgaggttgcaccatcatcctagcctagactagaactcaggttcctttcacctactactccagtgttcctgttacacaccctactcccattatacacaagttacttttgaccttgtataactctccatcccatatttctgcaggtctcactattgctggctgttcctcttgacttgctgtcatcaagccaagctctaggttgctccaggttacgtatgacagctctaggttaccatcgctgttgccaatcagtgcccagttctcttctgctgctgcttgatctgattccctttaatactctcagagcctaaaaccaagtctctgatacccctaccttgagatcaaagcttcagagtgtttctgtggatgagacaagtcctacagttttgcgccacctcaaaccattatagaaacaaaaaaaaattaaaatgaagaacacggctgtaaacctgccaaatagttttgttcccatagggagtccttcggcagctgtctctgaaaagatgcagtgtttcacatcctctctttgccatttttatttttatttttttgcttcactgttttatgttttcttgttaaagaaaggcaataaagttgagaaagtgtcatgaagttgagtcatctccgatttagttttcttacccattttagagttgagacattcatccctgcattccacagtgatcatttcagcctcgttaaataactttaacatttggaaacaatatccaggactactgatagggatctaatcataattagcacctgtaatcccagcactttgggaagccgaggtgggtggatcacttgaggccaggagttcaagaccagcctgaccaacctggtgaaaccctgtctctactaaaaatataaaaattagccgggagtggtggcaggcacctgtaatcccagctatttgggaggctgaggcacaagaatcacttgaacccaggaggtggaggttgcagtgagctgagatcgcaccattgcactccagcctgggcaatggagtgagactccatctgaataataataataataataatatttaggcacagttgtgcccttggagagattacctgatgcttattttctggggtatgcataggatttctaaggaaatgataacattccacattttgaactgcatggtgatttcaaggatatatacatatgtaaaaatttatcaagcattttattacacatacgttatacctcaataaaaataagtgtatcaaaaaagaatttaaaagtgctatgtgtattcacatggaaatatattcactaggtatggaatgagagaagaaagcaatatgtgaaatagtttgtgtggcataataacattttcgggattaaaacaagggttggcaaactacagcccgtggacccatctgttttcctaaataacattttatcggaacacagcaaagttcgtttgtttacacattctctatggctgctttggcactatgtcttggtttcctagggcagccataacaaaggaatgcaacctgagcagcttaaagaacagaaatgactgtctcgcagctctggaggctagatgtccaagatcagggcatctgcaggaccacgcttccaccgaaggctccagggagggatctgttccaggcctctctcctgacttctggtagttccttggcttgcagcagcataactccagtcttcatatggcgttctccctgtgtgcatgtctgtgttcagatttctccttttaataaggacggcagccacagtggattaggggttcaccctacttctgtatgaatgttaggggtggacacagtgcagccccataacaccctacaacagcagagtttaatagctgcaacagagacggtatgtcctacaaagcctcaactatttattatcttgtctttatagaagaaagtttgccaatctctgtgtatgcgtgtttgtgcatactcactaaaacatttggaaggctgttcactaacatgttaacaaaggttgaatctgagttatagaattataggtagctttaattttaattgtatttttaatacttttctatattatttggatttttaaaaattctgcaataatttctgtatgataaataagcagcacatgtatttcttttgggaggaaaaaatattcctatttagttcctttccccttcatacacactaccaccaaattcttctgccccttagtggtttattttgttctgatgcaaacctttctaaatagggcactgtcctccaccactgggagtgttaaggacaaacacttagcaaaccagcaaactcaactgtttactcacttgggtatatggatccttcatgtctttatttagctgcctcttgtaagttggagagaaaaggttctggcttttatctcctcattaaaaatagatccttttatgatgaggggatggagaggccatgagtcatcatcaccagcatgaaagaaagtgtgggatgctttcaggatcaggcctcaggagctggaccccgaggtggtacctggccacccctatgaccccctggtttcttgtcatttcaggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtaagaccccgggtgacccctttctttagggggacttgagaccctcacactcgctttgtttgctcctgggcttcccagtggatctttgcatgatgagtttgctccctaaaaatatttactgagttcctgtcacatgaaaccatggttctttaggttgcttataatggaaagcaattctagataactaaatttaacaaacaaaagtattctaaggatacagtctctctcaggggatttaggaaagagttaaataggtttagaaaaagacaagagccaggacagtcctggtgccttaagtgggaatttataggtcttctgtctagggcagtggttctcaaagggtgaagggcaattttgtccctcaggtgacatttggcaatgcctggagacacattcagtgatcacggctgggaatctgcttgctgatctaatgggtagaggccagggccagaagatgcaggaaaacaccttacagggtccaggacagccccctacatcacaaaacacaaaattatccaacctcacatgttggtaggctgtggttgagaaacgctgctgtacaaaattacataactaggctgtaatcagtcccaatttcactccagagaaaggatttctgatgcattttgaggtcaaagactctttcctagacttatcaggcatgactcacggtggagtcatgttgtaccaacatggcaactcatgttcttatcccgtggaggaatgaaggaaaggcaatctctattgcagtctaatgagactgtggcatttatagaactgtaaagccgcttgggccagctgtgtcaccagaagcatttcctcctgtctgccctttctacttcatagctggtgatctcactatagcccggggtttcctggcatggcctctagaggctggccgtggcttggaatggcaggttggtttcctttcaattgccaacacggaggaaataggaaaagcaaagtcagctcagatagcaggttaacaccaaaaatgagctcggtatgaggaggatagaaaggctcaagccagagggcagaagccccgttcaaatagtggaggctatattcagagatgattacagaacgtgttatgccaggctacaggtgggagagaaaaatctagttaccactacagtgaaatgcaatatcaaaataggcagaggttagctagtgcatagggttagtgtgaattcgaatgaagtgcacaattacttgtggcttcttatcttctttctattcacagagttaaatcctagattctcacagtgccatcaggcattctaaatgtgttttatatttaactcccaaatgagaacatgtgagtctttgaattctccatagggcatttgtaccttcctcagatcactggccatgttctctgctgtgtaataatgatttgtggctgtgttggtcagctttttgctgtgagatcttagaggcgtacaacagtaagcatttattttcctcatggtagtgcaggttgagtggagaagctctgcctggggtggggatagtgcctctgcttcctgccacaagcgtacgaatcagtggtgtggtctctgctccacacgtgtttctgctgtgtctcgggctgaaaaggtagcagctacctggggaagctcttttcctggccatggcagaagcacagaaaggaacgcctagctgcacatgcacatttcaagccactgcttggtcacgttcacgtctgctaacatccttctgtccaaagcaggtcaggtggccaagttcagggtcaagggattgcaggtatactctgcctttcatgagataggtcttgaagttttatggcaatagtgtggacactgagagtatgctgaagaattggggccaaatgttttgcctatcacaggggtggataatcacccttacaggggatgaactattcagcaaacaggagtcttatttccagcattacaacaaaacactgaacatcacaggtaaattggtcaataaaggtttgaatgaataaatacatgtatggatgaatgattgattgatgttaagatgtatttcatttggctggaaacttttaaatgtgataggtatctgtcaaataagtgagttctaactctagccccacccaccattggtgtcactctcgaagcatctattataaaacagctaacatatttagggacttgggtatgtcaatcatcatactggatgcattacatacgttcctcaatgtaatcttcgtaaccttatgaggttaaatgttgcttattcccactttacagaggaggaaattgaatctcagagggcaaatcccctagctagtaagtggcaaagcttctacttcagggaccttactctggaagggggccaattagggaagactgttgttatatttaattctctaagttatctatcaaagatgactaaactcttgagatgtataaatcctttaggaaggagtaatttagtgcacatctgaactaaatctactgtcccatttacaaatacttctatgaaagaagtgatcttttttagcctcggtttattcatctgtgaaagggtacagaaataattacctaataaggctggtgtgaagatgaaatgggagaatacatgtaaagtgcatagcttagcttagcatagaccctgtaacatacaagtggttcaataaatgttagccatcaccattgtagttacagaaaaggggtcccaatgcagacctcaagagagggttcttggatctcatgcaagaaagaattcagggcaagtccatggagtaaagtcaaagcaagtttattaagaaagttaaggaataaaagaatggctactccatagacagagcagacccaaggctgggttatttcttgatgatatgctaaacacggggtggattattcatgcctcccttttttagaccatatagggtaacttcctgatgttgccatggcatttgtaaactgtcatggcgctggtgggagtgtagcagtggggacgaccagagatccctctcatggccatcttggttttgttgggttttggccagcttctttactgcaacctgttttgtctctcagcatggtctttatgatctatatcttttgcccacctcctatctcatcttgtgacttagaatgccttaagccatttacgaatgcagcccagtaggtctcagcctcattttacccagctactatttaagatggagtgttctggttcacacgcctctgatatcattattatcattatcatcaccaccaccatcaccgtcatcatcatcatcatcatgaccattgccatcatcctcattaccacgatcatcaccaccatcatcatggccatcaccaccaccctcctcctcctcttcatccttctccttctcatcatcaccatagttgcccgtgcacaactctagtatcaaacacaacttctttagtgttgcactggcaataatgtagtcaagttagtaacacagaaacaacttttgtggtgctaaacagaaaaggtcttctttgcaccaaataaaaaataaacagtaaaagcatccagatgggccaggggtttgttcatgtacttacagaacatctaggttctcatcgatattttctgttctggctcattgccttcctggtcagacttgggtttgggaaatgtctctattcagcttcatctcttgaggccatcgggaggcataagacttgggagagaaaatgccattggtccagggggtgtctccagatgatcttcccggaaagccatgaccaattctgaatgtctctctaggagtaaatacatgaattaacacagctgcataaatatttcacttatcgtatgcagcttcagcaggattaattatgctctaaaattagacgtgtaaagagcacagtgctgagcagtacctaattattcatcctctagaatggagtgtttatctcttgttacacagtagcttcagtggacgattatgagtctaatgagtgtcaaaagtataaaaaattttcctaatgagctgtgtaaatataacctttgaatggagtgtttggttattgagggaacctcttacatgaagcctgccatgcatttccctaggaaaaaggctgttcatctgcctggaagcatacacaagatcctagcaagatgttgccttccttttccatctaattgtctgtggtctttctaaaatgatagagtgcaccatggcatctttggctctcagtactggagtaacaatgctcatgcatatgtttcagcattgctcagcatcgatacccaacatttactgagaaacagatgttttcgtaggcactgatattcccagaaggggttatcatggtctttttcttcttaccctcaatgaacttacagtccagtaggctgacaaatgtataaatgcaaaacatctaatcctaaaatcgaaacgtttctagtaattcacatatataaatttatatcacacgtgtatatatacacatatgtagacatacatatacacacgtgttatgtatgtggtatatattcttatgtatgtgtatatatatacatacatatatattcttaggtgtgttgggtagataagagaatggtcaaggagaaatacgagacataactagtatctttaagaataaaggacagaatgattcataaagaaaacacgtgtggcaagatttagacaaagaatagaatgggccagggttcacagaagactcagccatttattcatccagcaaccagcaactctttattgagtacctcgattctgcttggtccctaaaaggtaacacttgagtgagaacctgaagactgggtaagccttggacttaaagaatggcatttctggctttgaagtaaaggtgaacaggggatcccataagtcccatctatctcatgcattttgtgattttcaaaaaaatgattgtggggtttgaagaagcagaagaaagaccataaaggtcaaacccttctcatatctgggggccagaacaaaagatactgagaagaacaagaatgcctaattttattattcagtcacaagtgatgctgagaaaagggaaggaaaaaattgttttaggtcctctcatctatggttcagcactatgccaagcacatcacatataatatcctagtaagcctttatataatattctggagtaaatcttattatctcccttgcacaaagcaggaaaatgaggctccaatgagtaaagtgaactgcagcagagctcattcagctttaccatgagcaagaatcacgtgaggatcttcctaaaacaaagactgtttcagtgggtctagggtggagcctgagacccagcatttctaacaagctgccaggtgatgctgaggctaccagccaatggacaacaccctgttcagacttttatagaggtaacaattggctctagttcatctgagtccaattctgatcatttcctactaaaccaagctgcaaggagaaacctggtttgcaggcggccaggtcagcttagctataagtaatactttttagtattgagaagcgtttaatcttcttctttgtattttgctcagttttaatggttgtggatttatttttaaactccaatagacattactcatccctgacatctagtctgaggtcatttaacacataaaattaaatgtatatatttatcatgtatgttaaaaattatgtatatggcatattcaattgcacctatatcatatttaggtatatataatagatatgtgaagtatttgaaagatatggtacacatatctctcgcattgatattatattaggctaggtgcagtggctcatgcctgtaatcttaactactcaggagcctgaggtgggaggtttgcttgaatccaggaggtcaagatcagcccaggcaacatagcaaaaacccatctctacaaaaaaattttttaaattactgggcatggtggtacatgcttgtaggcccacctactcaggaggctgaggcaggaggattgcttgagctcaggagtttgaggctgcagtgagccatgatcatgtcactgcactgcagcctgggtggcagagtgagaccttgtctccaaaaaataattacattaatagagtgaccaactcaaccaatgttgcctggactgtccaagttttaaaactagtgagtgaccccagttatatcatatttgtacatataatcatatgttaaatatttgaaagatacacacacacacacacacacacacacacaattttacttcatcaggttccctctgttccttttgtactgcaacttttgccagcaataattttaaagactcatctagattgttaacagattggagaggaccacaaaccctgctctcatgttaataaggaaacttcctgcaatggactctagagttttaatagcaccattcagcataatgatgctcacagatcttggagtgggggagccttggaagtcaatggagaactcactttctccctctgagtgggtcagtgttggcatcctgagtcctttttttgttggccttgtatcttccactgaagcatacaagatagcttttgacggcaggggaccccgtgctggcaggcagaatagaaagtgtttgtgtggtcacagaagtccttgtatctaattagaattctcataaattgctctgggccgctggatgggttgctaatatcctcaacactgcccttgatcaacttcccagcttaatatctttgggctgacatccgagtctggggtagagctggacagtcccacagctcaggcagtgatgaccacacatgtgtccattctgaggacggcgtatccctgagaggccttcacagccagtcttcttagggctggcttaggaatggtatgacagtgtggactggggaaatccttgaatgccccttacccctgaatatttttccctttcaactttctacagcatccagaatttcaccatttgaaattttttttttagataagtgtggattgctgcatgcaacaccctataaaaatggaattcctccttccctcttttcctaaccccatttcctgatatgacatctcatccatccttcagcctctgcgctcctctgtgaatactcccataaagacctctaagctagataccctgcctgtgaactcccttatctctacacttgtggcatttagcaaagcaagagaagtgaaataagtaagatgaaggttctgcagtttcctagtggtgtgacctggggcaaattaatttcttagagtctcatttttctcattttaaaatcagaattctttaaggattaaatatgaaaataaacataaagaagctagtccatgcctggcacacattagatgccattgttggcctctccatgtgccctgggccacttgagtgcactgcattatagattcctcgagggcatacgctatccatgtccacccctgttgctgttcccttactgcaggactcagtggagcttggcataaacaaaatttgtttaatgaatgaacaaatgaatgaattagaaaatactgcagatacacttttgcaagtcttatgtcatcgatttaataccttctttaatgaaagggaccttattttctttagaaaggacactagatacctctagagagagagatgcaaggaggtaatcactgaatcactgccaatcttttgacagtcttcccaggcatcttacctctgtattcaccacaagatagaggcaaattcctccattgtcttatttgtatattataatagtcaaatatccctgtattatgctctttaatgcaatatatgcaatatgcatatgaggcacatatatgcacatatttaatatgtgcaatatgaggcatataaccaacagaattatatattccctggcttttacaactgtagtggatcataaattgctacttagtccagtaatatggaaactgaagccacagaggggatatgacctcacctaaagatgcacagcgagggagtgcagagttggggctcaaacccaggttctctgcctcctagacaaattatatattaaaaacaaaacaaagggaacacaaaaccagtgatggtcctttgttctgtttctttgggaaagacttgacctctgcagtagaagtaatggtcgtagaggacagttggggtatctccaggcatattggtcagcagccccatccaaatcataaaagcctccagtagaatgagccttgctgtctcccaggcaccctccttccctgcagcacagtagaggcaagacaggagaaacaatgtggactccaaaacatgtgctttgtttatttcaggcaagactgcatgctaatgggagaacagtagacaagtttcatatccatagtgttcccaggcacacaccactggtttatgtctttctttgacaaaccagccctgttcacagtttctccctttcttccatgcaaacctcttccaaactgtagctctaatgccttccccaaggaggggcttgtgaaataaagctgcgttgctccacccttgacttttgctgttcttcactgatgtggttttgttcattgcaatgtcattagcatgaatagagaattctaaaaccccaacaaccaggaatgataattgcacagttttgacttagccagaccctttgccaaactggatcgagctcctactgtgttctttgctaaacttgctgctgcagtcctaagaatttaaacactcaaaagcgtcctccttaatttatttatgtgtttgtgtgtgtgtgtgtgtgtgtgtgtgtgtgtgtgtgtatgtatgtttcatatatcttatcaaccaaggtttgttttccaaattctctaaactcagacaggaattcaggcgttcccacataatagtcagcaacataagtcagaactcatggttcttccatgtccaccagatctagggagggttctggaatatgggattcagtctctttaatcaagaacctgggagagagggactgtaccttcaggggcccagaaattagtaccatgaggctgaaatctgttctttagtctgctggtttatgatgaagagggcgaccaagaaaaaatagtatttcccttagcatttatcaaaacccatgacccaaatcccggttactgcctggttttgaaaatgaagttttattgaaacccaatcacatgtaaagcctagtcattgcaacagaaaccgtaaggcctgcaaaggccagtatgtttattatctggccttttacagaacaagtttgatggcacctagtctagactgtctggagacagataagaagggcagagaaggctgggtgcagtggctcacacctgtaatcccagcactttgagaggccgaggagggtggatcacgaggtcaggagttcgagaccagcctggccaatatggtgaaaccccttctctactaaaaaatacaaaaattagccaggtgtggtggtgggtgcctgtagtcccagctactcaggaggctgaggcaggagaattacttgaacccaggaggcggagtttgcagtgagtcgagttcgcgccactgcactctagcctgggcaacaaaatgagactctgtctcagaaaaaaaaaaaaaaaaaagaagacttaaagttggttgtccagttctcctaagagaagggagaagatgaagatgagaacaagaagaaagaaagacaaatagtgtggggaaggaaaaagggatagagatatatgagggagaaattagagggggaaaaaaggagaaggaggtggtaataataaaggataaagaagagaaaagaaggccaggcatgatggctcatgcctgtaatcccggcactttaggaggccaaggtaggtgaatcactcgaggttaggagtttgagaccagcctggccaacatggcaaaaccccatttctactaaaaatacacaaatcagccaggcatggtggtaggtacctataatcccagctactctggaggctgaggcaggagaatcacttgaacccaggaggtggaggtggcagtgagctgagatccacaccactgcactccagcctgggcaacagagcaagactccatcccaaaaaaaaagaaaaaaaatagagtcaaaaagtaaggagagagaagagaaaggaagagagagaaaaaagggaggagtaaagggagagagaggcaaagaaagaaggagtgggagaggtaagaaatgtttgctaagtgatagttcaggcaatgtttagcctgtgcatccacagagcaggctagttttattaaactgagaattagccatgctgcagatgaaattgaagatgtctcagagccatccgtgcttctcctcggctccggtgtgttggtacaaggcacagaccaccagatgactcactcctgccttggagatgtctaatctgtctttcgatggcttccctgccagcaattcttcctgacataggtccctgtgtcctcagatgactcagcaacacccattacaaccagcagcctcagcccaattaaagagataaatgcaaagtaaaaatagaggggagaggaactgcagagcatctgaaaacctcgtttgagaggatgggacagttttccatttctccacatggaagtagttcaacagctaccatgattgttatagatatttgtcataataagtaacacgagaaggataactacatgtcacaaaatcatctcagtccttgtatgtatttatccatgaagagagccaaactctgtaaaatattcgaagaaatctattctgagccaaatgtgagggccatgacccaggacacagccccccaggaggtcctgagaacaagaacatgtgcccaaggtggttgggctacagcctggttttacatgttttagggagacaaaagacatcaatcaatacctgtgaggcatgcattggtgcagtctgatagggcgggataacccgaagtggggtagagggtggggcacaagtaaaaggtagagtcaaagtccaaagattttctgatttgcaattggttgaaagagttaaattattatagaaatgcctggaatcaagagaaaggactttctgggttaagagaaggagttgtggagactagggttcttatgtgcatgaagcctcagtgttttctattcagacctctaaaagatgctggattctcagatagtctcttcaagattgggagggcctggaatggggaaagatcttgttatgttaatagagaatatatatataagatgcatttttccccaacaagaatggctttgcaggccatttaaaaatacggcaaagaaacatatttggaggtaaaatattttgacttcctcctttatctgtcatgtgatgttctgccaaagttggaaactaagccatgttatatagcatggaataaaacccctctgacaagactttattgtctgtaggatgtgactcttcaggtcccttagatagggctttgggcaagagaagaaaatggtcggagtttggtccttatattaatttcatttgcccctcacaatgactaaatggcatggagttataattattcattcctatttacatatgaggaaactgagtcacaggtcagttaagtaaggtgtccaggattatccagctaagtgggagatctgagattggtacaattggtacctatgcaggagggcgccaggatctttgctttaatctttacatgatgttacttctttagctgctataaaccctcatagacatcttggaagacaggtggttttctcatctggaaaggggcaaggctgtgatttaaacacaggtaggtcacaccccagagtcagtgctccttcctcttttactaatgaaacagcatcattaccctgcagaaggtactgggcaaaatcactttgcgacagaagtttagggtgggagagaaaatgacctacactttttttccattgttcatggtgaaggagactcgtccatgcctcaggccccagcaccgtgggagcaggcccagcctaatttttgagatcattcaaccctgccagtttggggaaaactaaggacccagaagcaggagatgagaaggaatgaaacaaggacagaatgtaattaagagaagtcagatgtttggcctcgatacaggcttgcaaagcagcctctccaggttcacaaagacctgtcttggttgctggaattgcttgttccccacagagcttcttggagctgcataatctccagaatttcagaaagttattgttccttgctaaacgtgttttaatcaaattgagacttcaaaggcagaaatcacagttggggatgagctgggctagtctgtaaattactaactttctaatcaagttaggaagaactgggtgccattgacaacccccttcccatgtattcacccatttgttcattcattcattctcccttctagtcatcgattcaacaaagaacaactgagcagcttttaaactccaggtggtgggatataaaaatgattaaacactcctgctctattgcccttgcctatggagatgcttttgacattttgcatccaatagaatcacttggcaagaaaatacagacacctaattttcacctcctgtggggcatttctacatcctttctgggtgattctaatacacattaagggttttttttattgaaacttatactttttatctagtgttctaaattgaatctccatgtacataattttataatattttataacttttaagtgaaaattcttaaagcaggcatttgctccctttacattatatatatatatatttaattatactttaagttttagggtacacgtgcacaacgtgcaggtttattacatatgtgtacatgtgccatgttggtgtgctgtacccattaactcgtcatttaacattaggtatatctcctaatgctatccctcccccctccccccaccccacaacagtccccagagtgtgatgttccccttcctgtgtccatgtgatctcattgttcaattcccacctatgagtaagaacatgtggtgtttggttttttgtccttgcgatagtttgctgagaatgatggtttccagcttcatccatgtccctacaaaggatatgaattcatcattttttatggctgcatagtattccatgttgtatatgtgccacattttcttaatccagtctatcattgttggacatttaggttggttccaagtctttgctattgtgaatagtgctgcaataaacacacgtgtgcatgtgtctttatggcagcatgatttataatcctttgggtatatacccagtaatgggatggctggctcaaatggtatttctagttctagatccctgaggaatcgccacactgacttccacaatggttgaactagtttacagtcccaccaacagtgtaagtgttcctatttctccacatcctctgcagcacctgttgtttcctgactttttaatgattgccattctaactggtgtgagatggtatctcattgtggttttgatttgcatttctctgatggccagtgatgatgagcattttttcatgtatcttttgactgcataaatgtcttcttttgagaagtgtctgttcatatgcttcacccactttttgatggggttgtttgtttttttcttgtaaatttgtttgagttcattgtagattctggatattagccctttgtcagatgagtagattgcaaaaattttctcccattctgtaggttgcccgttcactctgatggtagtttcttttgctgtgcagaagctctttagtttaattagatcccatttgtcaattttggcttttgttgccattgcttttggtgttttagacatgaagtccttgcccatgcctatgtcctgagtggtattgcctaggttttcttctagggtttttatggttttaggttttttgtttgtttgttttttttttttggttgttgttgttgttagagttttgctcttgtagcccaggctggaatgcagtggtgagatctcggcttactgtaacctctgcttcctgggttcaagcaattttcctgccttagcctcccgagtagctgggattacaggcacccaccaccacgcctggctaatttttgtatttgtagtagagactgggttttgccatgttggccaggctggtcttgaactcctgacctcaggtgatccacccacctcggcttcccaaagtgctgggattagagctgtgagccaccacacccagccatataattctttttaaaaaacttttgttggaagttcatgggtacatgtacgggtttgctatataggtaaacttgtgtcatgggggtttgttgtacagattatttcatcacccaggtattaagcccagtacccattatttgtttttcctgatcctctccctcctcctatcctccaccctccattaggccccagtgtgtgttgctcccttctatatgtctatgtgttctcatcctttagctctcccttgaaagtgagaacatggggtatttggttttctgttcctttgttagtttactgagaataatggtcttcagctccatccataaggtttaagaatcactctttaaagtaacaatatttaccatttagaaacattttatcctgtgattggcagacgttgagtacacatatcagttgccatccaatcactcagttggggtccatgatattgaatctttgccctgagttttattcattctctttctctcagggcttctaattgggtttacacagagcccttggtgattgtgaaaactagaggcataaatggtttggcacttctaagcgttagtccacatgccaaccacaataaagaacataggagatatgagggtaggctatgaatggaagacgtagtcagataagctttaatgttaagcttcctcatccaggaaggatcgaaatagacatgaaagcctttattgcttccaaagatttcattttcatttattgactataataacagtgttaaaaataaagcaggcaaaactgaaaaccccacatttgggtaaagactgagccagcacttctatcgattaaatcggatctggaactagatttggacgcaatggctatcctgattccttatacgtgtagacggggtctcatgtgaaaccacggggaaagtgcagctaaagaccgttgattgagtctaattttttatgtggatttcattattgctcccacgtatgtgggtgacttttgcatgtacataaacctcatgtatacacaaagataatacactgatgatatagacatcagaagggggtgatcattaataaccattctgatgccccaacaactaagtcacttactctcctatgacccaaaaactgtctagggcaaaccatttattcagaaatgcaacgttttcaaataagagatatgtcagttctaagcatagattagcaataaaggacttaactgcttctccattggcctgtgaccagatgataccataaaaattagacttgtttatttccctcctaattttaactagagacatatttggaataataatggaacagtacttattaagaaacagataatatccataaatatcctggagagccactgagtcttcctcagtggtaaaactccaggggatttaatctgcgtaaatttgcagtgaattccctaatgggcctgttgagattcagaatcttagtgtctgttatcaatccaacaccaggattagtacaaggtcagcatgccaggcccatgcctgacaagcagtgaattgctcaaaccagagaaagtcaaatgtcaagagaaccatcaaagtggaaataagatataatgaatggcttgttggtaagtcaaacattgatgtcacataggctcgtgcaaaatttatggcatggataaacagtggccccaaatccctctcagtctatattttttaaacactttcatttggaaaggcaatatattatatatacagttgtccctcagtattgtggaggattggtttgagggtctcctacagacaccaaaatctgtggatgctcaagttcctgatataaaatggtgtagcatttgaatataatctatgcacatcttatactttaaatcatctctagtttacttataatacctaatggaatataaatgcgatctaaatagttgttacaccgtatggtttaggaaacaatgacaagaaaaaaaagtctgtatatgtttagtgcagacaccattttctccccaaaatattttcaatctgtgatcatttgaattcacaaatacagaaagggctgactgtacatataatcaccccaatctactactttaacataattgtttttaatttatgtattatctcctgatccctgttacttgcagacacatttctttaattataattattggttatatatacttttatagtccatgatttttcacttattattacattttaagcattcttatgtaactatactatctgctttcacaattattttaattttttgcataaaatgtcatcatctttattaaaccagaaaccattacattattttccaaatgctacacattttgatatttggctagtatagataacgatggaagaaatttcttcatgcctatttcttttttcttttgaactatttgcaacaaactcttagatgtagaatttaaaggttactggttctaaagatctctaggagtcttgatatatggcgtcatattgatgcccaaaaggtttgttaaccctgggtgcagtgactcatacctgtaatcccagcactttaggaggccaaggtggggggattgcttgagcccaggagttcaagactagcctgggcaacatggtgagaccccatctctacaaaaaataaagacattatctaggcatagtggcatgcacctgtggtcctagctactttggaagctgaggtgggaggatcacttgagcctgggaggttgaggctgcagagagcagtgttccttccactgcactccagcatgggtgacagaacaagaccctgtctcaaagaaaaaaaagttttgtttccatctaaagtaatagtaatagtggatcaatgtaccaattttaccactatctagcagcattaggcattacagttctttttgctattttagaaggtgcaacatgctatctcttttatataaatataaaaagttatttcatgtttcatgttttgattggttaaatcagaattctgcaaattatggcccattacatgttttttataaagttttactggaacacaaccacactcattcctgtattacgcattgtctatggctgtttttgtgctacaaaggcagagttgagtagttgtgatagagaccgtatggcctgtagtgctgaaaatatttactaattggccgtttaccataaaaaaaaaaaaaagattagtgacctctggcttaaacaataaaagtgacatgttattttgaaacaattccaacaattggaagaatttaactaaacatgactggtttccccttatccttaaagaaattttctctttttgtaaagaaatatcacgcttaaaaaagtttgtatttttctctcctctggtttagaaagtctgttttcttcaactttccttattattacctcacttaacccccaaagtaaaagaacacttatacctgtactatgccactcactgtttttttctatttgttaccttctataaactatgacatacattcgttatattgcacaaatcccaatatccagttaatttttgtacagctgtgcaactcccacccagattgagctataaaatgtgaccactatcctagaaagcttcctcatggcccatgccagtcaatatgccccccacaagtaatcaacattctgtcctccatgaccatggggtggttttgtcttcttttgatcctcaaataaatggtggaatcatacaacatgtattcattgatgtctcttgtgacattgatacatattactgcatgtaaccacagctcattattttttttcgttgctgggtggtattttatcgtacaaatttatccattttgctgctgatgggcatttacatcacttttagtttttgtctgctttggatatttttgtacctttcttgtgcacaaaggcacttattggtttggaaatatacctaggaatgaaattgctgggtaatagagcgcgtctactcaactttagtagatactttgaaccagtgttctgaaaatgtaaaccaatttacattcctgccagcagtgcaggtagtttctccaatttgcaagtgctccttttcgactttctgtaagaggtaaagctggcttgtgcaacagaactctaggtgtcttcatcagtggctgtgtggttggctgttgccaccagtcatttagagatccagattcttgccccaacatcaacattgccttattttgtgaccttggttcatgtaacctgacctcagatttaatgtcagtacaatgggggcagaggactgtggagtctgccccacttactttcctgagttagaattgatatctagcttctctgccacccgcatgtgctcttccactcatccctggccactgtctcaccccatctggtgccttagacttgggaaaagggagaggaggtcagaggagcacctccatacctggggagcgggaggatgtcatcaaaggaagagctgagagctctcctaagtcataacccagccctgcacaccaccctattaccctctatggaaagaaaaacagggtcttccttctgctttagttacggatggttctgacagctgatatagggtcccttctgtaatagttttatttctcactttctgtccttctccattcccctttttcttcctcctccttctcttccctgtcctcttttctttcctttccactctctccttctctcttcattccacaactaagtctccgatgcccattaagctccttgtgtatactaagcaatggggaatacagatcaaatggaagtgatccatttcgcttctggattttacagcttcaaggaacttgttgacaacacttcgataaaaaagaaactgaaaagcagtgagataattttacttgctgaaaagaggagctatttcttggcatgtagaactgagcaacacagcataggttaccttggagttacaagagaagcatcacacccaaatggctgaagcccctggccagagataagaactcagaggcatctccccaacctgggagaccaggctccatgctttcccactgcttcctttaaatggatcattcaggcatttgcctgcaaacttaaagtgacccgcacgctattcccttttatgtaccactagttggccacattctctctttctcgggctgactcttcattcttgccttgtgtgatgcaggagcagaaaactgtcctcttgattcattgcaccctccctgcccaggatgtgtaagtaataaatctttgagcttattttctatatggtggtgtattgaatttgcacctttcatctgaagacctaggaactaccgcagactgggttttccctcggggagactacaaggttgggcttccagtgccagagcgatgatcaggcagacataaactggacatgggtcagacaagagctgcaagggcatcagcagttataaataagttcctcctgggagagatcccctggtcatggataggaaaactaggcatgaggttgtctactaggtaaaagaagcatcctgtgaaaggcacgtgtaaacacccagatttacttcccctcgttggtcattagggcagggttgttagctgctgtagtactggaaacccagtttagccagtggctctcaaaacagcacgggatctgaagttattgctatccttttttttcttaaatctgtatgtgtttaaaacacaagaactcctttgtgatattaaaaagtcctcataaccttcccatgataagtcatcagattttgaggactattgattgagaaaatatgcaatggcaaaaagtcactatgaattcatttgtgctcacaaatgcatgtgccttttaagccatgtcagcttgaccgtctttatttgtgtgaggcagattggttaagcagattccagaagtgcttggtatataataaggtttcctggattcctacaaggtttctgccgtcttacttcaaagaattgtatctctccaacttcatccagtaatggaaaattatgaccatgtgtattgtttgatgtttgatagagttgtccaatcttttattgtccaatcctctttttaatttttcttctgaaagagacactggttgggaagctgcacaagttgtagttgggttttttgttgttgttgtttttgagacagtttcactcttgttgcccaggctggagtgcaatggcgcgatctcagctccctgcaacctccacctcccaggttcaagtgattctactgcctcagcctcctgagtagctgggattacaggcgcccacgaccacgcccagctaattttttgtatttttagtagagatagggtttcaccatgttggccaggccggtctcaaactcctgaccccaggtgatctgcgtgcctcggcctcccagagtgctgggattacaggcgtgagccactgcacccggccagagttgggagattttatggttgggaacctgtgtgcataaaatcccccaactccatccaacttgtgcgactaatcacgtggcctgtgaaatcctgcaatgtgacaagtagcaatgaacttaacaatactcaagtttcatccatggagcagaaatctcagttggaaggtggcggtgaaacatttatgccaaagacagcctgtccctgcctctaactggatacatttaagcctagccctatttttattttggttttgtgacttctcagcattatacagaaatggaatattctgacatttaaataaggaatatttatctcccaaattcaatctatttgtgtccagaatcttgtactatttcctatcaccaccaccatcaaaagtattttttcacttcggcaaatagttcagtgaccctctgagatcgtgagaacagaggtcacaggctccagaatattatttctgaacccagggttacttgggtcttatttttctctagctcatttttttttcttatttgtcagatttattgggcctttgttttgtccttttgagagtttttaaatttgtctttaaaacaacatgggtgttgggtcaccacagggaagagagaaaggaatgagtttctcactgctgcatctgggagggtggacttgcctcacatggctttgagtcaagatggtggaattaatgaagttgggccctcaaggtcaaagctcagatggtctagctgatcttactctgctccaaggccacagaccacatccccaaatctgatacacaacttcctttcatctacaggacaactgggcaaggagaggatttggccccaattctgtgtcccccaggccatcctcaattgcaggaccacaactcagaactcagaatgaccaagtctgttgtcatcgagaacatgagcctgccaatgaatctgtgccctagatttcccataaaaaagttgttcctttgccatttccaattccaatcgggcttctgagaaacccaaagtacccaacccctgggcaagacatgaaacaggattgaaatggggtcagttaccctctcggtgttcacagcgaacccgaatgagatcagcagcaacaaccttctgacgtctttcagctatagatggaagtctgttccctgtaggaaaccaccaggctctattgctgggatctttgatgagaacatactcgcccaagagccagccttgatttctgggtttcagaatctattcctcacccctttgcctggggcttctcaaacttcttcctgtcttgggctctgaccgatcctcagatctgtggatcacaaactaatcaaggagacaggagccttgtgttatccacagttggtgcaatgtcatgaaccacatgtaccaagacctgtgccacagactgggggtacaaggagaataaaacaagatccctgccctgaataaactcacctcccagtgacaattacgttccactgtgacaaattctatacaaaaaaaaaaaaaaaaaatccaggatgttatggtagaggaaaccatggcgtcatatttacattcctgtgccttcagggaagacttcctgaaggtggatacctctgagctatacaccaaagatagctattgccaagttttcagcacaaataccatgcagctggtatatccagagtagactgtaatgggttatgatattggtgacagtttacaatgaatccttgccagcagtttcttgtaagtgcgtttctcccagtcactgcataacctcggaacaggaaagcttaagctgcgtcttctgtctgactctgaaatcaggacaggactctaatagtgactgtgtcaccaggatagagttgactggtgaccttcctccacatggtagcaccattgtacacatttgcaatttgaatgagacattgcacactcactcatcacagcttacctcctattgtatgtgaggagacactggatttccaatcagggggccatgactggagaaacatgagcaacaactgaagaaccttgggtccactaagaaaatagttgggtgttcactacagatgtacatctgacggccttgctgttccctgggtaccccagacttgttagaatgaaaatcaagttcttagcattctggcttctactcttcgggctcctcctttgatcccttcttccttcccagaaatcctgaactgctctctgatctcaacactccttgtttcttcctgcctccagccctatgcaaatccaatcatctcattttgccgtaactactggttttcatgactgtctctctcacaggaatgagctcttagaggccaaagactatctgtaattcatctctatatgaaaatacagagatgtttgccacatgttaagtgctttacaaattttctcttttcaatgagtgaatgaatgagtaaagaaaaaaaacaaatgaagtcctcggaaaaccaaaaagcaacagcttccttgaccagacatgaaatagaacatcgaactcagcttctcagaaccacatactctctcttttcatctttcatcactgccttgggtcaggtgctttggcaagaaaccaagaaaaaaaaaatatgtagacgtgtgcctgtggaagctgattttagaagatatgtttcagcaaattttggacaaagcctaaagggtacaggttcaaaatggatttttcacaaatgacctcaggggagaggtacttgggaagtttgaaggctagtcacattgcttgctataaaatccattcccaaaaactgcagttcctctggaagtgctgagaatgagtcttagggcaaatagagaactaatttctcttactttggatataagagagtctccatggagagctgaaccttctccctggacttgcgttcttggaatcatagatagagtgagttagaagggcacagagagcattatgtggtccatcccaccccccagcttccctgatttcaggcaataataatatctccagaaatactgattttgtaattagtgtatgccaggcactgtgtgtatgcaacatcgtttaattctaacaaaactcctatgagataaattctgatgtactcccatttgctcgatattaaaactgaagcttagagtgattaagcaaactccttaacctctctgcacctgcgtgccctcatctgtaaactagacaagccatattaagtttacatgagttaatttttttaaactctagtatagtacctgaaggacagtctattttatgtaattttgttaaatagaaaaataaatacatgaatggatgagcagttggatagattaaagtagagtacctggaccatgatcaaagagccggtacctgtggaagccaagagtctaatgcaggccgtctgactcagatattgagtgtattaatacctgagtgtattaatacctctgtgttactatctagaccttaccagatgactggatgtgctccccaaaatcttaagggaagggtgcttccttttatatctcattctagtgttttctacctgaaacattctttcttgtaatttgctggacagtatctagttgaattttctttcattcctttttgcaaatataaaacccctggcttccaccttgtcagtgggtggatgggtaatgggagaaactcctccactgtctgcatcctgtctgtgccttttgtctaaccagccttcttacagcctgacccaagcagccagtggaatggaatggaagcaagttggagacacacacacacaacactgcctcaattatccttgcctgttcccttttagattctgcatctctctgacggttgactcctgaaactctattactctgtcttttaatgttgtcagcattaggaaaagagtgaccttgacaccttgctccttctactgaacttacagctttcctcacgatggtgcagaactaagtggttagtagagatacttgtggctggaaacatctcccctgaaaacagatataggaagaacaggtgcaagttcccatgggcgcaaagaagttctgcaaatgtgcatgagcttactgtcactggaggaggtggaaacacaaaaggagagggctttgagtgctacatggggaccagtcctctccggtggggagacaaaggcagtgtggtttgactgcaaccccaaaacttcccaggctccatctgttcccaagagagcatttagcttgtgtgttcccagcaagaatgagtctgcttcaggaaagagatttaattgccccatttatcagctctggttcacaagatcacactgacaaagatcacggcctctttttaataggagaaactggcagcagaataaatatcatagagccactccttggaaaaacgacatttgatgcttcaccctacctaaaggatgcacatttcccagccttttactctcaagcccgctgcaagttcccctttgctttgtattccttctatttatatggcagaataactcactaaacagatttgaacacttctgcaatgctgcccagtttaagcctggggatgtaagaaaagaaacagaaacagaaaatatggattcaatgctcactacgtgctgcaggccacgaaaaatatcaaaaccataaaacatggtccctgatctccctccaggagattacaatatacttgagtaaattaaaaatgaaataagaaagtatttgaactacagttcagtacgctagtcaaagagggccacgaggcaggaaatgattaatttgaaaatgattggaacaggctgtaattggtaatgagaaatgtgcatttgctcttttttttttttttttttttttgaaattgaagtctgctttaccatgttgatttcctctaaaaagaggtattgtttgggcaaagggcagaaggaaatctttttatttacatcctgaaaagaatcgagatgatgtttcttatatcagactgccctccttacaggcttacaaacctggcttggtttgaggcaacaccgaaaggaagatgttctgggaatctgatgagtcatagtgagaagacccatttttgtgtcctcccagactccaaagggtctgagcacggtggctcacgcctgtaatcctagcactttgggaggctgagccaggtgggttgcttgagcccaggagtttgagatcatcagcctgggcaagatggtgaaacctcgtctctactaaaaatacaaaaaattagcacagcatggtggcatgtgcctgtcgtcccaactacttcggaggctgaggtgggaggatcacctgagcccaggaagttgctactgtagtgagttatgatcgcaccactgcactccagcctgggcgactgtagtgagaccccatctcaacaaaacaaaacaaaatacctccaaagggaggggggacgtcaacagcacattgtatttccaaagggatggcattggtgtttttgtgagaagaggaagcagccgtgcaggtctgaggtacatggtgggcagagaaatctggatgagtttgagatagtgttggtggacagtgagatattatttcaaagtctcccatgactttgtgactgtgcgaaagcatgggaggctgttggaagaaaaggaattgaatcaagataccctcttctcatccctttacctacacaaccgattgatcagcacccatttttgtgggtgaggaactggaaagggatggatttcctatttttttaaaaaaaaactcattaacatgtatgcttttttttctggttaatacatttgagaactttaatgagtcacttagtctgtaaaaagaaaactaggaaaatctctgtccatcaaagtgaagaaaatgcaaggaggtttaccatctgtttgaagctgtcagtaagaaattaaagcccaaatgagcatgtgagttcaaatgtatgctacttaaatggtgtagtaatcaaagtaaaaatttttccatacaaaaactcatacattgaaaattcctggaaccatggcagaagcaaacccagaaactctctatagggatgtttctgtagcctagtgttcttgggagtcccatggggcttagagggaaaataattctgcagaagattagctcatggtcaaaagttacagacgtcacaaggaagtaacccaccatgagagtcagaacacacagcaaacagaggaatgagaatcccaagaactaaggtgggggtgggggggagtaatctgaaagactagaggtttaaaattattaaatatatgaaagttttaaaaacttttaaactttatataacaaactatataacaaaaggatgggatattatgataaaaagaacaggcagaactgtaaaagaaccaaatgaatatcacaattaaaataaataaaattaaaacataaagctaaatattaccaacaaaagaataaattaacgggaaaatacatctattggaaattacccaaatgcagcacagagagaaaaaagaatgcaaatattaaaacaaggtaaataacctagaggagagaatgaaaagttccacagtattttaaagttttcaggaaaaaaaaaaaaaaagatgggactattatataccattagggaattgcaaattgaaataatgagctagcactacatccctatgagagtggctaaaaccccaaacactaacactaacactgacaatgaaaagggtggtgaggacttggagcaacaggagctctctcattcattgttgatgggagtgcaaaatagtacagccactttggaagaaagtttggcagtttcctacaaagctgaaacacagacttactgtataatctagcaataatgctcctaggtatttacccaaatgaactgtaaaaactgtaccacactaatgcaagatgttaacagggaaaaccgaagggagcggggagaggtagtatatgggaactctctgtactttctgttcagtttttctgtaactataaaaccactctaaaaaaataaaatctattaactttttaaaaaagatatgatagggagaagtaatattcaaagccatagcaggtgaatttttgccagaactaaagttgtaagtattcagattgaagaatcgtactaagtccagagccgaaccaataaaacaaacccacacctagacttcacaccaaagacaaagtgaaattctcaaaagcaactagagagaaaatatagattgcatagaaagtaacgacaattagatgattagccaacttttcaacaactgccatccagatcagaggaaaatttaacatctccaaaaggtcaaggaaaaataattgtcaactttgatttttatattcagccatatcattcaagagtgagaacaaaccaaaaacaatacatgctaatttcacataacttaaaaaaagaccaatattaaatcattttgattgacttcttcaaagagaattgatataaacatttggagtatttcgttaatttttctctgcatgtccccattacatcttagagatcatgtatatacatataaaatatagtcatacttttcatttagcatacacatcttccttgatttttactgtccttgaaagatcatttttaaaggctgaatcatagtctaagtgccatagtttagtgaattgctagacagtataattgctagacatatagatcagagaattttctcctaaatggcaacaggataaaatgcacataaaagagggacagaataattctaagcatgcctactcttttcttccccccattggaaaaaaccacctggttctttaattgcctactgaagttggggggtgggtatagtttagtttgcaaggggccattcagagccagctggatgtctcttttcaattaaagttttgtgccctaagtatgctgctcatgtgtgacttttctaagtaatcctgaatgttctaaagagagagagaaaaagaaacacacatatttgaggattgccataggccaggcactgtgttaggcattttcttcacaacagtaaatagtagcaaacatactgcttatgaaaacttactatgatctgggtcctttagggattttatacattctcatctcattcaatcctcatggcgactctaggaagtatgttctattattatgcctatttcacagacaggataactgtagctccgaggccatgcagctagcagatgatcaagtcagaattgcaatgaagtctttctattgtcacgttctgcccttttattcccatgtcttgttccaagcttgggtgggtattgggggcaggggtaagggaaagcaaggtcagaaaaacataataatgaccaaaataaaaaaaaaaaaaaagacaaaactccaaaaaacaaaaccaggaactgtgctaagttatatatattatatatgtatataatatataatatatatacatattaatagagaataagtttgctatactctctctctatatatatattatattctctatttttatatataaattttgtcctcactgcaacaatattaggtaggctatgtaatcattattatcttcactcaagaagtgagcaaatggaaacccagcaaactcagaaacttgtcttaaggttacatagctgtgagttgcacatcgtctgttccaaacccagaagcgtctgccccaaagtgcatgttctggtcctcactgcctgtgaatgttgtgatctgtccaggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcagggtcagtacaccgggtggctactttcttgcactgcaagcaggtttagaaaagcgcttgggttcttgatgtctcagtggggtctgcacttcctccccttaccagcctttcttgggcatgtcacaagagcatccagattttgtgcattcataagccaggtgttgcaaacttagatgactaaggaaggcagaaaggaaacgggagtgggtgcagcaggcgggacatgagaaaaatagcacagatgacgtgaaacggcagctaaacctcagtatcaaagtgagagaacgatagggaatactgaggactgtggccaattgcatgatgtttacctcaccagtagcgtggcagccatcctcaactcctgctgagtattgtcttatgggaatgtagagtcaatattatcaggtcttctagttttttaaaaagagaaaatgtcatctgattttgttagaaacctttccatttttaaatattagtaactaattccatgtaaaaattttttggccgggcacggtggctcatgcctataatcccagcactttgggaggcccaggcgggcggatcacgaggtcaggagatcgagaccatcctggctaacacggtgagaccccccccttctctactaaaaacacaaaaaattagccgggcgcctgtagtcccagctaccccggaggctgaggcaggagaatggcgtgaacccgggaagcggagcttgcagtgagccaagatagcgccactgaactccagctccagcctgggtgaaagagcgagactccgtctcacaaaaaaataaaaacaaaaaataaaaaaaaatttaaaaacactgggccagacagagccagcctgtggctcccatcactagcacccaggtatgctgtataacactactaatgctgctatgcaagatgttacaatttgtgtatgcattgtaacagaacatgcccaacaaaacaaaatctacttgcaatgctatggaatatgtatacacatctaataaaacacaaagagcatgtggaatgcaatagcacatgaaaggaaacacaggtgtaaagtaacagaagaaaatgcacacgtatcaagcagaaaacaaagtttaccttcaactcaacataaacaacagcacaaaatacatatgtatctaccttcttatctatatgtccattcattcgtttcagccatctatgcatccatctatttatccactcatctctcttatttgcccaccttgtttttttgtttgtttttttgttttgtttgtgtttttttttgtttttgtttgtttttttgccttggaagaacttcattaattaggatttgaaaaatggtgaaaactctttggttaaaaacatctaattgcagcaaaccaacacagcacatgtatacatatgtaacaaacctgcacgttgtgcacatgtaccctagaacttaaagtataataataaaaataaataaataaaaatctaattttatatgctattgtttactgagaaagctaactaattgctttaaaacagatttgtatattcttaacatttgctagtttcaagaactgtggagattcggaaggtacacattagtttagtgaggaagatttattttctccattcacttgcactccaaactcgggttctgtgcaaatacatatttcctaattagcttgatggcatctaaacacatagattgcttaaaaataacaacgtacgtgcatagagctaggtattatgccaactttaagctaattctcccagccaattaccaaaggcttttcatatccaaatgattctgggattagcaccaaacaaatgcacactgttgcgtttacttctaaatcttgcttgtttttggaagagcatttcctctatctatctaaaacactgctaaggaagccaagttgatttatcaacattttaagaaatgaagtaaatccatatcttcctttccaaaggatgggaatggaaggcaaactgggcagcacagggcaggcattgttggtggagtcccttgatcatctagaatttgaactttggcctctccatccctaggggagaaggaccccaagttttatgggagcaatgtgcttttattgattgattgattgatttgatttgatttatttacttatttatttttttgagatggagtctccctctgttgcccaggctggagcgcagtggctcatttgtaagatttccacatccacagtctggatgctccagcagctctggaagcagtgatggcaggggcagatgttattttgtggcaggacaaacagccaaccacacattatatatagaaggagaccacagataagtttgcaggaatgcaggaaaggatgtaatgccagtgccctgagcctcagggggccttcaccaaccatgaagcctggggtggagaggatcagagaaagagcagctcaaacttgcaactgtaggcttttgtgtttacggttccttgaaggctggagtggagagactgtctactacaagaaaaatgtagcagtgaaaatgagttgaggctgtcacagttccgtgagcatccctgcagggtgagcttgtccccaccatgggggaccgatggagccaccattatcagagtccacagttaatcacacttactttcctgtagtttatgccaaagtcagcagccactgccaattctgccctacaaaccccttcatagtttggctccctgtcagccttgggaagaccaggtcaaatcctgcagccttgatctgactgtttcctgtaggtacggctgctgaaatctggggtaggagtggggagaagcaggggaagccacagatcaaaatgttccagacgtccttttgcctgttattgtggtaggaatcaagggctcttcccttgataacagttgaacagctacttttaagtgaacgtaaacagttgttttctaaaagaaagaaagagtagaaaatgagaagacatatagatggaggtgcttgtatttgggctgcccaggagcccttaagtcattcagttccctggatggatttaaaggcggtgtcactgtgtcatcagaactcttcactgtgactagtaactaaaacccagttctaactacattgaatagactcacacacaaacaaacacacaaggaatagattgagtcgattaagtaaaaaagttcaagggagtggctccaggggtttaaaccatgtctttctctatctcttgggctctacttttcactgcaatggcttcactgataggctcacacccccacatgatggtaagtctgcaactccttctatccaagcatccacatctatccccccctcaaagagtatgatgagcctcacatgaatttcatgccttcctttagatgaatcaatgtgtgcatggagaagagattttctgattggccacttaggacacattctttgattgttagcttttgcataagagtaggggtaattccagaaaagaattaacaatggatgatcctttcatgctgactgtgtttgtcagtagttaactctctggtgcctaaactttcaaagatgatgctgggaaactttaatgaaagcttggattggtgacccgggtgctgggaggctcagttatctgttcttatatgccactttggagacactgaggcattgacagttgtatgagcatcggttgataccttttctcaaactccatgtgtgactctttgcaaaggtgtcagctaatcttgagccagagcaataagataaaccctatgctttgcaacttgtctcatacctttaagagacattatcaggattcagactgaattttgctgtttctccagggctcctgcaagaagtgcaaatctcacctttgcaggtaaagttcaagtgcaaagtggtttcatgttcactgctgctgctgctgacagtgctttatgttgctcccctacagggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatatacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgcatctgcactgtagtgcgattgacatgtgcaagagattaggaagtttggctcgtaacagtttcagctttcttgttatgccttccatcacagcccaggctcaccccaagaactccaggctcccctaaagaatagcaaatcagtgtgttcgtgatgactgtgctaccttcattatagttcatttccaagacacatctggagccaaaggcccgagggaccctcaggtggggagagctacaggaatctctttggatgttgatgtgtgtttctctcaccctcggcttcgatggtcttgttcagagctgcataaactaacacatttatgtctccgagatctaagtgtggatcttctgtctgtgacacagtggccattgtagtttatcccgaagacgcctatgtacgtaagtttgcatttcctcccttctggtgatgactcagggttgtatagtatctgttaccccttccctcccagagtaaccataactcgttccgtttccaaacagccatggtggtgtccaattagctgtgtatcgctcttcccagagttgttaatgtggtgacatgcaccaacagccgtatgtgtactgtgatctgtaagaagtacaatgccatctgtctgccgaaggctagcatggttttaggtttatcttccttcacatccagaaattctgttggacactcacttccaccccaaactcctcaaatcaaaagccttcaaaacacgaggcactcttggatctaccctgagtatcctccaaactgtggatacagtttagtgagacaagcaatttctcccttctgagttattctctctgttggtggcaaaccacttcatagcaccaacagagatgtaggaaaaattcctcaaagtatttgtcatttctgagtcgcctgcattatcccattcttattctcctcaaacctgtgcatatatgacatgaaatgatatccattttttttttaagttagagacagagaggggaatacttatgcatggggagcctgttagcacagtgcctgccacaaaaacaagtgcccccgacaagatagttgctatgttatgacactttctcagatcaggattttctagtttaaaaattaaatatcataaaaccagcaaataatattaactaaaccttttatatagttctactctgttaattagtgtatttcatgtacatgaatatttttgaagtatttgggataactagccatcagtgtttgcagaagacctcagtctgttttgggccattacggaaacactaagctaatgtagactcgcctggccatttcctggtttcctcctgcattctgctttacattcttgaagaaagggataaagtggcaggttgaaaaattatcccatttcttctcctcatggtgtgcgttctgttttgtaagtattattttcttgcatgtgggcaagtgtcagggatgattcccttaaagctcaaggatgcatggaatagctccatctttgggaaagtacacctgacctacagtgttcctataatgaaaagtggttgcaataaatttcagggtcaatcatagggagacagagggaggcagtgggtgagaggagcttcctttcatttttgaaaggcagaaggggctgactaggtgctggggatgcatgtgcttgaaaatgacattttatttcccggatgctgtacctctgctgccccaagacccagccatggagaagcctggatcgaagggcccagaatagtcaccccaacatctgatcctaaatctgaatctccatgactgtgtagccttttagccctttctaccttctgcccttccagtgcattccagaccttaatccaccccagcaaggatcgcctccatttcctcatgagtctgggatgttttgacatgaatgaattaaaaagtcttcccagaatacagaagagtgatttgtcgtcaagccaaagaggctttctgtcttcctctggtgtcctctaaacccagggggctgccaaatgccacagagacctccagggagagtgagagttatacttggactgacttcatcggtcagaaagccttcccctaacagcagcattatttctgctattaaccccatacatctctggataaagaaactgaaaacgtggcctttggaagaatcaacagtaatgttgtgaaaaaaatatatattcttttcactgaccgaagtgttttttcaaataaataatcagaaatgttatgctacacaaagtttatggtatcccttctctactaattcaatgactcttcaatgtgatgatcccaagcaaaaaaaaaaaaaaaaaaaaaaaaatcaactactgatcagatggtcaatttctaaggaaaagatgtagagttattcaaaggtcatctaagtcagttcagtctttgcaaaaagaatatcaggaatgtaacgtccagtggtaaatggaacccacagtatgagaagtaacaagaattaaataggaagcctggaagcctgagactatagatctatcacagaagattcccgtaacatatcccagctctgagttcttagatttgttgatgtcaaggagcccaaatttctgaacacaaatgcctgagtttcagctggcttaagtcagagctggcatccataatgatattttgttaattctaattggttttccccacttgagaaggacccaactagtcctcagataggtacacttgaatgcaaacggttgggtctctgtccatgggtaatagcacgcacatgcaaccaatttaaaatactctgggtaagagagtcttctagagcataaactgtacttgagaaacctttgtgcttctggaaaatgggtttcatcatccttacatctgcaggttcttaggccacttatggtttcaatgctctgagctggcaagtccctataggtctatctttctgccagagagacttgcaggattataatctcacaatctcaccactcattactgttatgtcctctgcaaatctctctgcgttattttagccagcaccatgactgggcatccacggattactcttgattttctcttccctgattcacaggatgccagagagtctgagtatttagtttttctggtgaaagcattaaaattcacacattgcagcaa

SEQ ID NO: 14183 - DNA, 8230 bp, Human
ctcattttttttaacctataaaatttttatactatattttaatctataccaaaggtttaaaacacagaattgccttataataagccctcaataattgtgtatttttaacaaattctttcattatcttccattttaattcttttatttttatttttttattttttcttggagataggatctcactctgttgtcaaggctagaatgcagtggcatgatcatggatcactacagccaagacctcccaggctcaaatgatcctcccacctcagcctcctgagtagctgggacaagtgagcaccaccatgcccagtcgatttttttttttttttttttttttttttttttttttttgagacagaatctcactctgtttcccaggctggagtgcagtggcatgatctcggctcactgcaacctccgccttctgggttcaagtgattctcctgcctcagcctcccaagtagctgggattacaggggcctgtcaccatgctgggctaatttttttgtatttttagtagagacggggtttcactatgttggccgggctggtcttgaactcctgacctcaggtgatccgcccacctcagcctcccaaagtgcagggattacaggagtgagccactgcgcctggcctagttgaacagcttttaagtagcagagttaggactcatttccagagttctgtgacttccttccttccttcctttctctctctctctctctctctctctcccctctctctctctctctctctctctctccctctctctctctctctttctttctttcttagatggagtttcgctcttgttgcccaggctggagtgcacgtgccacatgctcggctacttttttgtatttttagtagacatggagtttcaccacgttggtcaggctggtctcaaactcctgacctcaggtgatccatcctcctcagcctcccaaagtgctgggattacaggtgtgagccactgcacccagccgagtcgtgtgatttctaaggtaatagctgaaatattttgctgtgagatatatatgtatatgtatctatacatatacataaacatgtacatctatagacgtgtgcgtgtcaacttattatcaatgctttgttttcttcaacatatagctattaactacctctttctgtgtttttctagatctcttttacataggtcttggagattttttttgttttgttttttgtggtttttttttgttttttgttttttgtttttgagacggagtctccctctgtcgcccaggctggagtgtagtggcgcgatctcggctcactgcaagctccgcctcccgggttcacgccattctcctgcctcagcctcccgagtagctgggactacaggcgcccaccaccacacccggctaattttgtgtgtttttagtagagacggggtttcaccgtgttagccaggatggtctcgatctcctgacttgtgatctgccctcctcggcctcccaaagtgctgggattacaggcgtgagccatcgtgccaggccaggtcttggagattttcatactctgatctggatctttattacagcagacattatttatttcccttgattttattcttttttctctttttagcttctggagcaagattgaatgtctctgactggtaattattctatagataaagctgtaatgagtttcgacacacctcctgtttcttgttttcccccctattttaaaaaatgatgccccctatattctgagactgacctgtatttccttaaccaggcctgtggcccgggatgctgaggaccatcaggtgtgaactgagcttaaaaataaattccatggctgcttttgtcacccttgcatgctggtcactctgccctcagcaggtatggatgatgacgccactcacagattcaaagaaagggcaaactggcagagtgagtcattggatgttgctggcacagctataaagatccagtggcccaagttgtgtacctgaattcaagcagtgggacaaatgagggtttggcatgcagctcgtcatcttaagagttactatcttcttgccctggtgtttcgccgttccagtgccccctgctgcagaccataaaggatgggactttgttgaggtaggtgaacgactcaggaccacattattacatggtgaccattgtgggctcttatttcgtgtgtgtgtgtatgtgtgactgcatggtataatgataaatacacacattaatattacacatgaaaacattttattctatctatgtgttcatttttctcttctaattttaagaaaaaaattaattttttgtagcccctaaaagtgtttttgggccctaggcactgtgccttctgtgcctaattcagccccattgctcatctctcactttcttagtcttctatatggcatagagtgaacactccagtatataggtctctgatctatatactggagtgagagatcaagggaaatcattcaaataaattaatgggaccttcacattgactgagtaatctcccagtcggtctaccacacactttcaatttctaaaaaaattatgaatttgctccaaacttttaagcatccaaaatacctaaaaaatgttataactggttgcagtcatgtattttgtaattgtataggaacctagtcaaatttcctgctaatgtttagtccagaacaatacaataagtcatttgcctcttagtgcccagctcagctgataataaaacaaaggcataaaaatgcagtcatataatttaaaaaaaacagtcaataggtttacgtcaagtactcataagaactgtggaataatagatcaagctgtatcagacatgagcattgcccttaaagtattttgagtccagctagcattcaaatacagacagagaaagcctaattacaatacaatgtgctttttttgtatttagaagtttacatttaatacactagactggcagaaaaatcagtggagacaaggaataggtaaacaacgggctctttaaaagtaacttaatgaaatggaagtaaatgcaaatgaaatggggaatgcagaaccagccaaattttatgtcctggagtgattgattgtatcctgattaagaaaacctccatcagtcagaaagaccagaggccatcttccccggggaattcccaggtaatatcttcctgtcgtttatacttgggtttctccatcctaaaacttggaagctttttcttttaaaaaaatgttatagtttatccatgttatttttattctgtcacttctcattcatatcatttcactgtggcataaagaatcagggatggctgccatcatctgactgagaacaggagacttaggaaggccagactaagtaccgtccttctgagaccctcaaagaaggctatgcccagggtaactgatatatgggtcttccctattgactcttagtactcatccttcttgatctgattcagggctatttccatcaatttttcctgaccaagaaggagtcgccactccttacccaggagacacaaacacagctcctgcaacaattccatcggaatgggacagacctacttgacatgcagatgcatgctctgctacaccagccccactgtggggtgcctgatgggtccgacacctccatctcgccaggaagatgcaagtggaataagcacactctaacttacaggtgcttgttactaaggcctagaggataatgtgtggggtgatgacctcaaagggctttctaccaggtctctcctggaggtacctctactctcttctgctttcattggcagcccgctcaaagcccaaaatctccctcagagaaggtaatactaccagatccttttctagcttcctctaaccatctctttagaaagtagagagcataaccactatcctttccctttgttaaatcttttctttttaattttaatgcgtgagtgtgtggatggttctaaggtacaattttgaaaacttaatttctgcctaggttactctttctgttggggattctaaatatacttgagatatctaaagcaagcagtactaaattatgtagaatgctatacattttaatttatgtagaatgctgtatatttaatttaatttaattttgttcacattgttttatttacttatttttccccaaccaccagataggactgtcattcttagactttagctgacctaagaataatttgggatattgttaaaattcttagaaatctatatttgcatgtttaattccttaagtttctgatttaattagtctgaaattagctcaactttataaataaccaaaatgagtcctaaaactattaaatgattctccccaaagtagaattattcatgtttagagctaggataattcccattcctctgaactatttcatttagagattgctttcctcaggattatcaattacccacatgatatgaagccatccgcagtgaaagacagtatatataatgcagtttccatctggagcaatgtgacccctttgatattccagcaagtgcagaatggagatgcagacatcaaggtttctttctggcagtggggtaagaaattgacatgggaagaaggatatgtatatgccctgtgtaaaggacaaagggtttccatccttaaacaaaaacctagcccccctattaaagtttctgagaaaaaaagtctgacaaaaccctactgcaaagcaaatcctgtaatagggaagacatttttagtaaaatgaagcaataaataaagaagaggtgttggctgcagtgtgaatatggtgggggtactgcacattttccttccaaaaagacgatgcatagctccgaaatctattgaaatgctattcaaagttgaaccaacttacttataaaaactttctgagtttaaattctctttcccttttcccctaccattttgaaaagaggttatcattattattgttgtctaacttgtaagctttactcagtgtctgccatctgtctgtctttctttttaccctagataagagagtaggaagattttgggccccaccttatttctctgcatagataatgccttagctctctcacatcccccagtggtagactgttgcacagtatcctaagtctctgaggcttacttaagactattctggcctttgtttctacctccaccctcattgtgatcatagcttctgtcgtccacagcccatgaagatggttggccctttgatgggccaggtggtatcttaggccatgcctttttaccaaattctggaaatcctggagttgtccattttgacaagaatgaacactggtcagcttcagacactggtaaatgccttgtttggtgggatcgctagaactctctgggaacctggggttcagtgttgatggtttccatttagggatccagagtggtcagggtgaggtggaagatttggctgaggaatcaggtcttctttataagtgaggagatgtgggatcatttctgaacacaggtgatcccataataaacacattgtcagattgtgtttttttctccttatctctttgcttctatttgccagtccctctttctttccatgtgtctttttcacttcaagtttatctgtccaaatatcttgccattctgttttctacttactttctttccctccttgcctaccttttcctttaccctgtaacatttgccctttcctcgttttctgttctctcctttttctttgtcctatttcacacactttcagcattccctatgcatagttaattttatcttttttttttctataatttttcaggatataatctgttcctggttgcaactcatgagattgggcattctttgggcctgcagcactctgggaatcagagctccataatgtaccccacttactggtatcacgaccctagaaccttccagctcagtgccgatgatatccaaaggatccagcatttgtatggtctgtgctgcttaaggaagagaagggagatctgggcaggaaaatttcacctgaaatttactgttgtttttttttttctgtttccataggagaaaaatgttcatctgacataccttaatgttagcacagaggacttattcaacctgtcctttcagggagtttattggaggatcaaagaactgaaagcactagagcagccttggggactgctaggatgaagccctaaagaatgcaacctagtcaggttagctgaaccgacactcaaaacgctactgagtcacaataaagattgttttaaagagtaatattttgtcctcataatttgatatgtctcagcatttgctatgttcaaccactgtgatcagaacaagaaagaagtgtacacaacagtggagaactctggcagagatggccacgggactgcaagaaaagaaagcataagattaggaatagacctttgcattttcctacacaggtagagtttaaggaatgttattttctatgctgtattgaatatgccagttatggagaccaattggtttaatggcttatctagttattagctatgaaactttggttaagtcaagtaacttaaacaaagttaagttcagggcagctgaatcaacactcaattcctaacaagtcctttgcatctcaaactctccctttgtatttgcttctggagaacctaacctctgaagttgactatttgaaaagccaatgaaactgtcaatctactgtgacactagtagtataaaaaagaaaatgcatatcaaaacaacatgagtaatgagaaaagcagataccgtgtgactactgcagatcttgaaaaattatgaaagtacttaagaataacttataaccaataaatatcaaaatgtatatccaaactatgtattcctagataaatacaatttataaaaattggtaaaagaataaatagaagatctaaatggtcctataaatgttggataatgtaatccttaattacatctctccacaactagttttaaaactgacaaagagaaaacctgaattgtccgtaaggattaactagaaagcctataattaaaactaccctgggatggccatttaattaaaaaacaacataccagcatatgcaaaatcttcccggggagaagagaaagaatatttcttcaggtattttagagctttgtgtaatctcaatctcataacaaaacatgacaaagacattacagtaaggaaaatttcaggccgtgcttactgatgaacatcgatgtcaaaattctaaacgaaatatttgcaaaccaaatctggcaataaataaagaaaagaaaatggcattccaaacttgagtttattccagaaagacaagttgatatttgaaaatcaatcaatataattaatcacattaacatgatattaaagaaaaataatatgtatcataaaagcatgaatttcaataaacccaaaataattttatgaaattcagcatctatttttgacaaaatcccttatcacatgaacaatagaagatgacaacattctcggataaaagcaggtacaaaaaatcttagcaaacatacttaatggtaaaatgttgttaaccacacctgtgatatctgcaaaaagaaaagaaaacaatttttatcccttctccccaaaatgcactggagatcttatccaatgcaacaaagcaataaatatagaaaacgataatgaagattttaaataagagaaaaagaagctgacattacttgtggaggtgtgatttggtgcaaaataaggccttagagaatacagatcacttattaaaaataaaaaataagttcagcttttctgaaaaaagaaaaattaactttatttttatgtaacagtcccaaatatttagaaaaaattaatcatgctacttacgttagcacaattgaatgccaaatatgtgagaataaacctagtgtaaaatatgtaatctccaaacagacaagtataaaataatattgagaaaaaataaagaccttaattaattgaagttcctgttcttggattagttatcttacattctaaacatgtaaattctccccaaatcgatctacagattcaatacattctcaatagtagtctcaatgtatatcttggtagaaatggataatctgtttctaaaatttattaataaatgcaaagaggtaggatagccaatatgcaaagaaaaaaaatgtgttgggagatgatgcttcgtaccaagcactgaggaagcagcaatgaactggatagtagcgtttgcctttaaagtgcttagtgtgccttcttgaaccctgttgc

SEQ ID NO: 14184 - DNA, 183112 bp, Human
ccttcattttcctttgagggctaaatgggagtagagatatctttgctgctggtcctgagagaccatggggttgtccattcctggtaaggtgatgctgaccagacagagctgatctagatgaggggtgggaggtgacagtggttcagtggctttcttggaggatgcatgattgtttgaattattatttttaattgacatatataagtatataataaatatatatgttatatatatgagttagagctgaattgcacaatatgagcaaggcgttcctctcagcttcaaaaccagctctgggttgtaaacaagctaccacttcctcaatccctctgaaataacatcaaagttggggtgcaggatgaaggcaccccaataataccacactggggaaagtgtggtattttgatacctgtatacaatgtataatgaacaaagcagggtggttaacatagagaatgcatgatttgcttggtggggagaactggatggttctgtaattatgttgagatggacagaaagacatcatctgacttggggagaaaatcgggtgtgggaggaggtgggagagtgcagaacctgaggcagaggtccccagcaagtctggcatggggtagggtagggtggttgaatactggcttcagggagatgaggcaagctggcctgactctggcaggttgtcagtggtagtcctaggtagaggagggggctttgctaagctacctgaaaagtactagagtgggccggggtaggaatcgggctaccgtggcttgtcggagatgaggaatgtttttagaaaattgaactgaccatcccttccttcccctgaacagcagcttgtatgcaactataaaggtagtctccctttcagccctgcttgctgtgtctttattcttatcaaaaaccaggatctgagttcagagggcagtgaaacataaaatgaaataggaaaggttgcagtagtacatagactttggctgctcccactaacctgcaaaaaaaatattttccttgggcgtaccttagcagttccatggcagaagttttatctcctgtggttcagagagtttggctcgtcaagctgaatgtagggttaaagtgtgtcctccctcctctgtgggtgtttgcctagctcctggctgtgggttgaagggactggtaaatatgtctattttactgctgaggcagggtggctcagtgcttggtcaccttggagggatcataagcaagccgccgctggggccctgtgccacgcacaggtattcatgcgtgcgtgcaagcacaccctgtatagctgtgtaataattgtccaggtgtggtgcattctttgtcagatgtacccttgtttttactgcctctgtgcaggatgtttatttgctgtgcttcaggctggggcacgtagcttgatcaagggtagtttttgctgtggcccctgcaaatacgttgtggtgcccagagtagatgaaaaactgtgagtttcccaatagagcgggttcatctggactcttgttggttgcgttctaggagctaattctgtggctctggactcttccctggaggtggggatgaggccggggccggggggaggtggtcttgtggcgctactgcgggctgtgcactcaggaaagtggccacggtttaggacgacctcgacacgaccctgtataggacgcaactaactccagagaaaacgagcgagccccatgcaactcttcattcctgcagggagaacaaggaggtgtgcccgccagggaagggacgcacccccaccggcgctcgctgccttaacttccccatccccgcgccagggaggggccggagtcgccgccgaggccgccgagcgcagaaagtgcgcgaaagggacgcgctgcgagcctcacacgtgacggcgccgcgccgaaccgagcgggacctggcggcagcggcggcgggcgcagcggggcggcccggagcggcgcgggcggcctggagccccgggagcggcgcgcgcggtcccggcccagcggctctcctggcctcgcgctgcacattctctcctggcggcggcgccacctgcagtagcgttcgcccgaacatggcgacacggagcagcaggagggagtcgcgactcccgttcctattcaccctggtcgcactgctgccgcccggagctctctgcgaagtctggacgcagaggctgcacggcggcagcgcgcccttgccccaggaccggggcttcctcgtggtgcagggcgacccgcgcgagctgcggctgtgggcgcgcggggatgccaggggggcgagccgcgcggacgagaagccgctccggaggaaacggagcgctgccctgcagcccgagcccatcaaggtgtacggacaggtgagcagttttgcaacccgcctccctccagttttttcctctccctgcacttcctcacccccgcatccatccgttgcagtcgcctcctaggtgcaggcaccactggggacttcccggcttgcatttgtttttttccttcacgagtacaaccctcagcacttgaatcgcattgatctttccttcttcctgtcgatttagtaaacgtattccaggtaactcgccgggtgcagtgcgtattaccccagggtgtgtgcagagagatgtagtttccggcaggtataggaggggtgcagcttcattttacatctggataaaaaacgggctttctttagtgtatcatcagttggcagtggaggcgagcaccctgcagttgcggtacacttacacagaacagcacgaggtgggggtttccacacttagcattattagcacaataaaagtgggcaaacctgaaagcttgtcgactatctctgtacagtcagacaagaggtgtgtgtatgtgtgtgcgtgtgtaaaggctgaatttttaatttttaatttttggcgagcgtgtgagatgctctccattccttcttccccacccttcaagatgctgactctcccacccccgtcaagataactttattttggagaggaatacccctcatggcacttggagatttgaaaggactgcaggaaatttggtgggcattattattctataagtgatttatttctacccaggcaataggtttattagatcataagtaacgtgaatttcacttttatggtcagacttactgcgaggaattgcagatggagtttgtaggttaggatcagcactggcaaaattaatttgaccgtgttattgcctcatgagactcccagtcctgcagttaagattgacatcagcaaaagtataaggtcggtgggggagaaaaagtaggaccagaggagggggtaaatacacttgttttctagagtcaaattgttccttttgaagtagaaattattaataaaagattaccctgagttctgccttttctcactaatttcactttagccatttcttcaggaaatacagagttaaatgttcaacccttggatccaggacgaaccttgtaaacatatcaccctattgtgtcattttgttggtgaagaaactgaagcgtggaatggtgaagtgactagtccaaggtcataccgggaaggtggcctgctctctagtttttgtctgcattgtctcagtgacctttgcttgactgcagtcaccctgtctttatgcaatgctgctgaaatacctcctttctaaaataaaatagatctggtataaagggggaaaggatggtggtgactgggtgggagcgttggatttccctccactattggtccctgggcaagaatgtgtgccccagggcatgtaactaatggtggccacaggctgcaggaacctgcatgctcagttcctcttgggcccagatccttgtccccctgtccccaccccatatgacaaatatgtgtatgaacaaaaagaagtcatcaaggtccttgctcttaacagcgacaccagcatggggctgatggagggtgggagaaggaggaggagtggcccacttcttcattgggcctccgcagtcagcccagctctgctgtgctcttgaatcagcattctgggaactgggagttgggggctggtgggagacaatccctcccagtgctcaggtcccctgaagctatagtttaggttgaggaaaaagttttctggtttcaaaaatatgtgtacatgtgccatttctttcttgggtttggtttatgaaaagctccaggggatgtggggcaggttggacatgaactctgttctcactgggagtgactcccaaaccctgggcttttgagtttctgggccagccagattgagtttggttcagctgaaggatggagaactagcagtcaaactcataatgaggaattcctaaccggagggtgagggtacaagggtgagatttttcttctctgtggctgccttcctatgccattgttgcctcttgctctgaggttaataagaagtggaattaatttgaatctgtaaggatttgagtcagataaaaggaagaacttccctgtactgggctttctgccacaagttctatctggtgcagacccttcagaatgcaagcacaggttggtgactgaaggggtttgaggtgcccctcttggaactctggagtaactaacatctatttggaatgatctttctagcaaggatgaccattgcctctgtgtttccctggggcagacctggtttctaagttgtctctggtggttatgaatagcacccccttcactctcaaaagtgtcaagatgtgacaataaattatatggtcctacttttagccttaagccaagttccactttgtaatcacgactttccccttcaacgtttaaacctaaggaatggtgatgttttccaacagtactgcttgacttgagtgtggttctatggaggtgcagtgagctggggaataaaatttcattcctgcttttaggaaatttacaatttaaggaggagagcaagcagatgcagatacaggcatgtcaatgtaccaggatgggaaccaggaaacatggtcacaagaaaccagccacaactctacaatggtgtgataacgggctgtgtgacatgcagcgcatgggagatggagagataaggggtggtgggctcagacactgtccagcttcttgccctctgacctttgagtgaggttaagaggacactggcagcacaggttagggctggaagcagaagctgcctgaaggaagcaggcctagaggcgatgttaaggccaccaccttcagggagaagagaagggaaggctttctaggggaatacttgcatctgagaaagagccctgtgctggagtcaatgtcggtcctttttcctctgcttcgctaatgtcttgggtaaactaggcttggttattttgaccattttcctcctcagtttctctaaggtggggagaccggcttctgccatgattacttaaaggcacatttatgatactgaaatgtgattgtaggggtgaaaataatttgctggcagatatcaggacttttctgcccatgttcaaggctcacgcctgtaatcccagcactgtgggaggccgaggcgggtggatcacttgaggtcaggagttcgaaaccagcctggtccacatggggaaaccccgtctctactaaaactacaaaaattcactgggcgtggtggcagatgcctgtagtcctggctactcaagaggctgaggcaggagaatcgcttgaaccccggaggcggaggttgcagtgagccgagatcgcgccattgcactccagcctgggggacagagtgagactccatctaaaaaaaaaaaaaaaaaaggcaaagtttagaagttgagccccttcttaaaggccaggtccaagaagagggattccctaattcatgccacactgaatttcctcctgatttctcataagctctgtctgtctgcgccatcatacctgctttttcctctgcctgaaatgatcttccccaactcttgtccttgcctgggaagctcttattccattctttaacatccaaggaatacctcttggtattctcaggctatggtgggaagagtttcttctgagcttggaggcagcacttactgccttgtgttagaattgctcaactgtctcatcttcctgtttgctccttgagggcatggatcaagttctcttgtgtttccctggcacttgggaggcccttaatgagtatttgtggaccagccacacacctggaagaagagaggcccagagggtaggaagcacattcacattatataaaatgtatttgtaaggaggaatacagtgaacccacacatggatagtgaaaatgagatggctcattcggtagtgaggatgcaagcggcatggcctacagatagtggagccctgatttgcctgtgctatatgggagttattttcaatgaagagcttggattctattttacagaatcctcccttttagggctatcattctggtttatgctaatggtattgttttggggaaaaatcctttggaataaagcacaaagcctaacaggatttacaggtttattttccttccaacaagctctctcttcataattcctacattttagaagccagggagtattcagtgtcctgatttgagactgaaaataaagtgtctattacagcacaaggccctgggacaaaaggcctcctttgggggtggaataccgttcagctttagatctcttttgagtagattcttccatgatacacttgcttgggaaagaattggctggttgattctgaagttaggatgtttgacctgtgtgcttccagaataagatgagaaggcaaagaatgtgctgcttcaggttggcttttatgtagctgaagagttgctcggggccttgggttggctcaataagggacgtgaccttgaaaagctcttcctggttccacttggcgtcttttcttagggagctctgtgcccagtctctggccacttttagttcataaatagcttgcatggttagaggcacagaaggtggaggctttgcgagggggaaggaatggaggaaaggggttggtgagaagagtaaggaggcggaatttggagggatgaaataaaaagctgtctgattaggtaatgcacgtttacaaaacaaaatttgtacaaaagagtatgtggtaacaaatttccttccctctcatgccccctgttcacccagagctcctttccgggtggcatccgttgttatcaatatttttgtatatctttccagaaacagtctatgcatgtacaacatgtatgtacataaaattggaaacttgaattataaatggcttcctgttacctgtagtccctggtatcctgaataatgagattaactttagctctaaattatatttgtgatattatgatggtgaattgttagaaaattacctgaagtatcataatataaaatagatgattactttttttccaggccaggtgagaaaaacctcattctcctttcacttcaagcgttcttgcagagcaggagagcagcctgatgtagcccccttgtaacttggagagatgctggagcacagttcccttgagatgtggagtccaggcttgtaagagcatcagaatacagtgatcatggatcttggttttaatttgtgttctgtctgagaatgttttctctatgttctgtaaaatgaagttaatggtatgcttaataaattgctttgagacttgggatccacgaggcagatccttatagcaacgaacatcccaaggcaaaaggtggatgttgtaggaacatttcattgtcagattttggtctgttcctccttagagatgacagccatcttcatagtgtcattgttgaatcccagggcagagatagttggagccagctttgttccacccactgtaatggagggacacagggggcagtcttatcataatctggagagcaggtaatccaaaaaataatcgatttgcttttgctatgtatttatgtagtcttttttttaaagcattcgtttaccttcctaattaagttttgctcaggtgaatattaaaatgagtttgcattctttgatctattgataagggaaatggctggcctaaatgtattcagggaaaggcagtttggagtttagaatttgcgacaataattcagatgcagataattgagagttgataaaaatgtattaaatgttttaaatgaataaaaatgtattaaaacctgggggcattacattgacctttcctccatttatttggatttaaataaatgtgatggaaagtaaaagagagctcactgcatttttggtttgaatattcagggattagtatttctccagaggtggtctgggctgtgggggtgaggcattctctgttgatgagcatgggactttcctatgcattttctaggtatgccagacactgttggcagatggtatagtcagtctagccacgtacatgcaaaaatcaatttccctcaatttaaaatgagccacagttaatttcgacctaatttattggtttatcgacctgtgaaccctgggccttcgaagaagtggcatgggcggccttcgagcgctgaagtggctgatgaagctaaaatccagaaaaggcagggtgggctgctgagcaagatcaagatttgagtttcctcctgtgttattgtgagatgctcagttttttttaactgtaacatgaccaatgctttgtgcattttatggtgggttccgtaaaaataggactgcgtaacgatcacaagtacactagtgtgttaaaaaataattacaaagttctgttatccactgggtaactgtttattataatggtaacatccatgcccatagcactgctactagccaagagctggaagatcctatcttcctggccgcgtcctggaccctccgatgtggcactgttcaatagatctttctgtgatagtgatgttttctatctgtgctgttcaccatgttcactagtcagatctggccattgagcaggtgaaatgtggcaagtgtgactgaagacttgaagtgtctttcatttaattttaacgaatttaaagttgaaatagccacatgtggctcttggctactgtgtagacagcacaagctttgacaaggcctcttcttcccacctgtaggcaacctctgcttcacccaagagagaagttcctgcaaagacctgctcgtgtaggcagggcaaacagggcaataaaagcaagagtggagggcttgggtctagaccctaggtattggtggctgctgactgccaagttgagtgtcaggagacagtggtccttctttcctaggtaggaactcaccagggggaccgtggagggccaagtgggtccggtggttggctctagggcatgcctctgcacagttgcctccttctgtcagtcacttagtcaatgaaggctggctattcatagggtgaaccagatctctgtggcttcacttctcatctggccttgcgcaaacactgcacttgtatcgggcttcgctaaggtggagcgcagaccctgcacgttctgtttagcaatgaaagatgtaaacagtgccttaacagtggggccatctccctgccctgccctttgcttcctgtgcttttgttgacttaccttgatgtagctgggtctgtctttcttcccttcaaccctccagattggcatgaagacaaacactacaggcgtgtggtcttcatctttgcatataaacctcccccacttcttggctgaccttttaacttagcttgccattgctgttgctgctgctgcaggctcttagcttggaaaatcaggacccttcacaatgatttatctccagtcccctgaattagattcaaaacacagctacgaattctcagaaaggcaggctgatgtgattatatcccaaatctgagtggctgacaaggacaataaaaagatgtacctatatcaaatgcatttgtgccgtgtagagaccaatatgttgtttattatctccccccctttctgggggttttttaaatgaagaaggtaactgatgtgacctctattatttagaagagagactagcctgttgagtagaaaccctgggggaagatgactagggtgaatcttacatgaaataaatgtgggggtgaatcaatgggtgggccctcagttgggattttaatattttagggatactgagatgatttccttctgactttggggggctggtgagctgaggtgtagtgtcatgatgaatttttttttttttttttttttgagacagagtctcgctccgtcacccagctggagtgcagtggctctatctcggctcactgcaacctctgcctcccaggttcaggcgattcttgtgcctcagcctcctgagtagctgggattacaggtgcgcaccaccacgcccggctaattgttttgtatttttagtagagatgaggtttcaccatattggccaggctggtctcgaactcctgacctcgtgattcacccaccttggcctcccaaaatgctgggattacaggtgtgagccaccgtgcctggccttggtgaaatttttaactctgtgcccagaggcattggaaaggctggtatgatctggttgagcctggagggccctgggttaagagccacctgtggagaaaggctagcttggggactgtggctgggaagactttaataggtacctgtgagatagcaagctatagggttaaggtcccagatagttaaggaccccatttctctattagcccaggagacacatgcgagacagttccacctgtctctgccccagggacctggggagaaaggccagtgctgatctgcccaaggatctcagccaaggagcccgagatggcagggagtggggacagagcagagtggggtgagtgtcctgtgaaaccagaagtgtttggaaggacttgcatgctttgaacctgtgctcaattaattgagtaacctgagactctgtacctatgacttacctcatctgtgtacatttagttccctgaaattctctcactgagtggttaaaaaaaaaaaaaatctgcagttaactgtgcacatggtttgctgaatttggcaaggtgtgctgttggtggtggtggtgatgggtgggctggagggggacggttactgcagaaacaaggccttcaatctctagaggagaaaaatgaagcagtggatgtggaaagttggttagaggtgaaagagctatctaaacagagctgggggagtttagctagcagaccagagcctgtgggacgtccgcctgttgcctcacctcctggtagcccagagggcatctcctattactgagaaattggccaagccatgggtttaatgcactcccccttctccattagtcttgtttatagctgccctcacagggtggtgaagaagccactggtagggtatagaggccttcggttctgggatgtaatgtttacatgcttttctcttggagttaggaaagtgctagaaaacagtgtcgcctctgggctggagccttgggacctggaggttgggtttccccaggtttcagagttcggctgggaatcaaggagaaaactgcctgtgagtttcagttaggcaggagctcctagcttgactcaggcgtgcagtgttttgtcattttatatatgtcatcgcttgctcttaggcctttcgctaatgttaatgttctatgtggagccgttttgtgaggaatggcttattttggttgagaggcatttggtaatgaaaagaaatgatgttttagtgcgtcgaagtttatgaaatgacatccacaggctgcatctcatttgattcttacgacaatcttgaaaaatggggaagataagaatgattattcatctcatttcagagatgagtatcttgaagcttgaaaaggtgaagtgacttacccgtagttagacaggtggtaaaccggagagaacaagactcaaaccaacccgctaacttgtttcagatttatgcaggcatatttgtctatcctaagtaatctagtgaaatttttgatctcaagcagggatccacagcttttttgcagtacttttttttctccacctttaaaacctggagatctcacataattccactttctcctggccacactgatcttgtaatttttcaaacacagcaagtctcaaggcccttctccttcctggcttctgctctgccctgccttaggtctgggtccatgttctctgcctcacttttccatccccttttccctaactcctccctcttcatccttatggtgtcagtacataggtcaggtcttcagtgaagcctcactctctccccgatatgaggttaggtcccctgtgtaacaacagtaattcaatcatcattcctggaattagttgtttaatgcgtgttttccctactatattcagagctatgaggcaggacctagaatcgtgttatttttctttcttttttattttttgagacagggtctagctctgtcgcccaggctggagtgcagtggcatgatcatagctcactgcggcctcgatctcttgggcacaagcgatcctcccacctcagactccctagtagctgggactacaggcatgcgccaccaggcccgtctagtttttgtattttttgtagagatggggttgtgtcatgttgtctaggctggtcttgaactcctgggctcgagggatccacccgccttggcctcccaaagtgctgggattgcagatgtgagtctgccattttactaacacctagtatagcatctggtatatagttagtgcttgataaatacttattgactgaacgcggtgaggggctattcatggtgaagctgcagagggcaagtctgtggtctggaaccatcctgaagagctgtgagaaatgactttgggctcacagggaaatcctcacgtagggcaagtcctggcttggggtgcgctctcttgagggggtatttgctgtgctcactctgactgtgtttcctgcacatggccgtgtgttttcaggcagtgagaaccaccacattgccttaaagtctgtctctgagcttaatctcatttgcaaaaggtggcatttcatttaattgttctctgagattctttctggctttgatattttcctcattttttttttgccaactggtaaattaaggggtgatattatgttcatgagaaagagagttttccacagtttctttttagtagggagcccctcccaaaacagcaaagcatattcgctcattgacaaagtgggttcaccaggacagagtggcacacagaggtaaacagtagataggttctcgctgccaaggatcaatcagaaagggaaataagctctctaaactgatattataaggcagtgagattatgattatcatccttttagcaaagagaaaggaaagggcatatgtgtatttttctctgtagaatggtcatggctccagtgaaggagatagtagtgaatgctaagttctagtccaaggttattctctccttgtttcctcatctggaaaatgggcagcctgaattcatcagcaaagtagttcaggagttctgtaggtgaagcatcttgagcaaactcaaaagtcaagtgagtgagctgagattccatgaactgggcctctcttccgggagtgctcgtaaactagatttcagctttccttctgaggtgagcagtccagggaggataataagcctgctaaatatagtgagaacacagtcttgaaaggggacagtgagaggcaatttgcatacctagcatttaggccatgcaaagggatggtttgggaaaaccttgttctccttggacctcaggaggctgtctttgacttcctcagtttcgtcatatagttcaggggagtgcctggctccttctgtcctcacagttgaaggacaggatatttgttttatgctatattgtagaattttaaaaacgcttctttgtatttcactgctagtgaagcagagaaatgaatcagactgccttatttgtcctccttgtactgcgttttgggaggaggctgtgtaggagttgtgaggactgcaagctgtgggagtctaggacatcctgatttttgggtttgaccaatttgaaagaggtgtagagagggtacctgtgacccattctattcagtggccccacctcctgcataagcctcaacaactatacagatttcggtggttttattggaaacttctcatcattggcttagacttgcaaccctaattcccccagaagtgctctgtgtgagctaacaggtaagaaatgattaaagagcctacagggtgcctggcacctagcagacctcagtgcctacttcatccgcaagtgaacgcatgagtaatcagtcccttcatccaagccattgacttcctcccctctatttataacaacccagaacttgaggactgggtggtagcaggtccttcccctcactctgaataataggaggtgaatcatttcacctctccgggttgccagggcacgcagggggctgagggacaacacttgtggggtgatatggacttgttcgatgaagatgccgaggcgagtcaaggtgtgggtggcatccactgttgtgagctggcggtggatgctagccttgggcctgcggctgtttctccagctggggacagggaggcctgtgcggatgctgtggctctgcagatgccgctgacagcactttgaaggattggtttggccagagacccagtccacagcctgcctcctgtatgactcattctagctgcatattttggtagcatgagggcttgagatgagataaaaggagcacttcttaagagtggaagctcctaggttcttgattagcacttgagaaatataatgttctctgcaggtcctagaggccttaaaaaaatttgagtatatttcacattacataaaattagccattttaaagtgaacagttcagtgaacttaatatcgccgcaatgttgtgctaccatgatttccaaaacatttccatcgctctgaaataaaaccccttacccattaagcagtgattccctcctctccaatctcccagcccctcgtaaccactaatcagctgtctctccctatggatttacctattcgggacatttcatataaatggtgtcatgcaatcatgcaatatgtgaccttttgtatctggcttctttcacttagcatattgtttgtgaggttcagccacattgtagcatatatcatcagtatatcctagagttttaatgaccatcccaaatccccaaagacaagcccccccgccaaaaatggtacatctttctagctaccgtcatttagttccaactcctgccaggaggcaggggaatcaactagattcattgtttcccaaagaagctgcattagaaatacctggggttggggtgtgtctcctttttttttttttgagacggagtctcgctctgtcgcccaggctggagtgcagtggcatgatcttggcttactgcaacctctgcctcccagattcaagcaattctcctgcctcagcttcccgagtagctgggactacaggcacgtgccaccgtgcctggctaattttttgtatttttagtagagacggtttttcactgtgttagccaggttggtctccatctcctgacctcgtgatctgcctgccttggcctcccaaagtgctgggattacaggcatgaaccaccacgcccggctgggtgtgtcttttaaaaaagactgattcctgggctccaggcagagggcgacagagccggtaggcgtggagtggggcctcttaggtgattctgaccttcagtggggcatgggacccccctaggccaggtgatctttggggggtggggtgggaggagttatcttgactcttaacgacctgccaatgagccagatgctgtttgttgtttatgatgcagtttctgtgttcagaggtttctgtggcatgtaatttttctctgtttgccttctgaggggaggcactcggcccctccctgctgccttaacagctccaattaattgtgtctcatttatcaagctccagctatgccctgtgagctagacaggggagagggaaggttgttcacaccccggggttgtggttatagctgattgcacgtcaaggttatgttcctgggaaaaccaccctcccacccactcccaggccagtgtcttctgggtgtgggacctgtgtgggggattggcgatggaaaaaggcttggggaggaggaaaggggagatcagggggagatccttggggatggatggaaaaggaaccaaacaaaccggaagccactgattaagtaaagggatctagggacctgtgggttgttcttgattgctggggtctgccctgggctgctggtgtcttggccacatgccatggagagctagcaggaaaagcctgctttgttgacttcttttctttcccctgggggtgaggatgggggcaaggtggagacagaggagacaggtgaggccagagggtagaatgcatgtcttgataataaaatttacttcctgtcagcctgcctgctggctcccctgtcctgcgcgcatccattcctgattcctgcaactaggtctgctgtggggggatgggcacccgggctgccttggggatcagctgtgactcaccagggagttattcttatgaccaggatgtgcctgacatctcgccaagcaaaggagctgagctgttcctgcgagtgcctggtggccctcgtacaagtcatttcttgccagggattttatccccctactgggctgccccttttcagtctgctcttatgagtaaaagggacatctaataaaaaaagctttccttaaaaaaaagaagagaaagaaacaaagtaacaaacaaacaggtgttttaccaggcttgccttctagaggttttctttttttctttttttttttttttttgaggtggagtctcgctctgttgcccaggctggactgcagtggtacaatcttggctcactgcaagctccgcctcctgggttcacgccattctcctgcctcagcctgccgagtagctgggactacaggcacccgccaccacgcccggctaattttttgtatttttagtagagaccgggtttcaccgtgttagccaggatgggagtttttctttgtagaaaagcccttggatgttttgaggcttgcccttggtgctcttctcacctttcacctgccttgggattggtgaggaggtctcctgtcctctgagtagatcgatttcagcaagttatcttcagaccttttgcccactctgatcactgaaagctttgcaacctactcaaagcattatctgagtgttacctgccagagggagcattttgatgtcatctttgaggatgcccaagttgaatatttgaggactttttatcccagatcccaggggaacatgggtgattttttttttctaggttcctagtcctttattgtattgacatttgcatagttttctatccccactctggttcaagagtgcagatgttttgggaggggaggaaacttttagctgggattcccagggcacatgtgttgtgagtttctgatctccagatggatccaggggattgggctggagaggaggaaaagggaaggcttcagcgaccggaggagattcctttagctgctttctctttgtagcattctggattaaataatttatttacttctatttcttatttgcacttctctgttagtgcttgcctggacttctctatctgggaatgaggagagacattttggaaggacacatattcctaggtccttttctttaaagtaaggtcgcctttcaaatgtttttcaaaaagagtttgatcctggatcaaattaaatgcaggtatttaaaactccaagtaacgtcgttaaggattagctgctttgtccttctgccagccaaatatgtggcacaggtgtttctcttttccctgatgacatctgagagcacctcaaggagtgggtggggaaagttcgagtgtgctggggggaggaagcgagagaaggagaaaggagctgtgggttttctgccgcagagccttgatgagaagacagctcggagggcaggttggcccaggcttgaactgtcatcagtctaggcttactcgtgggtggggtggactgtgcgggctggagtcccagaagcttgatttccttccacgtgtgcctcagacagctgaggttgaggaggctggtggaataggcttctctcagacatcgctcagcaagagaggcagcctgtgatcctggtttcatggcattgtcctgcttctgagtgttggaccacctctcagaattttttttttgagactgagtcttgctctgtcgcccagattggagtgtggtagctcaaccttggctcactgcaacctctgcctcctgagctcaagcgattcttctgcctcagcctcccgagtagctgggactacaggtgcatgccaccatgcctggctactttttgtatttttagtagagatggggtttcaccgtattggccaggcgggtcttgaactcctgacctcaggtgatctgcccgccttggcctcccaaagtgctgggattacagtcgtgggccaccgagcctgaccagctctcagaatttttgttattcctgtcatgactttgctttccacagagtgggtggaatgtatggttcaggtgttcaaatgccagtcctcagacaggtgtccatcagccaacagtgaaataagaaaataaaagtaatgtagttttccatacagtgaaacaatggttctttattctgagatgatatgcttcctcagttttcagtgttaacacatctttgaaaaaatgacaatgactctagatagtggtcatattgccctgtaaggtgagctgcgtaacagacaaatcccaaaggctcagcgtgtggctgagttgaggctccgggttatgagaagttcaggatgagtgctactggttagcggaggtcttttccatggggatgcagcctccttccgtcttcggctctgccctcctctggggctttggagtcctctgaatgcggcctgcggatggggaaagaaaagaggactgcatgggggccaggccgatagtggccctgatgacttctctcacattacacctgctggaactcagtcccaggccacaccttctgccccacagcctggaccagagtctgcggtgtcctcaggaagcagaggaaagagattgagagagtagctagtcctgtttttgtgatgtccttacttggcagaatagaagttgccaaccagtcctctgttggccttcctcatttttattttatcggtttaccaaatctaaaagtctgagaactaaaatatttccttatttgagacctttcaaaaataattttgaaaagcttcacaatgatacttctctcatttcttattaccagctgaaagtgaatgacagtaccaccaagccagaaaaaacatagttggaacagaagtttgaaaagcatgtgatctttctggcctatgaattttttttgaacaagggcaatgtttccatgctttggtttaaaatcttaccagtgcatgtcatacatagagtaaggatcagagtaaccagagattggtatcataaaggatgaaaataatcaaaggaattggttatgccaatgagagcccaagaagcttttctacaatctctttacatccaaaatagcaggggactcatttctttgtggggaagttgagtgtgacagaatatgcatgaggtgggaggggaagaggccaccttggcccaaatgctttagatggcagaatcttcatcatttctgcttgacaaaggaggaaagagtcttgatttagaatgtgtgtggccatcacttatcgtgggtcctaattcctacattgatctctttcaggttagtctgaatgattcccacaatcagatggtggtgcactgggctggagagaaaagcaacgtgatcgtggccttggcccgagatagcctggcattggcgaggcccaagagcagtgatgtaagtgttgtgttggctctgggcacaccttggtgccatcaacatgcccttttctggtccactgggattatcatactggaaaaagtagtgggtaattggaacatggaatggatgaattgtatgacagggaagataatctagaaaatgatatatcccttgtttgctgaacacagggaggtgcagtcagtgttgcaaacagatccatgcaatgtgtgattacctttgggaagtaatagcatatggactggattgttgcatctgcccaagaaaataccagagtgccttcctgggcagagctgcctgcctgcagctgagcccgatggaatcaaattggcctttcccatatgctggtttcttctaacccattatagtgggatgagctgttgaaactgattctctaatattcttaatttctatagctgggtatttgtgatctttagtaggtgaggtactttgaagactcaagatgccaagggttataaactcaaaggcctgtgggaggccgggcaggtaaaggacaggagtgaagccaccttcaagtttataacactcttttctattttttttttgagttggggtctggctctgttacccaggttggggtacagtggtgtgatcttggctcactgcaacctccgcctcctgggctcaagccatcctcccacccactcagcctccagagtagcaggaactacaggtgcacaccagcatggctggctaatttttgtgcttatatatattttttggtagagatggggttttgccacgttgcctaggctggtctcgaacccctgggctcaaacaatccgcctgcctcggcctcccaaagtgttgagactacaggcttgagccaccacacctggccattacaacactctacctcctcagagaaatatggtttctcccatttttcttgaagtctgtggccttgttggacaatatatgtcatttccacttttgatggagatgcacattcaagaaacattctcccatatcttaatttgaacatactaatggatacttggttcctgtgttggagagacgtggggaaggggaagggcctttggggaccgggagaagcatgcttccgaggagcattgactgtcagctccaggctctggttgccgtgcaggatgctgggcccagtgttgccacatcttctggttttccagaggaacccagaggtctggagtttcatgtgaaaactgctgagtcttacaagttggcagccagtgtatagtttttacagacaccgcgtgagccaggtaaaacacatgtaagggccaaagctcgcccaacggctggtcccaggtctgcggcctgtgctctggactcctccttgtgggtgagaggagcagcccctgcctcagcctggggtctgacactgtggcagcgcgaggctgcagacggaacaccatgctttacagcttcggtcaccctgcattctggccgggggaaccttctgatgaatttgccagcactttcacactagccttaaggatacatttataattcttgaatgcggatttggtctctgtgaggtccctctctgtatatccactgtctgggttgggtgtgttgagaagcaggtgttgggaagttgtctcagggactgtttccagggagttgaattagggcagccacagaagggaagacagaagggctggctgtcaggatgcatgactttgcccggggtgggttctgagccatgctgtgtgggagaccaccgctactgatggccagtctgggtgtagtgctctggggcagggctagacttgtttggggcaatgactttggcccatttataaatatgatcaggttttgcaagtaaaagctgtggccaccacagacagctgtgtctgaatgcctttggtggccgggtgtggtggcctgctcccatagccccagctactcagcaggctaaggcaggaggatcccttgagccaaggagttcaaggctgcggtgacctatcttcgtgctactgtacttcagcctgagtgacagtgagaccctctctctagaaaaaataaaacaaaaaatagaaaagaatgcctttggccctgtgagactcttcatagacacctgtgtgtagtccctgcccatgggcatatccctcctgggcacaggagatatatatactgtgctatactgtgttgagaaatccttcttggaatttttatgcgtttaaaaaaactcttaatccagacaacattttttgtgaggtagataaagaccttaagcattgttttatagttttgctggacaaacaggagccaagaggtgtaaagagacttgcatgaggtcactcagcatgtcagtgggaaggtcggggctgatgagaatcaaggcccaatcatgtactcagtgtgcgaagatgtggtattagggtgaccaacttgtctaggttttagcactaaaagccccacatcctgggatcctcccttaattctgagtgaaccagggtggtttgtcaccctaagtattgccagtctattgaaacccaactcttgctctctctgtatatttgggtgtgtctaactaagagcccattgaacatgtgaagtgggatacactattgtggaatgaaatgggagatagagccgaggtgggcagatcacctgaggtcgggagtttgagaccagcctgaccaacatggagaaaccccatttgtactaaaaatgcaaaattagctgggtgtggtggtgggtgcctgtaattccagctactcgggaggctgaggcaagagaatcgcttgaaccctggaggtggaggttgcgatgagctgagatcatgccattgcactccagcctgagcaacaagagagaaaactctgtctcaaaaaagaaaaaaaaaaaaggagatagattaaatgggaaggaaacgcaatggccagggttaataaatagggatggcagaaatggccttcctctctatacaaactgtgttaaaggattggcagatgcaagtgagatgcctgatgtaaaaagttaatgtgaaaagaaatgatgactcagaggcagtagttggggtaataacaatccaaattctctttaaagaagactgagcatggtttgtaaggtcccatcagcagtccagaagggaaagaacctaaacaaatcaggaactgtgtgggtgttggtgagcggccaaagtcatgcatattcagtatctaaaaagggatggctctggaagctggaatccagaaagtcttgctctcaaacggggaaaaaatgaatcatttatccactgatgaagttgaagccagtgtgattccatgaagagaacggctcctgcaggactcatctgtcctgtgataaatcaacaaaagaattaatagatgtttatctcaccttttcctaactctttgtttctgctctctcatgatgtattttacaaagtactaggtttacaaagtgctcaggtgcaacataattggctgaagagctgtccaggggtacagtccaccagaagatcagaatcaaccaggggctgggtgaggagtggctcatgcctgtaatcctagcacttcggaaggccgaggcgggtggatcatttgaggccaggagttcaagaccagcccggccaacatggtgaaaccctgtctctactaaaaatataaaaattagccaggcgtggtggcacaagcctgtaatcccagctactcagaaggccaaggcaggagaatcacttgaatccgggaggcggaggttgcagtgagttgtgatcgtgccactgcactccaggctgggtgacagagtgagaccctgtctcaaaaaaaaaaagaaaaaaagaaaagaatcaaccagggaagatactgtgcaggataggactttctgcttttgtccctagagcagtgtgacatcatgattgtacccctcaggactgactggggagcagtgtcagttcttgctaacagagggaggccgatgtctggctgagcacaggctctgaaatcagaacacctgggctggaatcccggatgtgccattcattagcaatctgaccttgggccaggtgatgtaccttctcttgtcctcctctgtcactgacatagtgcttgttaaaccttgctacccaaagtgtggttgtggtctgtggatcagcccttggggattttctgggagctggttagaaaagaatctcaggtcccatccggacttcttgaatcagaacctgcacttgaccagtgtcttgccggggccagggggcaggtagggggcggagagggggcagtctgtgggcatattacagtttgagaacattgctgtaaagtacttagaacagtgccagatatggggatgttttctgtacattttagctgtcatctgtttctcccctttctctccctcctctttattattacgtagttttgaggtacaagggaaagaattaaaaatcactcactttcaaggaccatctttgtaggtaaaaaaggatctaaccagaaaccgtgggcagttcagtaactcctcccctgtgctattttgctttttagggagtagcatcatattgaggtcagaggggactatttagtgcagaaatcccgtctggatgaaaaaccaactaggagcacaagatgagtgagtccggggtgttctctcaaattcacctggagatggtattggactgtgagtcagcagcatggtgctgccatgaagaaaagacagctagaaaggaaagcgcaagtcggggtggagccaccaatccgcttgagctaactgcacactggcagaggccttttctgggctgttcaatgtgggggaagatagataactgtgcaccagctttaagcattgtccttgttctatggagcttatagtctatgctaattaagtagaaataagaattaaggactgggtgcggaggctcatgcttgtaatcctagcactttggaaagctgacgtgcgtagattgcttgagcttaggagttggagaccagcctaggaaaccccatctctaaaaaaaatacaaaaatttagctgggcatggtggcgcctgcctgtaatcccagctactcaggaggctgaggtgggaggatcgcttgaacctgggaagattgcttgaccccgggaggtcaaggctgcagtgagctgtgcttgtgccactgtgctccagcctgagtcatagagcaagagcctgtctcgtcagaaaaaagagaaagaaataacaattatgaaggtaggataaaatgtcatgttggaatttttcaacctggccaagggaaggaaagttgatgagtggttcatgatggccttcaggcataggacggactcttacatacttgcttttcacttctgttaagtagaagacccaaagagatggattttgtttgtaggtgagaattagggaagagctctttgatagtgaaggtggttttacctccatgtgcacgatggcagcggcatggctgagaatctcaggaaggctttctacttggttaatgtgggtcttttctctctgcgggccagcactccttccagtgcttggcctgtagacttggtataagaccttcctacttagcagagaaacgttaagatggagaagagaacattctcctagaggtaacttgttggagtagagagacaactggacgtggaattggaggaaactgtcatagttttgtctcttactagcggtatgacccggagctagccattcacttctgggaatcttagtttttgtttatctcttaaatggaaatctcttagtgactcactgattcattcaattcattcttttctattcatttatttatcacatttgtttacttgctctttggtttataatgatatttattcatcctagaaatctttgttgagcacctgctatgccccaggtacactgaaagagacaaaggtgagactaactccggtttttcagatgaagagagagaatgtttgtaaaggagtattacatactgaaaaatgctaccttaatgtaaactatcacctttgtgcccctgaagatatacgtggggggttatcaaattatgggatgtcagagctggaagggactttagtttccttcctgagaagccattattttgctccatgtgatgtttgaacctaaccgggacactaatgtccattcttggccggcagaatagaagtgagaaagtgctacttcgtcattttacccactcagattatctgtgaactctcagcctgcacaatttctgaagctgcttttgtggcagctccttactgtgtatctggtagttgggaacacatactgtgtgttccaatagcttcttcaactgtgacccagataaaggcagaggctctgtcttggcctcttctaaccttaacatctagtaagtattaaagacgtgcatgtgctctctgttccctttctacataccttgtgtttacatagggcattgtttgcagacatttacatgtttacatgcccatcgtgtctaaagactatgtcttttattagtctttgtctgtctggtgtctagacaatacctggctcacatggaaccctcaaaacatgtttgctgatgactcagacaagcaaggattggaatacaccctgctccactttgaattcacctgcccttccttccctccctcccttcctccctctctccctcccttctcctccctcccttcccttccctccctcccacgcttcctccctccctccctccctcccttccttcctcccttcctccctcccttccttccttcctcgctctgtcacccaggctggagtacaatggtgtgatcatggctcactgcagccggaaactcctgggcttaagtgatcttcacacctcagcttcccaactaactgagactacaggctcaaaccaccaagccaggctcatttttatattttctgtagatatagggtctcactctgttgcccaggctggtctcaaactcctggcctcaagccatcctctcacctcagtctcctaaagtgttggggttacaggcgtgagccactgctcctggcctcatttttctttaatgctcatcctaatccccttttccatgaatcatttgaaaaataactaagttattttaatatattcacctatcaggcttgtttttaaccccgtgattatattaattatttcacatctcacaggtaggtacatctcacagtattgtcacgtcactcagcactctttcatttccatcttgggctacgtggtggagacccatgagagttttcttctcttttgtatggaatgctgtacaaacagaacttcccagaagaagaatgaagaattagatacgttttgggcaccattcaacagatggcaaaacaaatcctccgttccattcccctcagctagccacattctcccccttctggatgtaatttgttaaacactgaactcagccccggtgaggaggttattactgtttctatcatttgtctcctgctccagggacttgccttggcctcagaaaagaggcttgtgtattccaggcagtggggactgcaggggtcccatgctttctgcccccacatgcttggggacagacatagaggtgccctgcctcacctttgtgtgttatctggtaacatctgtcatttcctatcaggcacctaatgggagccacgttcaggatccaggatgggatgtttgaaagagatctttctgcttgggctcggtggctcatgcctgtaatcccagcactttgggaggccaaggcaggcggatcacaaggtcaagagattgagaccatcctggccaacatggtgaaaccctgtctctgctaaaaatacaaaaaaaaattagctgggcgtggtggcaggtgcctgtaatcccagctacttgggaggctgaggcaagagaatcgcttgaacccgggaggcagaggttgcagtgagctgagatcgcaccatggcactgcagcccgggcaaaaagagtgaaactcagtctcaaaaaaaaaaaaaaaaaaagaaagatctttctgccagtttctcaccaactctttctttttcatctccttttctctgtattccaggtgtacgtgtcttacgactatggaaaatcattcaagaaaatttcagacaagttaaactttggcttgggaaataggagtgaagctgttatcgcccagttctaccacagccctgcggacaacaagcgggtaaggaagtggccatccctcctgtcccgacttcatgggactgggttttggaaagattgccgcacttaagggggtgctaggagatggcgctctctgtgatctttgtagcatgactggtggctagtgagtttttgtgctaacctgggcatttgtgacagactgctgttctcagggttggtctctgcacaatcaggcaggccaaggactggtcaggcaggatttctagacaaacaatgacaggttaaaccacagaaaatcagccaactcttgtaataccttgcccgacttgcagatggcaaaaatgtttcccaggtacactgagaataaccttgcaatcaaattcatgttttctaggatactatcagtgtgtctgcttgcgtgcttatgcgtgcttgtatgcgtgtgtgtgcatgtacgtgcttgtgtgcgtgtgagtacctgtgtgcgtgtgggtacctgtgtgtgtgtgcttgtgtgcatgtgggtaactgtgtgtgtgcttgtgtgcgtgtgagtacttgtgtggatgtgcatgcttgtgtgcgcgtgagtacctttgtgtgtgtgcttgtgtgcgtgtagttacttgtgtgcgtatgggtacctgcgtgtgtgtgcttatgcacgtatgggtacctgtgtgtgtgcttgtgtgtgtgtgcagatacctgtgtgcatgcattggtacccacgtgcgtgtgtgggtacctgcgtgcgtgcgcatgcttgtgtgcacgtgggtacccacgtgcgtgcgcatgcttgtgtgcacgtgggtacctgcgtgcgtgtgttggtgcaaccctctgtcccccggcctctgaacctgtaccgatatggaaaagaaaaccaaggcagcagatattgctatgcctcctgctttgttttcccagctggctggccctgggggctttgtttcttcagttaggcaatttgatttgaggaagcgttgaccctgggcccccagggaggtggaggcgggagggcaggaaccgggcagccggcaaggctttcctgccagttgggtagctcttagctcggagagttgtatttcgttgctttcttccccactcttgtgttaccgtgtttgtttccaggccagatcttctacggaaagacccttagtagaaaaactaagagaaacattctagtagcaaaagctttctgctccagaaaggaacaagcaagcaagatctacagggtcctctttccagtccctagtcctggcttctcaggttgcttgaggtctcctagcaggggctgcattcaaaatatttagcgactggtgtggcttgggcactgaccaatcagaacaaatcctgtctggaggaggctgggtcctggacgtcccctgctgggccatgcattaacttttgagttgctgaatttcagggagatcctggggaagggaccacgccatgggaagtgttgtggggtaggcttaggaagggccacttaagggtttcagggcagcggctgttgaccaggtggtacagagcagttgttttttaacaactggaatggtcattactggtacatacttgttaaaatatcagctctgcctgatgatctcagagtggagtggcagttaggagcaaacttccctttcttacctaactccagggtgacagagtaatttttccccctgagatgaaaagcaaggagaaggtgttggagggaattggccccatagacgggtcagccagcctttgtgcccctttgccccaccgcacagtgtggtccccaggactcccagagaggggtgggccccgctgcttgccttgcctttggctcctccgtgaggtgaggagccctgaccagggtccagctcatagctgcctcttctgtggatggatccatatgcgccccgcctctcaagaatcaaattacacctgctgatgtgttgtatgcttggaaatgcagagtggattttgtgttctcacacaaaaataactatgagagggaaagcatttgttaattagccagatttaaccattaaacaatgtatgtatgtttttaaacattatgttctacatgataaatacatataatagtatgtctatttaaataattaaatttgaaaaaaactaatcaaatattatcataagtaatgataaaaaccacaatttcttttgcagcaaactaataacacctggatttctcaatttattaagttgtacttacctgatgctgatgatgattactgtatttacacattgtctcagagctcactcttgcggaggttgtggcctcgaaaatgccttgttgtccctctggaatctgtcttttcagcttcatctcctcctcctcacctcctgctgtggtgcacagatacctataggcaggctccatctcctcctccccagctcctcccctagtgcacagatacctataggcaggcttcatctcctcctccccagcttctcccctagtgcacagatacctataggcaggctccatctcctcctccccagctcctcccctagtgcacagatacctataggcaagctccatctcctcctccccagctcctcccctagtgcacagataccaataagcaagctccatctcctcctccccagctcctcccctagtgcacagatacctatcggcaggctccatctcctcctccccagctcctcccctagtgcacagatacctataggcaggctccatctcctcctccccagctcctcccctagtgcacagatacctataggcaagctccatctcctcctccccagctcctcccctagtgcacagatacctataggcaggcttcatctcctcctccccagctcctcccctagtgcacagatacctataggcaggcttcatctcctcctcccgagctcctcccctagtgcacagatacctataggcaggctccatctcttcttccccagcttcttccatagtacacagatgcctataggtgggttctgacttcctttctgcttgttgtgggttgtggtgaacaactgctaaggccacaagtctgaagagtcagaagacaggacagatgatgttttggacttgaaggaggagggttagtgcaggcagaggactggggctttggaagcactggatctggagaaggagcagagcaggggccgtggtgtttggggcaagagcaaggggaaactggagggtgattccagtaagggagtttaggtgctgcactgtggaatgggggtgacatgtttgcatcccaagtgctgtgtacctccgagtggtgtgtcttagattctcatgggtggatattctttggagttggtggggttggagaagtcaggagaaaaaaggctgccttcttggagaatttgttgacagttgggcctcaggcctggaacaggctgagtgggttggtgggggcagcattctctgtagatagtttctaattccccagagaaggctgctcctcaccaccccaccagactctcaggaaggaaatgatgactcttaacagtgctgattgcttctgttacttttgcctttgtcccctggaaggcaaattgccccaccagacctaccacttcctgagaaaaatcacacaaggctggatgccttgctgtcaacagcagggcgctctgcctaggcaaatcacccaggtgaaaatgcgagctgccaaggagcatttgaaatggtcgaaatgaatgttagcagctgcttggaaaggttaagatgtcaggaaagggcagcgtggatgtctaggagcatgagtgcctgtggaaggggagagaaggtgctagcgcggcatccagttccagtccgaaggctttgccttgtgatggagatggtgcttgtgggcccatgtgagttttgggtctatttctgcattagccagcagtcccacttccttcttggtctcctgtgtgctgccctgaaccattgtgcagtgctggccacatggcagttctgccaacattgtggggcccctgagattggtcagacagaattgaaatatgtttggcgctgttatttgcttacttaataatttttaaaaaatagagacaggggtcttgctctgccatacatcctgggcacaatcatagctcactgtaacctcaaattcctgggctcaggtattccttctgtctcagccttccaagtagctgtgactacgggccagcgccactgcatatctggggctttttaaaaaaggacactgaatgtacagttaggcctcacagcctcagcctcagcagaagcaagacccagtcctgcctttttccaggcagaggttggtcctaggtaaaatttcattcccaccttctagagggatgttccttcattgccttctctgcccttcctcctctcattgtactcttggtttctccacttgaaactggagaaagtcacttatgctaatagactgtggatacattctatagcttagtttgttttctttccagaggtatttgtattttcagaggaaacagcttttaaccaaaggaggaagctcctctggaatattaagttactgcaaacagggttggagagattggggtacacaaaggcactcctgaaattgcatagtttgggaagcaccttgtaggtcagctcttggtcagtctgtaggtttggcctccagtaaacttgacagccaggcagcacagagacttaaaagccagggtgaaatactgtgtcttcctaacatgtacatatctgaccctttgtatcacagcatgaggtaccatgtgctcaagtgatgaatgtaacctacaaataatagagctaggggaatcaaatgaggttggatcatagaagccaagtcttcatggggtacttaggatttgatatgagcttcaaggatggacatgtgaccccagtaagtagaggagagctgtcaggagccctcaagcaggagaagggcgtcagcagagactgcaaagtgccaaaatgtggtttctgtgcaggacagcgaggagattcactttttggtggtggagagcttgtattgagctgctgtgcaatgtcaaacaggcccgtgtctgaagatggagattgtcttctgctttgagggctgaacagagctaggaaagaatatttgagtaggggtgtaaatgaatagtgtcctttagggaaatgtgtcttctggcaatattcttgactttcccttttagcagggaaagattagggaagagtctagaaagggaactattgtggcagtgtaggcatgaagttgctcaatcaaacctggtatcaccctctaagtatttcatttaggccctggaagacatgaggatgaagaagacccattgcctgcctccagtttgtttagtctctagtgaagacgtgggccatgccaatagcactgagaggaaaaaggaaggcacatattttgagaaagattttaaaggaaaacaaaacaggtttggtggctgatagagagtgagggccaaagggaaggactggagtaaaaacccatctctgcttgtgagtagtggggctgggagaaggcatagcaggcaggagacttgggacgtggggagggagaattgggttttgttgggaaagttttgaagaactcaagttttgcgtatagtaaaatatcttggcccatcaaaagtggagatggtgagaaggtaaacaaaaatggaatctctgtaagaattgagggttagactgtagatttgaaagtcatgccatgcttcttcttttgtttttgagacagggtctcacttcatcacccaggctggagtgcagtggtgtgatgtcggctcattgcaacctctgtctcccaggttcaagcgattcttgcacctcagcctcctgagtagctggaattataggtgcacaccaccatgcccagctaattttttgtatttttagtagagatggggttttgccatgttggccaggctggtctcgaacccctgacctgaagtgatctgcccaccttggcctcccaaagtggtgggattacaggcatgagccaccccgcccggccccatgcttgttcttaagggcggtggttgaagctttgtgaaaggataagccaaagttagcagcaaaggatggaagaagaatgaggttatatgagcgtagggagtggggaggaccaaggagccagcagaggagaatcaaggcttgagatgatcaggggctggggatggagaggtgaaatgagagggtgctgtggattaggagagaaggcacacaaatgagttaaatggtacaaggtaagacctatgaatgaagttcaggaaatgttgccgttttgttaaaagagctgttaaggggtgagatgtgaacatgtgaaccagtcagatattgacgtcaatgctgcctagtcctgcgtcaccttgggcagtaaactactctcagtctcagtgtcctcattattaaaagagtgtataacggtaatatccaaagcattgagtcactgtgaaccctgaatgagatagggcatgccaaacttttagctcagtgcctggcatataggaagtgctcttgaaaacgtttagctattaccatggacaataatacattctatgacggggtgcgtgatttttggattctccaatgtgagactgcaggaagccatggaacagatttctggggaaatcttttcaaattgaggatgcttccttccccaataacctaggtggtttgggagcaggaagatggactatgttatttctggggaatacttttatgccagaaattatgatgatcctcttaggatcataattgttttttataacattgcattttattgtagtttttgctttcaaaacatttactaccttttccagtttgatttaatgaggcttctgcagagtttagagatttacctgagatgctggggaggaaacgtgagagagcgaatccacaaaatatgtccctgggaagtttatggtctggatttggggagagagtgcaaatgaaaaggagtgagcacatctgaaagcagcatgagacaagtgcaaagtgctggtccacaccgaggctgtggcactgaaaggtttcagagctggagattgatctgggtcaggtggagtccattcgagaaagtgtccttgggcttatcctgcaggattgcttgacttctaggatgtcaatgactggctgtgggtagaactaggtccctgttgctctggtttctgattcataatctcctgagccttcctcattcttccaggagcagggaccggcctccgggtcttgccaggtgtgcatgcgaggccttacatcatctgtgcttcccagccttgttttctggttatttctctcaggccctcaagactgtcactgggtgcagtggctcatgcctgtaatcccaccactttaggaggccgaggcagcctgatggcttgagctcaggagtttgagaccagcctgggcaacatggtgagactctgtttctttctttctttttttttttttttttgagacggagtctcactctgtcgcccaggctggagtgtagtggcacgctcttggctcactgcaagctccgcctcctgggttcacgccattctcctgcctcagcctcccgagtagctgggattacaggcccccaccaccatgcccggctaatttttcgtatttttagtagagatgggttttcaccctgttagccaggatggtctcgatctcctgacctcgtgatccccccgcctcagcctcccaaagtgctgggattacagccgcgagccactgcgcccggcggtgagactctgtttctacaaaaaatacaaaaacttagctggttgtgatggcacacacctgtagtcccaactacctgggaggctgaggtgggatgacctcctgagcccggggaggtcaaggctgcactgagccatgattgtgccactgcactccagcctgggcaacagagcgagaccttgtctcaaataaacaagactctcatcaaacccatgctatatctcttttccccctttgtgcccaaacccacactgccctagacgtggaatattctttccctgcgggagtctcacctgccctgcgaggcccacctcttccatggaatcatttctcatctctcagcctggagaggcactcataggactctggtcatggcttctcattcagcctcactttctcttgactgatggttagccctggacatgtctgtctcccatgttagattttgagctacttgagggaaggcatcttgggtttttgtggcagctcctgagcgtctggtccgtggtgggaatgcagcacacatgtgttaggttgaattgcctggatccttctccccagggaattctttcagccgcagccactatccagcctaaattgttcagattcactcatccacacagaagctaagtaggatgaggcccgtgctcaccagagctacttactgctctgccccagagtgagcctgccagccacagtggcagcctggtccccagagctgccgatcacctggcatagcagcaagaaggagaagcttatcttcttagatggaagtgattttagtgcttttcctggaaagccatgtcccatagctgcttggaggatgcagggagactcaaccatcccatctgtgttagccaatctgaaaagtagggcgtctgtgtcccagatgccagtaactaccctctggttgtgactgagtgacccactagggagtgggaattgctaatttcattgaaaggaaacaacagaaaggcccacttcattacctggttaaacaagcccaccttgtagcttcatcccggtccatctccaggcctcctttcgctgagccttgtttggagtatgccagtgtctttttattgccaagagatggggagaaagccattgtggaagccctgtaaggctgtggtgccttgttggtgccagctggcccctgcacatgtgtgtactcgtgtggactcgcacatggtttaggggagtgttgggcagctctggacagggcctgctctcaacttacctgttttcccttgcagtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcaggtaagagggctttcagaacccagttgcatggggctcctctagttttctcctctgcctgtgtggattgtgtgtcctttgagtgacctcgcctcctgcctctccctccttctctcttgggcctagcctttgtagctactatttcacttaccagggctcaagaaaaatatctcctcctggcactctcagttggcagcccagccagccatcagcacccagcacttggcaggccctgtgagttaaacatcatgcccttctccatgcagttgcacctttgttagcccttggggtaaatcgaggctctggaatttaatcagagagagagccaggtggagaaagctggaatctgagctcttcagggaccttttgttgaatttctgttctgctttctccatcctccatcttaaacactgcttttgcctcccatttatttgaagttaccactaacagtaatagtcttccttcgagtgcgtgcgtgtgtatcatataaatgtgtgtattttcctccttcaacccaggtttgaaggaaatctgagagatgaggaaagagcctgagtaagacttatatctcaaggttgaagcttgccaagtcaaggatattagtttggcaaaaatctgtgaaacttgtagatcctgtatgattggatttacagtgagccttgaatgtttttgctcagagaaaccttggaacgtttttttgcaggttgtttaaccaaaacacagatctgtttacctttgcttgccttagggagtaacctaagtatgggctgggtcagtttaccagcggagggggaattattgttactttgggtctcctgcttcttaatacatggttgctagggccggaggaaccctcagattccatctgtggaagttgaggggctttggcaaagatcagcaggttaattcctcattgccacagccgtgtattcagttggttctctgtggggctctgtacttagctggtgtcctctgcattcatctttaattatcagggcccattactgttgttttcttcctcttttttgtgcgtgttaaaatactcataacgtacaatttgctgttttgacccttttaagcatgcagtgtagtgatattgagtatattcatattgttttgcagccatcaccaccatccatctctagaacacttttcatcttgcaagactgaaacgctacacccatgaaataatacctctctgcccccagcccctggcaaccaccattctactttctgtctctatgcttttgcctactctaggtacctcctaagtggaattaatactatttgtcactttgtgatggacttatttcacttagcagaatgtccttaagattaatccatattgtagcatgtgtcaatttttttctttttaaggctgaataatattccattgtatgcatagaccacattttgcttatttgcttatccctcatggacacttggattgcttccacattttagctgttgtgaataatgctgctatctgtgaaaggtttttaaggacactgtttcttcgttgaaaagtgctgagtataatcatcctttggtttttaccattacctagaggctagtcttgagtgaaatataatttttggtaatccataaatggaaggcaagtcctactcatttttccttccagttgctattgagagaacacataggtacacagttgtctttcctttcttgcccttgtttgcttttggagcaactgagctggctttggcagtctcagtgcctgccttcacagacagcgtgtcatggaaggtgggatttcagcgggtgtttgatggtgatgccattcaggttgtattatacatgcctcttgcatcatgaccacttgtctttgcagctgtggaagtcagatgactttggccagacctggatcatgattcaggaacatgtcaagtccttttcttggtaagttgtgtcatctaagaaatcttgatatatgtaacctcctttctccagttctagctccttcttggtggacaaactgccctcccctgaaatgtccagcatttattcaggaaatacatttttccagatctgagaattagagctgcaagtacaatgatctcactgtgggagagagttggggggaggagaaagtaaggtatttatgagaggagtggtagagcttttgcatttttcaatcaatcagggaacccaggggaatcttgaggcccttgcatgtttgtagagtttcatttttagagcatcatattagaagtgggagttttttctctatataaaattcatgcatttcgctgggtgcagtggctcacgcctgtaatcccagcactttgggaggctgaggtgggcagatcacctgagctcgggagttcaagaccagcctggccaacatggtcaaaccctgtctctactaaaaatacaaaaattagctgagcatggtggtatgtgcctataaatcccagctacttgggaggctgaggcaagaaaactgcttcaacctgggaggcagaggttgcagtgagccgagatcgcatcactgcactgcagcctgggcgatacagtgagactctgtctcaaaaaaaaaaaaaaaaaaaaattcctgcatttgttcataacattttcttgaatgtctgttaaatataaaacctactagattcttaagggtataagaaattgaataatttatggatatagttattaaggagaggtaaggaaagacatttcaggtacgtaacacacattgtgaaagaggcacagaggtaacagacatagtatgagaagctagagagaggatttatccttccagatgggaggatcataaacagctgtgtagaggaggtggcccttgatccaggatgtgcacaacaggtaggatgtccctgtgtggaggtgtggaggacaggaattccaggcagaggaacaaagtgacttgccaaaggcacagggatgcgccaatgtggtgcttgggtagagaacatgaactcttaattttggacagtgtattgggtgaagttttgaaagggaagttggtattagaatctgcatcgcttgataaaggaatttgggctacattctgaaagcaatgaggtacccctgtagttttgtgagaagaggagtgaaataaacaggctgtacttcaagaagtacttctagaagtaaatagtaatatacttatcgtaatttactattacagtgataaagtagtataggatcttgaattatatgaatttgtacatgtgcaggcaaatgtgtaggacagatttctaggagtgggtatgctgggtcagtgggtttatctaacagctatccattcactcacatggatgactgatagatattgcaaacttgacccctcgcaaattgactcttgatcttcaccaccccaaatcagctccacctataacttttctcatttgctcaggccaaaatctttggagtcatcgttgatttcacatttgttttatgctttacattcattctatcaggaaatcctattggcttcaccttcagtatatatctagaatcttctactcaggtaccacttctagtgccagcctccagtgtcattgctcattagtctcccaactagtctttctgcgtttactcttgtttttctatcattaattctcagcatgtggtcagtttgagtctattcaaataaattagatcattttgttcctctgctttgaaccctttaatgcttcatcatttctctcagattaaatgtcagataccttcttaccacagggaacaggatatttgcaattgctgttttctctgcctaaaatgctgttaccaaagatatacttactgcttactcccttacctcattccagtctttgctcaaataacatcttctaaatgaagcccacctcatttatgcccaccttaggatcctatttaaaattgcacctggccaagtgcggtggctcatgcctgtaatcccagcaccttgggaggccgaggtgggtggaccatctgaggtcaggagttcgagaccagcctggccaacatgatgaaaccccatctccactaaaaacacaaaaagtagctgggcatggtggcgggtgcctgtagtcccagctactcgggaggctgaggcaggagaatcgcttgaacccggtaggtggaggttgcagtgagctgagattgcgtcactgcactccagcctgcgcgacagaccaagacactgtctcaataaataaataaataaataataactgtctcaatgaatgaatgaatgaatgaataaaaataaaattgcacctactcccccattactcccaatctcctgtactgtgttctgttctgttttgcagagcactttaccacattctaatatactattattatgcttattatttgtctttctcccttcaatagaatgaaagcttcccaagggcaaggacttttgtaagttttgtgcactgatatatccacagtgaataaatccttaaaattgtaactttggtagagagtgccagatttgatatagaaagtgtcaagtttgcactcatctcaacaatatagaatagtgtctccctccacagccaatgtgttagggaagaaatattatctctgtggtttaatttgcattttccttattatgagttagaacatcttttaatctgcttaagggtcatttttttttttttttgagacggagtcttgctctgttgcccaggctggagtgcagtggcgtgatcttggctcactgcaacctccgtctccagggttcaagcaattctctgcctcagcctcctgagtagctgggattacaggtgcctgccaccacgcctggctaattttatttatttttattttatattttttagtgagagtctcactctgttacccaggctggagtgcagtgacactatcatagcttacagcagcttcaaactcttgggctcaagtgatcctcccacctcaccctctcaagtagctaggactacaggcatgtgcagccatgcctagctaatttttacatttttttgtagaaaggaggtctccctatgtttcccaggctgatctcaaacacctggcctcaagcaatcctcccaccttggccttccaaagtgctgggattatggtttgttttatttatttgtttgtttgtctgtttaagtatgaccaggctggagtgtagtagcgtgatcttggctcacagcaacctctgcctcccggattcaagtgattctcctgtctcagtctcccgagaagctgggattacaggcacccaccaccatgcctggctaatttttgtatttttagtagatatgaagtttcaccatgttggccaggctggtcttgaactcccaaccttaggtgatccacccaccttggcctcccaaagtgctgagattacaggtgtgagccaccgtgcctgatctcatgcctgttttctatttgattattagtcttttcattgttggtttcaaggagctctttatatattcgagattagccctttggctgtgatatgagatagatcgtatgtgtgtgtatttatatttctatctcctagtttttcatttgtttttagacttttacttgtaattttagtcctcattaagtgtaatggtcccagaagatgtagatactgcctttgtttcttttagttctccatgtaaagtgaaatgtcttttagttggtattgcttccttagtaatagaggtaaagatggagctggtatgttgaggagccttacagctgaccatcatcagacacccatagattctgtttatgtttccacagagggtagctgtttctgacccttttgttattttccttgagcaaaagttgtgggatcttagtgaaattataaccacagtctcatccaaggacaccctctgctcaaggagaaccattagaactttcttctgctttatttgaattttaaggggaaaaattgttcttttatctgcttaagaaactataaattaagagggcaaaccagcagaattactagataagggaacatacaatttagaaattttaagttctaaaatcatattgtaccttctgcctctgtgtagatatacagatatcctgggagaaaggactggtttatctcattgaagctaatgacatgtcggttaggggattttaggctatttgtgggatttctccccctaggtttccccataataagtgaaagcgtaatctagtctctcagaataatgatatacatttgttcaacaatgcttggcgagttgggagcagcaggagtgggaaagctaaaaatttacatggtccggagcttgagattggcaagacagaacagtggaagacctggagggggctgaggggactcaaagataccctgtggagcatcattgagggatttcaggtgaggccaggtgaggctggtgactgctcagagatagagcaaggattggaatttctcaatgaggacaaagacaatagaaagtaggtgtcagtgagcgtaagacattggaagtctaagtgattgcaaagtatgagaacttgtaggtggagcagcttgcagaaatgggaggtccaaatatggattacggaagaaaattgggatgaaagtcacagttctttctatctctaggtgttggctgctgcttttggctaggaaggaataatagaggtgagctgggtctcaaaatagctcaataaaggttccttcctctctgccgttttaaaaataccaagcagcctcattttaatttgcatatcctctggctagaggaagtactttaatcagtacttctaattgtggaaaagaagagaacatgccaccacccgcccacacatgcacacagaggatctgataatgaagaatagtgttctcccacactaggaccaaagctgctggtttctccgttgccctaagaatccagattgtagggcaaaactcaagtcttgctcccattgtaaaaagaagctcttttttctttgttttttcaagacagggtattgctctgttgcccaggctggagtgcagtggcacaatcatggctcacccagcctcaaacttccaggcttcaatccacccacctcagcctcctgagtagctggggctacaggtgtacgccagcatacctggctaatttttttaaatttattttttgtagaggtggagtctcactatgttgcccaggctggtcttgaactcttgggttcaaatggtccccctccctaccctggcctcagcctcccaaagtgttgggattacaggtgtgacccactacatctggcaaaagaggttcttgtttttctgtttcttattttcctttttgggaggggtggggggaatatgctcttgacagtatatctctgaaggaatttgacacgattaccttcattattctgagagccatcatgcatatgggattgtataagggcagttacctaactgaggccttctgcttttccttgagtcatcactctgtattctcactacaagactatcttcccgactttaccatttattttttccatttgctgaatggttcccatggccttggtgttcttgagaatgttaggagacctggagcagataagttgtcctctgagctgctgtgtggggattcttgggggatcactggctcagaagttcttctccaaggtagtttggcctggtcattctatgttttcattttggattagcttcttgaattgccccacagatccaatgcagaaagtatctcttcagctaggaatactatagggtaaaatgaaatctaagacatggccttccgaggcatctatactgtgtctaggaagctcagacaaatacataatggtgaacaataaaatacagtgtctaagaggcattactgcataaaggaataagactgattctaaaaaatcacccaactaaaggggttttatacctttgtttggagttcaaactcatgtaaaaggcttggaattggatgctgcagagggatgttattgctagtgttgggagaagagaggacagcactgaggaaggcttcctggaagatgaagacttgaacttgatgacagaggagagtaggaattggatggagggatcagagtgcgtgcagagggcatctcctcacgagagtgtggtgtttgcaaaagcacagtgggagaaaggtgccctccctttctgaaggacatcaaggagatcagtatgtttgagaaagagtttgtggaagagcctcatgggagacgaaatgcacaggcagctccagattgcctagatccatgacattggtaggggacagggcagagacagggcagcgtcacttggaaggatcaggctcagaggttcatggtgtggtttctccagtaatgttcttcagaggatgtagcaccttgggaaaactctccttcattcctctgagattcataactttagaccagaaacttgcttatagcttcaagcagtcccttgcttattaattttgaaacattttatcttgtactactactttttgctcttcctaagcagggcagggttgccttgagctaaacccaggatgctttgaaaacaacataaaacaccttgcaaatggcaatttgtcccctctatcctgagtcaaggagtaaccaaagggatatgtttgaggcacagagagtatgatctgtgggtcacaccatggtaggcctaaactctagttgattatcccattgcaaaacttccatgcctctagtaattaaatgtgcaaatgataacaacctttttttttttttctgccaggggaattgatccctatgacaaaccaaataccatctacattgaacgacatgaaccctctggctactccactgtcttccgaagtacagatttcttccagtcccgggaaaaccaggaagtgatccttgaggaagtgagagattttcagcttcgggacaagtacatgtttgctacaaaggtggtggtaagttgaatgtactaaagaataaactacttttgagtttcctttgtgaagtttggcattctgtgattaaacaggtgagtttgcatacacaggaattggaaggatgtgcttgggacagattgactgaagggatctcaacattgacaacattgacgaacattccgaaagggcttggcaggtgctaggaagtcagaggagtggagaggcctaggacaaacactcaaagtggctctaggctctaggaatttggttgtttcctggtagccaagcatccttgacaaagacgtatttctttgaaatcccaatgaaaagaacaaagaatggagaggggagggtggctcagtggcttctttcctttaatcccactgcctgatttcctttaaacttatgctgatttctttgagatttttcaacacatgtcaatttacatggctaataggatgtgtagtcattggctagtgggagttaatgctctaagaaaagcagtaattaagcttccagctgtcagtaagtagcttaactctcagcctttgggaaaatcttccccttgatttgatgtgttggagccagatgccgaaatggtgggcttgctcattcaaaaccagagttgattacttaacaggacttgtcttgaaattgtattgagttcagtctttatcaccctggttgtaaaggaaaaaaccaggcccagtcaagggcaggtggggctcttatttctgggaggctactagcttgctttcctgatggtgcccttcccttgttgactcagggtctgttgaaggcctttgctaactgggaggttactctgttgtctttcactgttaaccttagagactgaaatcagacgtaatcttttccttcagattctcatttacttctataattggtagcaggccaggtggaagtaggtcaaccttcttagtaggattttagggtcaagagaggatctccccagcaggaaaagcagggagtaaggacagaatgagaagagagatgtgggtggctaaaggctagaggcatttccagttacataccttgcaaaatgttctgaaaaaccattagcctatggcagtttttcttgtcaggccatttgcattgacccatagacattggttcagtgccttcctgccttgactgtttctttatctttctcttaaacacacatgcacaaatatgtacagcagcccagaaacataagcatcctcgaatggctttgggcagggatggggtgatgggaacacacagataagaaatcaggcccaagcactggtgccttgtgacatcagttggacagtcttgagttttcagtatggtctaaaaccttgtcttcagttctccagggtttataggccttttctgccttaatgccttgggcctggagttattgtgtgattttaattctgaactctaaaacacattgactgactgcctggtttgtcctcctttttgcttgaaccagggcaggatggatagctgttgtgcatttctcttaaccgggttatttctaggtgtcacggtcgagagtttaagttatatcccagctgggccgggcatggtggctcatgcctgtaatcccagcactttgggagtctgaggtgggtggatcacttgaggtcagtagtttgagacgagcctggtcaacatggtgaaaccccgtctctactaaaaatacaaaaattagtctggtgtggtggcacatgcttgtaatcccagctactcggaaggccgaggcaggagaattgcttgaatttgggaggtggaggttgcagtgagccaaaatcatgccattgcactccaatctgagcaacagagcaagactctgtctcaaaaaaaaaaaaaaagttatattctagctggagctttctgtgccctccattctagtctaacagctatgtctgttctccagatgtatctgatttacagagtgcctgtggtgagtttttaattaaacctggccagtggtaagattaggggtcatgtttgttttgatctcaccgatacagtacccagtgccttgcgctatgtttgatacgcagcagatgcgcaatagagttgaatgaatgccatgtttgcccacctaatttaaaaagtagtcaatttttagaaatttggtgggagacgtattaaatttttggtacttttataggcaattcttaactctctgtatggcttatttatttatatgctgttggtggcaaaattgtagttatgagctggctcctccttctgcacatggatgagccaccagattccagggtcagtggtattagtgagaggatgtaggtaagatgagttaggccaccactgagaggtgtttcccaaattgtggtcttaggagtacccacgtcagcatcaggcaaggacagttgttacaagtgcagattgcagggctcaaatgcacttttccccagatcatcccaaggttgtctaacaatcaccagtttgagaaactctgccctgagccttctacaggcagatgcttcaaatgacagagttgtactactgtctagggaatatttctcaagggatggattgatgggaaaagaaacacaactggctgtggatagcacacaaaatatgtgctttcctcctttttattacatcagactgctaaacgacaaggataaacaaagttggcctcggtcagataatcccctcccagtaagagtgttgaaacctgcaagtgtaactttttatctggggtctgcctagctctaaggctgcctgagcttgggaaattccagctggctttagtgttaaatgaattcaaatcaaattgggaaaatcaaagaactgattttaaagctacagaaagctggttttgcatgattaactcttttgcttccttccagcaccatgaatgattacagtcctttgcaagctactgtttcagccccctggcttctggactggagctggtgtccaggtcttcagaacctcctggtaccctgttggcctcgctctggctttataatgtgctttgtattttttgcccttaagttgccttgtttaatttttattccttgctttttgacatgaagttcacttatttgtcttcatagtgtacatcaaaatgatagggccattaaagaaacaatgaggttcctctgtgatttgttaatttggtaatatacaactgttaggctctttcagtagataacagtaattgctgaaaagcttgaggtgggtcagggttagctactcccctacaacctcacaacctcataacctcactaccagattaagattatcatgcaagccaggcccagatatttcttgcacaaatgtgtatcagtaagcaaagacatgatctgtggacttgaagtctcttctgtgaccttacagatgatgcagccacccacgccttgcatgctgcagacgctgtgttctagagtggatgctaggaaactatggcccaccacctgtttttgtaaatgaagttttactgggacacagccatgctcattgcttatttgtggtctaaggttgctttcatgcccagtggtagagttgcataggtacctatacagaggcaatatggctccaaaagcctaaaatatctattatctggacctttacagatagttgtctgacttcctgtagttgctgactatgctgatagttgtctgttaccccttcagttggcatcaggtaactggaatcgcaatgtcttgacaggtcccaggcattatccagaaaagtataggttatgggcctctctaaattgttatgccctgttaatgacaggatggtatctttagaatattatgcccaattcaagtattttgatgtcacaccagtctcccaagtgagggtccatgtgtattttcatgattctgactaagcaaccacgaatttcactattgaaaaccaattttcaaccttaagctaatttgctctctaatgttgatcagaggtaacagaacagtttagtaactgctacagggtgttgtgggcttctagatgagaaatcagctgacaaaactgtgttgtgaattataggataactgacccaaaccaaactacttataaattattttaactatgttacttaaatgtataagcacccaatgcttataactctcatacgtgatcaataaaacccagatatttacagattaaaaataaaactataacaatacatttaaaattaatatttgttacaactgtgttgagatacaattcacattctgcaaaatttaccctttttaagtgtgcaatttagtggtttttagtttattcataaggttatacaatgatcatcattacctaattccaaatatttttatcacctcagaaagaaaccacatacccattaccattacttccttctcctccctgatgctggtaaccactaacctagtatctttatggctttttcaattttgggcaatttgtgtaatggaaatcatacaatttgtgactttattagtccattttcatactgctatgatgaaatgcccgacactgggttatttataaagaaaaagaggtttaatagactcacagttccacatggctggagaggcctcacaatcaaggcggaaggtgaaggaggagcaaaggcatggcttacgtggcggcaggcaagagagtgtgtgcaggggaactgccctttataaaaccatcagattttgtgagacttattcattatcatgagaacagcacaggaaaacccgcccccatgattcagttacctcccaccaggtccctcccatgacatgtggggattatgggagctacaattcaagatgagatttgggtggggacacagccaaaccatatcagtgaccttttgtgactggtttctttcacagtataatgttttcaagtttcatttatgttgtagcatgtatcattactttaaccatttttaatggctgactagtattgtaatgaatataacacattttatttatccatctattagttggtggccatttggcttgtgtctactgttttactgttacaaacagtgctgctgtgaatgttcgtgtgcacgtttgtgtgtgaacttatgttttaattctgttagtttatacctgggagcgtaactactgggtcatgtgacaattctttttttttttttttttgagatggagtctcactctgtcgctcaggctggagtgcagtggtgtgatctcggctcactgcaagctccgcctcctgggttcatgccattctcctgtctcagcctcccgagtagctgggactacaggtgcccgccgccacacctggctaattttttgtattttttagtagagacagggtttcactgtgttagccaggatggtctcgatctcttaacctcgtgatccacccacctcggactcccaaagtgctgggattacaggcgtgagccaccatgcccggccgacaattctatgtttaacttttcgagaatcggtcaagtggttttccaaaactattgtaccattttatattcccaccagaaatgtattagggtgtagttttcccatatccttgtcaacatttgctactgttttttggatgatagccatcccagttaagtgtgaagtggtatcttatggttttcatttgaattcctgatggctaaggatgttgaacatcttttcacgtggctgttggccatttgtatgtctttcttggatggatgtctattcaagtcctttgtccgtttttaaattgggttcttttttattgttgagttataatagttctttattctatatattctttatatacaagttatatgatttgcaaatcttttctgccattccgtggtttatctttttacttttttctttttcagcactgaagtttttatttttattttatttttttgagttgggggtcttcctctgtcacccaggctggagtacagcggagcgattgtggctcactgcagccgtgatcttcgtgtgctcaagcaatcctcctatctcagcctcccaagtagctgggaccacaggcatgtgccaccatacctgttaatttttttattttttgtagagacggggtttcatcatgttgcccaggctggtctcaaactcctgggctcaagcagtcctcccaccttggcctcccaaagtgttgggattgtaggcacgagccaccatgcccagccgtgtttttaattttgatgaagttcagtttatccatttttttttgctgcctgtgctgttgttatatccaagaaactattgcctaatctgaggtcatgaatatatacttccctttcctttaagagttatgtagttttagttcttacagtctatgattcattttcaattaatttttgtatctagtgtgaaatagttatttaccttcattcttttgcatgtggataaccagttgtcccaccaccatttgttgaaaaggctatactttttccttggcaccttggttggaaattattttctcataaatatgagaatttatttctggactccttctctctttttttttgagacagttttgctgtcacctaggctggaatatagtggcatggtcatggctcactgcagctttgaactcccaggcttaaaggtcctcctgccccagcctcctgagtagctgcaactgcaggcattcaccactgtgcctggctaagtttttgaagagacagggtctcactatgttgcccaggccactgcacctggcctgtttctggactcttaattctattccattaatctgtatatctacccctatgccagcatcacactgtcttgattactgtagttctctaataagttttgaatttggaaaatttgaactctccaactttgttctttttcaagattgtattggctattctgggttccttgcatttccatgtgtattttaagatcagcttgtcaattttttgccaaaacaaaacaaaaaccacagataggattttgatagagattgatctacagattcaacacaatttggagagtgttatcatcttaatatatcatgccttccaatgcatggacaaaggatattcttccatttatttaggttttctttaatttctttcaactgggttttctggttttcagtgtacaagtcccggacttctttagttaaaatttttttcctggctgggcgcggtggctcacgcctgtaatatcagcactttgggaggctgaggtgggcggatcacgaggccaggagttcgagaccagcctggccaatatggcgaaaccccgtctctactaaaaatacaaaaattagctgggcgtggtggagcgcacctgtagtcctagctactcgggagactgaggccgaagaatctcttgaacctgggaggtggagattgcagtgagctgagatcgtgccactgcactccagcctgggcgacagagcgagactctgtctcaaaaaaaaaaatttcctaagtattctttttggctccattgtaaatggttcttttctaaatttcattttcagattgttcattgctaatatatagaacatgattgatttttgtattattgatcttatattctacaaccttgctgaactttattagttctaacttttttggtgtgtggattccttaggattttctgtttacaagatgatgttgtctgctaaaagagacaacatcatcctttaattcttccttttcagtctggaggccttttatttatttatttttttgcccaactgccttgggtagaacctctagtaaaatgttgactaggagtggagagagtaggcatccttgtcttattcctgatcttaggggaaatgcattcagtcttattaagtatgatttttaactgtgaggtttttctagatgtcctttatcaatttgaggaaggttcccttctattcatgggttgttgagtgtttttatcatgaaaaaatctgggattttgtcagtgctttttctgtgtcagttgcaatgatcatatgtttcttttttttcctcctttagtctattaacattgaatattacactgatggatctttctcatatgttaaaccaatgcacatttttggaatgaatcccacatgctcttggtttataatcatttttatcctttaatttgtttggcagaatttaccatctttgtgggaagttttctggatactaattcaatcttttcagtttttaaaatttctctttggttcagtttcagcagtttgtatctttctagtaatttgttcatttattctaggttatttaatttttaattattcatagtgttcacactaatcttttttttatttctgtgaggttgttaatgatgtttcttatttctttcctaattttagtaatttgagtcttctctttttttcttggtaagtctagcttgtagtctagtttattaaatgttgttaatcttttcaaagaatcaatatattgtttgagtaattttctttattatttttctcttctctatttcatttattcctactgtaatctttatatttctttcattctgcttgctttgggcttagtttgcccttatgtttctatgttcttaaggtggatagtcaggttattgatttgatatttttcttctttttttatataagtgattacaggtatacattttcctctaatcactgctttagctgcatttcatatgcttatgttttcattttcattcatcttaaagtattttctaatgattcttgtgattccttttgacttcattgatgatttttgaatgtgttgtttaatttcaatatatttgtgaatttccttcactttttggtttctcattttattctattatgatcacagaatgtactttatatggtttcagttctttttaaatgtattggggcctattttaatacttaacatctgttatccttgagaatgtggctgaacatgtggaatgaaacatgtgctttgagaagaatgtgtattctgctgttattgggtattatgttctataagtgtttattaaatctacttggctgatggtgatgttcagtttatctttttccttttctgccttgttctatattgaaggtgggaaaatcttcaactgttgaaatctttaagtattatcatcttgattatttatttctcccttcaattctgtcagttttccctcatgtgctttggagttctgttgttaggtgcatatatgtttatgattgttaattcttctagattgacacttttatcattattaaatgtccttccttgtctctagtaactattttttgtcttaaattctattttgcctattattatagctattcttttcttctgggtacagtaaacatggtgtattagtccgttttcatgctgctgataaagacatacccaacactgggcaatttacaaaaaaggtttataatggacttacagttccatgtggctgggaagcctcacaatcatggtggaaggcaagcaggagcaagtcatgtcttacatggatggcagcaggcaaagagagctcatgcagggaaactcctcctttttaaaaccatcagatctcatgagacttattcactatcaggagaacagtgataacactatcatggaaaagacctgcccccatggttcagttacctcccacctggtccctcccatgacatgtgggaattcaagatgagatttgggtggggacacagccaaaccatatcacatggcatatcactttttcatccttgtagtttcaatctatttgtatctttgaatccttgtaaatagcatatggttgtgtcaggtcttttatgcattcttttaatttctgccttttgattaggatgtttaatttacttacatttaatgtaattactgaaaggtagactacatatctgctattttgctctttgctttctatattcctgataaattttttttggatcctttattacttcattactgcctttttttgtattaaatacagattttctagggtgacatttaaattcccttgtaccttctttcactaaatttttcccaggtgttttcttaatctgtgctttggggattacaataaatatcttaatttatgaaatctaatttggattaataacaatgtaacttcagtagtgtacaaaatctttgtcattatatagctttattgtgtccctgcttttgtgctattattgtttcatctttatactctttaagcccatcagcacagttttagtctaattgaggactccttagatgagtcatttttctttgctgctttccaaggttctttatctttggctttcagcagttttactgtggtgtgtctgggtatgggtctctgagtttatccttttaggaattcattgagctgactggatttatgttttttatcaaatttggggagttttgggtcattatttcttcaaatattctttctcctttattctctcatctcgtcagtgactttggtaatgtgtatgtcaggacacttgatggtgtttcctgggtcttttaggctgtttatttttaacattcttttttttgttgtcagactgagacatcacaattgacatgtcttaaagttcactgcttttttattttcctggttcaaatcttctgttgaacccctctactaaatttttcttttattatacttttcaactcccaaatttctatttgcttgtttttaaaaaatatttctatttctttattgatattctctatttgatgaggcattgttctcatactgtcctttcatactttatacatgatttcttttagtcctttgaacatatttataatagcttatttaatttttttttttacttagtctaatgtctgagcttttaaggacaatttctactgactactctttttgtttgtgtataggctatactttgttgtttctttgcttgtcctgtgattttttttgttgaaaactggacattttaaatggtgtggtacctccaaaccactgacaccccttcctcagggttttgtgttgttgctgtttgttgttgctgtttttgttgttgttgttattgttgttcagggagtttcctgtactgctatcaagtttgtgttctttattgtttttgctactgaattgtctcgtaatttagcttattggtcagctaatgataagacagagattttcttaaactctttgaaccactaagtctctcagcctttgctaatggcctctgggtgtgtgttagggtataccttcaatgcttttgcaggcagtttacaactctgtcctagccttcacttcctgcttatgtagagcttcaagattagctggaggtaagagactagaccccgttcatttctttcttgagcatactcacggctcttatgtgcttgaccttgtagagtcccaggaatactcatctagagcttattaaagcctcctaagggcatcttcttccccattttttccttttaagctttttagttagcctctttttaattcccaattggtaatactgtcttcagaagttacagtgataagcctttgctaatttttattcactattttcagtaaatgccttggctggctataaggctgtctatatcatgaaccaagtcaggctatgtaaagacaagagctgataatgcagccttcctgtgagcccccagacaggtcaggctttttgggaactccagacctattctgtcctctccagtggctgccaggctgctgtttttcacagctattgtagatgtgaggctgtgggtttccaaggctaccacagagctagagagagggggatgggattagggcaaatgaaaacatcacaaagctggctatttttgccaagattcagccattgttcttgagtaaatgtgccttggatttttgcaaccctttatttcatttgcagaattctgaaaaagttgattttgaggatttttgtcagtgtttttcttgcttttatggataagtatatttttagagttcctagaaatgcttccaattaatattaactttgtaaactttattataggcattttccaacctacacgaaagaacagttaatgctgatatgacctccccacgtgccctcaccaacttcaatattacttacctacatttgccaacctctccttagctatctactcactacttttttttccccctggaatatcccagatgtcggattttagctatgtttcatttatgattttttttttttttttgtaaacaacattaaggtggatgaggatgttttgctgaacctttgttgctgctccaagggaggatgtgacccatggctctggtgcttctgaactagtggccctgtgcttccccatgccttgggagggcttagttctttacccattttctctagctgagctgccatgcaactttcagtgggatagctcattgcagtatcctttggcctttacttgataagaatgtcctttatttagttcctttactcctcttttctccttgatcctccgtttctttttgctcttgacacaatctcaaatataaatggaaattcaggttattcagatacctagatgaatttatttatttaattatttattttttttctgagatggagtcttgctctgttgccaggctggagtgcagcggcatgatctcggctcaccgcaacctccgcctcctgggttcaggtgattctcctgtctcagcctcccgagtagctgggattacaggcatactctaccatgcctagctaatttttctatttttagtagagacggggtttcaccatgtcggccaggatgatcttgatctcttgacctcgtgatctgcccacctcggcctcccaaagtgctgggattacaggtatgagccactgcacccagcagaatttatttttagttatcagaaatgaaaacacaaaattaaaaaaaatcttcttataaattctcagactctataagattgaattagattcaaatatttaaatcatttctactagttgatgaagtttgtgcatttgtggatgtattagttggtacaacctttcaggagggctatttcatgatagctatcaaaaatacaaattttgacttaataattcttctaagactgcatcctaccaatggtattgtgcagttctgaaaaagtaataaatacatgcttatttatatgtgtgtgtgtttaagaatgtttctggaaataactaaagtgcccaccaatagctgttaagtggaaagatgtctaagatacattgccaatgataaaattttaaattgtgggacagtaagatacactgttaatggaaaaagttaagtaatacaacagcatttatatcatgatccaaattatatgtgaaaaattaaattgcctctgtcagtttagaactatattaggttgctggtaatagactagaaataaaaattgcttaaccaagtcaggagtttagttttctcccccttgctgcctggaggtaggctgtcttgggctggtatgttggtgtcctgatgttcttggggatccaggtttctgtcttaatgttctgccatcctgactagtgatttccattctcaagattacctcatggttcaagacatccatactagccttcaagtccttattgcagttaagaagaataaggaaagacagcaagtaggacctcttcccaccaattctgtctgtttaggcagccttctcagaaatccagcacgaaacttctgtttttatctcattgactagtacttagtcacgtgacttcccataggtgcaaaaatggtagagaagtgcagtcatttattctgggtggtgtcagagtcccactgctcaggaggaaagggataatgggtgttgggggtaggtgtagcagtgtctgtcactatgtacatatgcttgcatgtggtggcacagtacatttctgaaaggatgcacaagagctgttagccactgggcactctgcagggtagagtgggaggagggatgtggagatcagagcagagcttctgcatttaccttatacccatctgtgctgttggatattttccatgagtatgctttgctttttaataatagtgataaaaaacaaaccaacccaaaacctatggtttattaagaaaaatctcagagccttacaatacatcttataatcactagtgtgccatagtttaattgttaatatatttcttggtggaagtaaaacaatacagtaactctttaaaaatccattaagaatgaacctgaattgtccaggtttaggaataattctccaagaaggtagtgggatcgatgcattttgagattttttttttgatgattgtagtattctgtgatttttgcatttatgaggtaagactgacctgtgaaatatattcttaatactcaggcctcccagcagcaatcgttaagtatttttaactaatgatgggcctgggtgtcattgagaaatcactctttttaaagttatactcacagttggaagtcgtaaaaaacaaagcataaaaatgtatatttcattgatatgttcctctatatattcacaaaaatgtatgtgtataggctgacttaaactaatcatctgacatagccatgacattttatcaacttaatgaaggcttttggaatttatatgtaacaattttgctgggaactgttttcttattcagttaatatgcttttacatttttaatagatccatcatttcctacggccctatgtttagtacaagctattaatatggttttcaggtttccattttggtgggcagtctttcgtacctctctgcctgatttctttaaaacaaactacttttaaccatttgttcagtggtgatttgaatgtctgctgctcaaatggattaaaagtaactttgtctttatcagctgggtcctcacagtatttatggggcatgtttgagcacagggtactgaatcgttatattgcagataaaataaatggatatgttccttactctataggaagttaatatctataataaacagcaacctagtcaaggataagtgaagccaaagtaacccctctggctgggaatcccaacatctcaatatgtttaatagtcatttgtatgattatgtccacatgagggtatgcctccctgtgtctttcctgatagatatgcaacatttgccttcagcttctggccatgttcttttagagctggaagaaaccacacagagtttttataatagttcttatccttttttgagtggtggactttcttgagaatctgataaaacgtacggagcctccatagcaaaataaatgagtgtatataaaaaaatttgcatatatgtttacagggttgctggaccatttaaacccatctacagggaagtcttgatccaaataagcttctccttttgtatatgaataaactgaaagctagagagatttctatcattttctcagttggtagagctagctcttaatctatgcttttatacacatttccaagattcttgctgtgacttaaaaatctctaaaatgcaatgtgatgtggtcaacatcatgttgaatactctaccaatgaatatgtattctagcaaaagaccttcctcaatgagattattcagagatggaaaaccagaatcaatgaagattctctcaagtcttggtgcaaattaaaaccttgtgactggagcatccttgtaatctaaaaataggagtagaaagaagaaaagaacatgttttgtgtgcatggtgtgtggctgatctcaccctttagtggtttgggggccgtaggctcctccctgcgtgtttcttcagcctcatcacacaatcctctttctatctcttactctgttgaagtgttggcagcctccaaaaacctcctctagtccaagttctaccatcataccatttccttatctaatatccatggagtgtctagtgtctgttgcaaaccgggtatctaagatgaagcagtacaacccaaactgcccagtgatggcagacattgcaaaaacatgaatttgcaatcacagtctctattttgtgtttccagtagaactggaagaatctgactcttctatttttatttttgctgcttttgaatgactgtaatgtggcaccattaatttttttttctcctcttccttggcagcatctcttgggcagtgaacagcagtcttctgtccagctctgggtctcctttggccggaagcccatgagagcagcccagtttgtcacaagacatcctattaatgtgagtggggtctgcttgaggatgggaagaagtatcattgtctttatgcagaggtcagaggaaggttgttgcagggatggcctgctggagtggatattttatggcgcctccctgaagtcaggtctctagagagtgcagctatgctttgggcatcgtggtctgtggttcccacttcactgaagcagagctgaacgagagacttagtttgctttaagtggagcagcactggcagagagaggttcgagccagagtcagtgccatctgagcaacgtgccagtactgaagcaatgggaagtttgtgcatgataggatctttttttattaagtaactgctggattgcttgcaggggatgaattccagcagaggataggatttgggtcccaccttttagaaacaggctggagagactaaaaactgagtagcagaagaaaccagacataagcaaatgcttaaatatgcagctttataacatgaagatggataggaaaagtctgcatgggatgggtcattagaggagctgccacagggagacggtcacagtgaaacgtcttgacattggcaggtggtttggtgaaaggtaagtagctcacttacttaccttccaccaaatgagtgggatcatacggagaacagtcatgccagtcctttgctagtttctatggattctgctttcctttggtcaccttaggaaaaataaagggaagtgcattaacccgtattgtactttgtacgaatgaaagttctcatgggaaaatgagggagacattattaacggaaagaggtttgtaggtcatttgtgcagtgcagtggcccattattttgtgccccatttgccagtaaggggcccgctaagctgcagatctgcctcaggttctccaaagggaaagtcgccaaagcttctttgccaaggttagggagcttcccgtgggctttaggccaacattcatcgctagaacatttgaaagtcattgcttccgtgtgtatagtaaaagcccacagggcacatttgttttttgacgtatcttttttgacttttgattccaaaggaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtaaggagactgtgagtccttctcctgccttcttaggccaacacaaccattagcttctctctggttctgtggttttcaacattagctgcccatgtggatacacccggggagctttcggaaacccgatgcctggctcacgtgcgcagagatcaccatgggatgggtttggggtgtggccaggttatgaggatcttaagaagcgccctaggtgattcttacgtgcagccaagtctgagaactacagctctaggtaacatttagggtccgagctactgtgttaatcacttccttgagctgcttttgttcagttttctggttttgtggtttctgagcagtgaaaaacagcacttggtaaatatcagtcagtgagagctggcatatgcggccagtggatcaggttaattgatgtcattactctttttaagagataatcggacggtgttttgtaaagaaaggcaccaacgtcattgatcctttgtctgtaaatcatgtgtttagagctgttttgtagtccagcagtgggcggtctcggagcaccacacccatcaaggggtggtggaggagttgggggtttgggagggatgaattggttcttaagatccgttcagggccatttattctgatttgtcgtttgacaaccagacttgtgtgacctgtgtggctgtggttagagtcccctctgctcttggaaagagtctcccgtgtgaagctgactggtctggggtggggtctggctctccagccatgacaaccaggtctgagggcatgcccctgtgcccactgtttctgggcaattcattccgttgtcagtttattcacaggtatgctgctgctctctgccagacagtgttctaggtatagccacaaagtaatgtatgaagcaataaaatatcagaacaaagtccctcttccatggagtttgtattctagttggggaagatagaatataagcaaatatgtgatctgcctggtaacatgttgaaaagaagaataaagcaagatcaggggatggggatttgcaacggtgttcttttattctattggctgcttcaggagggggacatttaagcaggtgcctgaattacatgagggaaggaaccaggcagacccctgggggagtagcgctgcaagcagggcagacaggaagcacagtgactctgaggctggactgcactggtgttttaggagcagggaggaggccagggtggctggaagggctgcagagagggagagagaaggaagaaacaggacctaagagagcagggctcagatcctatagggccttcaggggcttgtgaagaactttgtttttttcttttttgttgtttttgtttgtttgtttgtttttgagatggagtctcgctctgtcgcccaggctggagtgcagtggtgcaatcttgggtcactgcaaccgccgcttcctgggttcaagtgattctcctgccttagcctcaaaagtagctgggattacaggtgtgcaccaccaggccaggctaatttttatatttttagtagagacagcaccatgttggccaggctgatctcaaactcctgacctcaagtgatctgcccgccttggactcccaaagtgctgggattacagatatgagccaacacactcaatcctgtcttttccttcgaaatgagatggaaggtttagaccaggagatggacatgatctgatttaacctttcaatttttttccgttaaaatctgtgaattgcattatataatgaaaagaatataacacataaatggatagtgttctaaataattataagtgagcactcatgtggcttatcttttacaggagttatcctcaatgctgtgtgggaatttgactactgtgactactgtaggggacaaaggtgggaacaggaagactagttgtgaaagtattgcagagatacaggccagtagggatggatgttggctggacccagggtggtcacactagagacgctggaaatggtcagaccctaaatatattttgaaagtagagccaatgggatttgttgatagatgggacgaggggtacgaaaggaggaggagccaggggactgctactgcttcacccgagctgcctttaaagagatggccacacagggagtcagggagagctggggcaggggcaatattggggggagatcaccagcttggtttgggacttacctggttggagaggcctattggatatccatgtgcccagccttctacctggcctctgacagtgcttttccacttcctgtttcttctcttttggaggtgctgtcatcttttattcctttcctcccctgacatagactcatggattaattattatttaatgtgttataaaccattcctgccatgatacattttgatgctcagcttgtcctggtttggtcagtggcggaccctacctccttctgtttggttcttgtcgttttttattgaaaaaattatttactggccgggcatggtggctcacgcctgtaaacccagcactttgggaggccaagatgggtagatcacgaggttaggagatcgagaccatcttggctaatgtggtgaaagcccatctctactaaaaatacaaaaattagctgggcgtggtggcacgtacctatagtcccagctacttgggaggctgaggcaggagaaatgcttgaacctgggaggtagaggatgcagtgagccaagatcgtgctactgcacttcagcctgggcgacagagcgagactctgtctcaaaaaaaaaaaattatttattgaggtgaaatgtatataacatcagcttaactgttttaaagtgggcaattcagtggcattcaatacatttacaatgttgtgccaccgccacctctgtttaatttcatggccttctcatttctccaaaagagaaccccatgcccattaagccgcttctctccaccgtccccttctcccagcccctggcagccgtcagtctgatttctgtgtctgtggatttttccctattttacaggatgtttcatataaatggaatcatacaataatatgtgaccttctgtgtctggcttctttcacttagcctaatgttttcaaggttcatccgtgagtaccatatatcagtgcctcattcattttaatgggtgaataatattctccttttaaaaataattaaaataatgaatcactatccctcagacctttcactgactctttaatttttcttttttcaccattgaaagcccctggctgtggaatggaaaagtcacagcttgctaaatattttctcgtcttcctcatttgtcagatattcagggtgaatgtttcatgctgggacagagtatgagccagaagccagagcgatggccctttacagagtcatgaaggcctcccctccttgcctgagcgcacagtccagtgaagaaactggaaatagattcacgtcaagagtcataggccaacgtcccactcagttttctcattgttctcagattttatctgaggactagagaggttccattatactcagttgagtgatgttttgtcatctgcatctcaatctcagccaggtgaaatgggataaaggtgaattagcacatcgtgtgggcaggctggtttagagtaaactgctatgtgaaatgagcaagtctttgaactgaataggaaagagtggtgtctgggaactgcttctgatttactcagagacatggagaaagagctctttctagggaatgaccctggccctggtgggatgtgccaggtgggagtctcatggaaagcactagctagatgttggatgctttggaggaactaatgtgctgaggagatgtcagccccgtgggtcaccttagggaggggcatgggcccagttggtgggggtattgccagggcatggattctgcactgagtggggctataggggacctggtgagcttcctggtaagccttggcccagggcactctgggaagaaggggagaagtgccctggggagggccagtgaggataaaatggaagaaagtagaccctcagagaaagtacttagggtggggcagattgttgcagggcaggtcaagtgggggaaaggaaaggatgggctgggacttctggtgaaggagcatgtgaggtacaggaagacaggcttctgcttagaagtaaaagataaaactccaggaatccgactcgggaaagaaacagggctcatctaaatgagagaaactcaggcctcccagatatctagaagaagcccataaccagtgggatgacaggtttatgatgataaccctcagagaggtagagcagaggtcagcagagaaggaggaatcgagaccttcagctggttcctaaggaagcccctgaaaaataactgaactagacctaaggaaaccacatgtcagagaatttggtctcaactccagcatttcattcggcactctgctcagtccctcagcctgaagctgctttggtggggctcctagtgttccttttcctgcctcagaggttgttgtttgggtctttctgtctgaggtggcagggcagtcatccagctgaagagattgtgtggagatggttgatggaggacagcgtttctcggctttattgtgtagccggtggcttagaacccctgaagtaaagggcaagcttccagtcttttttctttttctttttttttttttttgagttggagtctcgctctgtcaccaggctggagtgcagtggcacgatctcagctcactgcaacctccgcctcccgggttcaagcgattctcctgcctcagcctcccaagtagctgggactacaggcacgtgccaccatgcccagctaatttttgtattattaatagagatggggtttcactatgttggccaggatggtctcgatctcttgaccttgtgatctgcccccttcagcctcccaaagtgctgggattacaggtgtgagccaccatgcccggccaagcttccagtcttaacagccacctatgaaccctggttacaatttctcagagatccgctctatttgtaatgcgtgtatcattttagcgcaaaaccacttccctgtggctgtggcatcagggtatccgcatggtagataaagcctgggaaacccatattctctctctctttttttttttttgagacggagtctcgctctgtcgcccaggctggttggagtgcagtggcgcgatctcggctcactgcaagctccgcgtcccgggttcatgccgtccatattctcttaagaatataaccccaagctttctagagccatccttgctatatgtacagtttctttaggaaagaatcgacaggttctgctgagcttcctgacagaaaaccctgtgggcttctatctgatcagggtgttggataattaggttgtaagtacctggagaggggctgtgtaaccctgagctaggttcctacagattgggttgaattttaagcctcagcactgttattaatgtcttgcaagtctgacttaatgatttctgtttttgaaggctcactggaggatttggagtcaatttcgttagtgatgtaatagatgtgactctttcgtcaacttttgtatgttatattcatcattctaaaccccctgttaggaattgttggtcagacaagccttttgaccctaaaagttgaaaagaaacaaattttttaaaatagcagattatctggctggacatggtggctcatgcctgtaatcccagcactttgggaggccaaggcaggtgcatcacttgagctgaggagttcaagaccagcctcggcaacatggcgaaaccccatctctaccaaaaaataaaaaaaattagctgggcatagtggcacacacctgtagtcccagctacttgggaggctgaggtgtgaggatcattgaggatcatctgagtctgggaggttgaggctgcagtgagccatgattgcaccactgcactcctgcctgggcagcagtaagactgtctccaaaaaaaaaggaatgaagttctaacaatgtgctataatgtggatgaaccttgaaagcattatgctaagtgaaagtaaccagatacaaaagaccacatattgcagattccatttatatgaaatgtctagataggccaattcataaacacatggagcagatgagtggtttccagggcttgggaagggaagaggaaatggagagtgactgccagtgggtatgaggtttccttttggaatgatgaaatgttctggaactagatagtaatgatagttgcacaacattgtgaatgtgcttaatgccacaaaattgtatacttttaaatggtcaaattttatgttatttacaataacaagcaaataccaattcaggttcatagctgtttattttcatattgtaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgaggtattgatgctttaatcttcttttgctttttaatataaaggaaagagccctgctctgtggtagtttcctatgtctagtatttattgaaaaaatacaagatcacatggtattctattaatatcacatggagcagacttctatttgtgttgctacacttgcagttcccaaactctgctccaaggtcttgctaccacttctgggcagaagcaactcagaaaaaaaaaaaaaaaagtagtattcgtttttagtactacttgtttagttagaccattacttggtcttttggatttttgaattttgtttgtccatggtgggctatgtggacactcccctatataatgtatctgtggcccttgggaaaattcttttggagactcttaccttagaatttacttcttggtttttcttctctatttggcaatgggtcttggcttaccacatcaaatctaattttggaaagaggcagcctataaatggatatagacaaatatctgggtacttcctcttccctcaatagtgtcttctacagcagcttggtgagatcctgggatagttggggcttgggtgtttttgagcgtgctgtgggggtcaggctttagttaaatcgaattaatggtatcattcaaattcagctttctgtttccctgactaatcagtttatttatgaactgtcgttcatcagctttaggtataggtttcttcttctgagtttaggtggtggaaggaatgtataggaaatgggtaagtctgattacctgaggttacagaaactcttcaatgaatagacttccttgcaggcagagaagcatgagtcagaaagaggagtgagcaaataaatatttctttgagacccagcctaatttgttccagttttcattggtcaaactgagactctagcaagacagatacttgttagagatccttttatgacaaaaataagtagcaaataatccagcaaaccttgctaccatttttacctgaccataaccacataagcacatagtcctcctgtgcagaaccctggccacatctgagtaacattgaacaagctctttctgaccaggagaactgagtgtgaccatatggcaaagggtgttgtcctgattgcttgcagagctatgaaaatctggacatgagtgatggaggccagactgaatcgcttgaagccttgccctgtatacctacacctttgtgcaaatgtaaaatacataggaaaaaatttagtgctaatcctttgctttttatatctcattgatactgtacatcaggggagcttttccatgagacttatgacttctgattcttggtctttcttatgacagaattgctggaatcatgtttgaaatatgtctctgacttagaaagtgaatatgacaaaatcatttcatttctctttagttctgagtcacttgagaggatctctgagtgataggatgagatgatgactttcccatctacttgagttgacactgatttctaattgttattccctgagagtctcagaaggcctttttaagttgtaattgttctcttcttccacgggacatttatgtgggttcagatgatcctctctgtctggggggtgtggggacagctgggctgtgagtctggtttcccctgggccaggcctccttgccccgtgtcagctgcactgccctcacacaggccgcagggtttacagggaacgctaggcatggtatcatgtgctgacactgcctgaaactttggttgtatagctttcccagggctgttcccttcatctggctcagcgcctcagtcagctcctcaacctccagctccggagaatgcccatcctgtccaaggagtcggctccaggcctcatcatcgccactggtaagtgtgcttgcctgttctcaaaaggggttcagctgtctggtgatgtgcaggccaaatgcagagcgatcacccacacctccagcagtaaccacgctttgtggtttgaaagcattcttagttgctagatactacgcagaatttctggctgggcaaggtgattatctgacatattcttgaaattaaaaataattatttctcttgcattttaggctcagtgggaaagaacttggctagcaagacaaacgtgtacatctctagcagtgctggagccaggtggcgagaggtcagccccctcccccaatcccgtcccctccaccctcattcccatttgtgtgagaatgtagactgtgccttggcatttcagggacacaaatggtccatggcagagaccagtaatgccagatatgactataaagtaaagaaaggtacctgaagccactgatttatatccacagttactttaaattaaacacagacctttgcaaatgtgtgaattttactgaacattctaagattatgagttctatgagggcaaagacaatgtctgttttactgacttctttatccttaggacctaagagtgcctggcatggagtgggggctcagggcatatatgctgcatgtatcagcaaattatagcgtagtggtattagccctgaaatgggctgctattattattattattttgtatattattgaagttgagatgaagcctgtccttgctgggctatgttgtataggcactttcgtctcactctgtgctatggaagtagactctctttttgccttaaggttgtataactaatatcgatgctgattataccaattcctaagacagggctagttccctagttccaaaatgctaattcatcttcatctttgggcattagagaatttccaaacttgtaaaaaaaaaaaaaagttgttgccagcctcccattgattaaggccaaggaagtgcgtttggtctcgttctgtaggggttgctttcaggggtgaccctctagttatgccaggagccaccagggtaaaacccaacagatcacttgacaggatgagcaccttgtcatcgagcagccccgcaggctgggcagccggaacagcacgtcgggagtgatgtggagttctcagaacagctagcagacatagttcccatccacgtggtgctttactgggaatgcaccatgctcaccttgatatttgaataggtaatatgtaaagcagtaataaaaataccaacattcatttggcaccttgcagttcacagaggcctgtcacaagccttctctcactgtggcagggcttcccatccctcccgaggagagagatgaggctcagacactgtgtactgtatgtggcgaacgcaaatatgtgttcagatgaggcagattgttaaggccattgtagtcagagtgcaaacagtttgaatggaaattttcgggttgtccttgtgcagctcccaagggaagattaagcagctgctttcccctttcgtggagctggacgctccctttgaaatggggtatcctcttctctgcgaataggcctgtggtttgtttgtgccttctgctgttggtgtaatctgggatttgcacatctgcaagtgatttccttctgggtagaaagcagtgtcttgttcctcctccagtgaagtggtatcgtctggtgattaccggggcagctgtcagtgcctccctccacacgtgccttgtccctgccaagaagcaaccagtgcataagagaccttattttgggacatagcagaaaactaacttggggatgaaaagattgtgagtttatctgtgtgagtgggcatctgagtccccatgggcagccttcactttagagggacaatctgggctgtgtgcaggagcaggtggtggcagaggaagaggctgtagtggacagaatgttgcctggagcactgatgactgtaattgtggttttctttttcctcctaattagttgtgcaaattctctgatcctcagaattcctttttttgtgcttttttttctttttaaataatttttatttcttttatttttagcttttttctttatcaactttattgaagcagatgaaggcacagtacactgcacatatttaaagtgtacagtttgatcagaattaattatggtcaccacaattaagataacaaacatttccatctgcaaattctctgatcctcagaattccgtttttgtgctttttttctttttaaaataatttttatttcttttatttttagcttttttctgtaacaaatttattgaagcagataaggggacagtacactgcacatatttaaagtgtacagtttgatcagaattaattatggtcgccacaattaagataacaaacatttccatcaccctccccgaggtatctttgtgcccctcggtaatccatcccactctccagtcttgtccttgtctgcttctgttattcattggcattttctagaataggttattcattggcattttctagaattttgataagtggactcacacagtatatactctttttgcctggcttctgtcacacatcacgatgattttgggtttcatccaagttgctttgtgtatcaattgttcattcctttgctagttgtatcccattgtagggatatatcataatttatttattcattcatctgttgataaacattccagttttgctgattacaaatatagctgttatgaacattcatgtacatattttattcatttctctagggtaaatacttaggaatggaatagctgggtagcatggtgggtatatgtttaactttttaaagaactgccaaattattgtcccttttacatttccaccaaacagtatgtgagaattttaattgcttcacatctttgccaacacttggtatgattagtctttttaattttagacattttaataagcatgtgataatatctcattgtagttgtaattggcatttgtgtgattattaatgattcttttcatgtgctcattggccattttaaaatctggttgtgaagtatctgcccaaatcttttgcctttttgaaaaaattgggttggtccagcacagtggctctgcctataatcccagcacttcggacggctgaggtaagagggttgctggagccatgggcaacatagggaaagcttgtctctacaaaaaataaaaatagccaggcatggtggtgcatgcctgtagtcctagctagttaggaggctgaggtcagaaggtcacatgagccctggtggttgaaggtgtagtgagctgtgattgtgctgctgcattccagcctgggcaatggaatcagagcctgtctcaataaatatataaataaattttaaaaactaattttaataattgagttgtctatcttctttgagttgtaggagtttttttaaaaatatattttggattcaggtcttttgtatgatatatgggtagatactcattttttccatatggagatctaattgatttagcaccatttattgaaaacccttctctctctcccattgaattgccttggtacctgtttgaaaatcaattggccatatatgggccaattttaggccaattgggtctatttcaggtctttattctgtcccattaatctgtctgtcttttcactaataccaaattatcttaatttccaaagccttatagtaaatgttgagatcaagtagggtaagtccttcaactttgattattttaaaaatctttttttattattgtaggtcgttcgtatttcctgatacatttcaggatcacttgtcaatttctatggaatctgctgggatttttattataattgccttgaatttatagaatcagtttggaggagaatcgacatgttaatactattgagtcttctgatccatgaatgtagtatctttttccatttcttgttcaatttctctcagtactttgtagtttccaatgtagaggtcctgtacatcttttattagctttattcctaggtattttaattttttgtggtattactgtaaatggaattttattttctaatttttgctctagtatataagaatacaactgattttttatatattcatcttgtattctgtgaccttgctaaggtaattcattagttctagtaggtttttagattctatgtaagcaatcataccatttgcaaagagtgacagttttatttcttcctttctgatcttaatgtcttttatgtattctctcattcttctcttcttcctttttctcttctttcttgtccttctttcttctctttccctcctttcctccattttctcccttctgatttctttcattcttcttatcacaatggctaggacctctatacagtattgaatagaagtagtgaaagtgggcattcttgccttgttctctctctgggggaaacaattcaacctttttaccattaactatggtgttagcagtagatttctttatcaacatttgggaagctccctattatcactagttgttgagtattttttttttttatcataatcagatactggattttgtgaaatgctatttttacatttattaaaatgatttttttctattactatgatgattaaatattacattaattaattcttgaatattagaacaacctggaattactaggacaaactctacttggtcataatgcattattctttttatgtgcagctaggtttgatttgctaatattttgttaaagatttttgcattatttgtgagagatacttgtctttaatttgtttttttttgtaaaatctttctaaagttttgatattagtgtttggctagtatcataaaacaagcagaggggtaaacccctcttcctcttttttaggacaaagtttggtgttattttttcttgagtaattccctaatgaaactgtccaggcattgagttttctttttgggaatattttttgataagagatttaatttctctggttgatacaaggctattcagattttcttctttttgtttcaattttgatgagttgtgtgtttcaagaaatttgtcccttcatgtaagttgtgacatttgttggccttatgttatcaatgatatattctctttatctttttaatgtctgtaggatctttggtgatgatttcattcttgatattggtgatatgtgtattttctctatttttcgttcgtttaggtgtttcaatactgttgatctttccaaagaatctgcttttggctcttgttgattttctattgtctgttttctgttttgttgctttttttctttattattattttttcccttatttgttttgttgttctttttgtagcttattaagatataaccttgggttattgattttatatcttcttttctaatgtaagcatttaaagctgtaagttttcctttaagtactaatttagctatatgccacatatttagatatgtttttagtgtttttaagttcagagtatatttaatgtccccctttaaaactgagatataggctgcacacagtggctcatacctgtaatcccagcacttaggaagaccaaggcaggaggatcacttgaggccaggagttcaagaccagcccaggcaccatagcaaaactttgtctctacaaaaaataaaaaaattaactgggcatacctgtgatcccagttactctgggggctgaggtgggaggctcacttgagcccaggaggtcaaggttgcagtgagctgtgattgtgtcagtgcactccagcctgggtgacagagcaagaccgggtctcaaaaaaataaaaaaacagataaaattgagatgtaattcacatattataaagttcaccattttaaagtgtacagttcatatgtttttagtattattcagtcatcatcattatctgattccagaacattttcatcaatccataaatatctcttgatttttatcttcgaatgataagttacttagcaaagtgttatttaatttgcaggtatttgggggtttcatagatatcttgttattgatttctaatttaatttcctatagtcagagaagacactttgtatgatttcagtccctttagatttgttgagatttattttgagatccagcctgtggtctatattgttgaatatatcacgtgcactgggaaggaatatgtattaagcagttgtttgaggtagtgttctgtagatattatttatatgaaggtggttgataatgttgttcagatcttttgtgttcatattgatttttgggggttctagttctctaaattcctaagagaggaatggtaagatctcctactatgattctgaaattgcctcttgctcctttaaattctatcaatttttgctttattttggtatgcattttgagtctctgttgttaagtgtattcacatttataataatattttctcatgaattgtcccttttatcattatgaactatctctctttatctattgtaatgccatgtgtcttaaaatctattttatctgatattaaaatagttactgtagccttcttctgtttactatttggatattacatctttttttgagttggtgtcttactctgtcacccaggctggagtgcaatggtatgatctcggctcactgagacctcgacctcctgggttcaagtgattctcctgcctcagcctcccgagtagctgggatttcaggcgctcaccaccacacccggctaatttttgtatttctaatagagacggggtttcgccatgttggttaggttggtcttgaactcctgacctcaagtgatccacccaccttggcctcccaaagtgctggggttacaggtgtgagataccacgcccagccctggatagtacatcttttaacatccattcgctttcaacctatatatgtctttatatttaaagtgttttttttttctcttttttgaagttgggtcttgtgtgttgtccaggctggtcttaaactcctgggttcaagtgatcctgccaaatagttggacttaaaggcacatgccaccatgcccagttctttgaagtgtttcttctagacaacatatagtagggtcttgcttttttactcattctgccaagctctgctttttaactgaaatgcttaggccattaacatttaatataattattgatgtatttgaatttaggcctaatatttcatttattttcttttcatttctcctatttattattcctctgttccttctgtcctctctccttttgtattatctagatacattaagtattctacttttatttagattttttggggggcttatctatgtgtatttctagtgacttctctaaggattacaacatacatatctaatcttttatagtcttctttgagttgataattgcacttaacgtaaaatttagaaccctttcaaccatacaagtcccttttctcctcccccacctatatgttattttcatatttatcacatcaacacacattacaaaacccacaaagcagtgtttgtttttgcttcaaattatcatatgaatttcaaagaacttaaatatttacccagatatttaccatttctcttgcttgctcttcgttctggaaaaatctctgtttacccatgggaaatttccctatagcctaaagaaattcctatagcatttcctgtagcgagatctgttggctgtgaattctcttgtttttccctcttttgaaatttctgttttatttaccttcattcctgaaggatatgtttattggatagagaattctgggttgacagtaattttcttccagtactttaaagatgtctactgttttcttgtttccgtgggttctgatgagaaacctctcttcactttagctatcattctcctgtgtgtaacatgccatttttctctagatgctttggagatttttttttcattggttttcagcagttttggtatgatgtgtctaggagggcttttctttgagtttattctctatgtagatgctgattttgaatctatatttatatctttcaacaaatttgggaaattttcagccattatttcttcaaatattttttttctgctcccatccctttctcctgttcttctcggactccagttacatattagacctactgttattgttccttgtgtccttggcaatctttctttctttgaaatcctttttcccctgtatgttctctagaacacacagatagatctgtaatttctacagatctatatttattttgaagttcactaattcctttgtcattgcttttctgatgttgagcccatcagtaaatttcttatttcggacattatatttttctgttataaaatttgtttggtttctttttaaaaattgtttccacttctctgggagaattcttttctctcattcatttcacgtgtatttttctttccctcatgggacatggttataatagctattttaaaattccagccaggtatggtggctcatgcctataatcccagcactttgggaggccgaggcaggtggaagcacttgaggtcaggagctcgagaccagcctgaccaacatggtgaaaccctgtctgtactaaaattataaaaatgagctgggcgtggtggtgcatgcctgtaatcccagctacttgggaggttgaagcaggagaatcacttgaacccaggaggcagaggttgcagtgagctgagattgcaccactgcactccagcctgggcaacagagtgagaatttgtctcaaaaaataaaaaattaaaaaaatattccaatatatgggtcacttgggattggcaccttttgactatcttttcctttgagaattggacacatcttatggatatgtttgtatgctgtatgttaagtaattttggtttgtattctgcacatatgaatgaaattcatgaaattaagccttctggaggatattgatatttttgtctcagcatgtaatcagcctgtttaggttctgaccctgagttctgtcttgctttctgtaggtggtagtttaactctcagttcagtatgctaagcctttgttacactggtttgtgtctgtttcatgcacgtacacttcaggggttaggctgcgacttgcgtaagttcatatacaaaattaggggatttacttttttgacactctctgctatgggattccatccacactttacctaccctataggggctcctttctctggttcctttgggggaaataatatctattgcagttttagctgtgactgagactgaggtgcaccccatgactgggacttttccttcgggcaaagctttaccaggatattcatgacttgtgtgtgtagcttctctaggttttaaatctccacaagcggcttgctttcgtttacttttcagcatccactggtagttgttttttgtccagagttttcagctgtaattagcaggaaggatgggctatagagggctaatactgtcatagtagaactgaaaccccagttacttaatttttaatcaagggttggtgggagtcatagatttggatttgagtcctacctctgctgttcacagtctaccattttaatattaagcccgtgtttcttcatttgggaaaaaaattgagatactagaacttgctccacctgtccctaggattgtgtggaacagatgagataatggatgtcaatgtcttctgtaaacggaaaaattgttttcaagtggttgtcattgctgttatgtctatgtgcacgtgtgtgcatgcctgtgggcatgtgtacatggtttctgcacaattacctccacagcagtggtgtcaccatggatttttcctcttcaggcacttcctggacctcactactacacatggggagaccacggcggaatcatcacggccattgcccagggcatggaaaccaacgagctaaagtaagtgtctctgatgaggccttttaacatcaaactttctcccagaaatttacgtctgtgattataattggattatctctctacagcactatgttgttgacagcacaatttgtgatctctggatatgagttaaacttttttttttttttttgagatggagtcttgctctctcccccaggcaggaatacaatggtgcgatctcagctcactgcaacctccacctcctgggttgaagcgattctcctgcctcagcctcctgagtctgggattacaggcacctgccaccacgtccggctaatttttgtaattttagtagagacacggttttaccatgttgatcaggctagtctcgaacccctgacctcaggtgatccacctgcttcggcctcccaaaatgcttggattacaggtgtgagccactgtgcccaccccgatttaaactctttatctcccaaatgggaatataagaacctgtcctttctatcacaaagggagattgtgagcaagagggcaattaataataatggccaaataattaagtggaggctctttaatttgtccttctttgctttgtgtctttattacatagaaagactaataataaatagcaataataataataataatacatcagtaacaattacagaatgcatacaacttgatagccattgacttttggtgcgttaggttggtggggggtctcatggagctggaaggggtgtttagggttaactgcatcatttcacagatgagaaaacaggctcagcaaggcaaagtaacttgcccagggtcattccctttgttagtgacagagacaggattagcacttgggtttttcgattgcgtcctacattctttgcaatatattgttctgaaaagcaaaactgtcaagagtttgtaacctctacacccttatgttctgattttatcagaaccagtcctctgattacctttggctcgtttctgaatggttcatgttaggtcaagttcatgctggaccacacttctccctgtttttgagctgaacccattagatggattggtgaaggatctggagagggcttctgtaactctcttgtttattgcaaggacaaagctttctttttctttgctccttttagaaacggggccagcagtaagtgagaggtgggtggtttggaaaaagagatcttagcagctgtttttttttccctgtggttaatttgacatgtgctgagcagcctggcctcagagaaggagagagaagcaaagtactggtgtttggcattccacctggctgttctctgttctgtgtagcactggttagctatttctttagaggtgatactccgaagaggtcctgtttgtgtgcaacactctgtattcatattcagattggtgtttgctcagacaacgaccatcacagagcacagtacttcccacatttgtgctatcatttatatacccattaatttaattttcatttcacatgttcaccaagcaccgattgtgccagatgctgtgtatctgtagatgaataggatgcctgccaccctgtagttgaaaggtgggcgacgaaacaattgtagtgtttggtatactgctatgtgtgtaatacgcacgtaggggacatagtttggcttcctaggaatacatttcattctttgtatggctttcagatttcagagtcagttctcgatttgccttgtttaacttctctgaaaattaaatttgcattccaaactggctcctctgaaggagttagtgtgattctagtcctcttacaccatctgtcggtgcatatgtgctcagggaacgcagcgtcattctgcacgagctggagcaaaacatgatcaggaaaataaacttgctgccagaaaatcataaagccttccccagacattttgaaatgacttgggggttgtagactttgggggattatggtcactgtagcattcctctatttgtataggtttcatttggaggtgtctgtttgaatagttcaaataaagcatttgaaaatacgaaaatacatacaagcctcctattgacaggtgcatgtgtcccacataacaacctgagcttggcctaaatctgtgtagccacctggcatttactcagtgtgttgttcacagaggtattttgcttcttcccctgctgctctgaaaagcaagaaataatattcaagttagttgatattctcagactacaatggtgatttactgtgacacccatgcacaaggacaggtggcttctgacaagactggatatctgttgctgggctagggcctcaggccccttctaagtttggcctccccagtcacagagatctcttttcctttatgactcgtagcatgtataggctgtcccattcatttggcattgatcatattctgactccttatgttagttacctttacatgatgcgcctgaattctgcaactcgttagtaaggtctttgtaggtaaatatttctgctcgatgtaggttaccaggcacttagcaaatatttgattgaaataggtcatgcatacttaatcatccaagattgcttatggttttttttttttaactgatttataaaactagaggagacctagctagtgtgccaattgcacagctccaaggggaccactgccactgtgctccatgtcaatgacaacccctagagcacagatgtgagtggaggctccctggatgtgtgcaacccggtagtacccaagagacaccagagatgacctaatctactttccttagttttcacatgagggaataagagattagtcaggagttaatgcccacactggaacttgagcatatttctgttaggaatcatttcaggtccattacacagacaactgtcgaacatctacaatgaagcggatgctgtgctggataccaaggatgcaaaggcaagtggggcactgatcgggagctgcctgtgcccactgtggctctgtgatgtttctgagccagatgcagagagagaggctgggaggagggggttgtttgaaagagggctttctgctctgattttactcatctttagggagggaagccaagtaaagtagcattagtaactcaaataggttgtagtggggacagcaattgaagcattgctcaaagtaaacattagggttttttttttttttggtcgatgttcttttaagttatgcatgtctttctctccctgattagcacagatatctaggagttgactgttatttgtttcagcttctgccttgagtctcctctgagactgttacctttgttattgttaattgaaattgagagcaagaagtggaacactttgttttgctcttgtgtctacatgtctgaaatgggtaaataagaacctgcactggggatccacttattcgttcattcagcccgctgctcctgtgaacctgctcacgggaggcataggagcagtggctttttcgtcagagaaggggctgttgcatttttgcaccctgaccgaagaagattcaaacacgtttgtcagcttgatcacggaagagaagatcaatttctgtttcttcgctgcggtttgcttgtcagcatgatgatatttttcgtagtcagtaataatattttgaacttgccccaaagcatcttttttttctaagacatccaatttcataggggcttctctctggaaatcctgaaaagcccctgaaaagactccacgcagcagagcagctgtcttttctggacctgggctctggaagcagccccacagttccagaatgtgggaggcagtggttaatgtcttcacttgcttgcagcgcctctcaatggtacagttgtcgggagagccacccctactttatcctaacccctgtggtttttctgccccttgaggtatagagaagcaggtgttcttatcactgtgtttttttttttttttttttctggagttcagtggtgcgatctcggctcactgcaacctcctcttcccagactcaagcggtcctcccatctcagcctcccagtagctgggaccacgggcaggagccaccatgcctggctaatttttatatctttttttttttttggtagagacaggtttcgccatgttgcccaggttgttctcatttgaactcctgagttcaaagtgatccacctgccttcctaagtgttgggattacaggtgtcagccaccaagcttggtctttatcaccttttaactgttaagaaaccgagaaacggagttgcagtgcagtttctttaacttccttcaacaagcgtttatgaataatgccctttctgtgtgctaggaaagattcgaggtgccaggggcagaaaagtaagaggtcttattcctgatgaacggcaatccagtagaaaacactcgcaaaatcaagtcactgaaatacagtgaggtataagattatggagagcgctgggtgcggtgggagccagaatgagggccaggtgatgctatctgggggacaaaggaggacttctgagagaggaaaccccagctgaacctaaaaggatacaaagcaaggtcggaatgcttttccaggtctagagagaccttgagcaagggccaaagcatgatcagtggggaatgtgcacggctcttgagtattaatagaatgcaaatttccaggtgggaagtagtgagaaacgaggctggaggaaggtatctatgtagaggccaggtcctgggggacctcacctgtgccttactaaagagattaaagtttgctttgaggtgatagggtccctttgaaggattttagtaggggaatgacatggctagacttgcattatagaatgatggatctggcagaatggagaggatggattcagtggagagagactggaggtgagagctgatgctggggtgtgtttgaggactaagtctgcagggcatggtttctgattcacctgggatgatgggagaagtgattataccgctcatagaaaggcagaggtaaaggagtaggcttgcagggctgtatattaaatgcagacatggacaggttgaattgaagcctctgttgtgggtccaaggggcgatgtccagcaggaatctggacatattacaatatctggtgcagccttccgccaccctttgcaagaattttctccgtgccatctgtgatagacaatcttttgttctatacttgaacatttctattaatggggaatttgccatatcaaaaggtgcttccattttactttgggacagtttgctgttcatttgttcactaattcatttgtgaattaaagttctctggtaagggagagcccagattctcctccctccagcttctattcgtggactttgttctgctccctggagatgcacagtagatacttccttttgcatgaaagcctttcaagtatttaaggaccctgtcatgttctcctgagtgtctgccatttcatgatgaatatcctcggttcctttcctcatattctatagatcctcaatctccatcttctaggttctcccttaggtctgcctcacgatgtcagtgccttaaaatgtggtacctggatctggccccaatagcctgaaacatgcagaagatgttgagattttgtcttcatgattctgaacactctgtatctattaataaaaacctctgacagtgtttccatttttaacagccatctcaaactggtggctcctattttttttttttttgagaggaggtatcatttgcataccacaggatgctcagatattgactacacgatttaatcagttctgaagggtgcatgtcaagatgtagagtatttccatcagtccagaaaatactcacgtgcccctttccagtcagtgctctccacccccaaacccctgccccaattacaggcaaccactggtatgtttatcactgtagctgcctattccagaatttcatgtttgtatgttttgtatttggcttcttttactcagcataatgattttgagatttatcaatcttttaactggtatcagtaggctgagttcactttaactaaaatacctgagatccttctttcttatggatcttattatacaatcaatcaatcaacaggacggatgttccccgtcctgtatttgagcaaacaggtttttgaaactacatgtggagctttatttttatttttgcttatttttttttggtttgaattgtatttttggcatttatttatttttttgagacagagtctcactctgtcgcttaggctggagcacagtggtgccatcttggctcactgcaacctccgcctcccaggttcaagcgattctcctgcctcagcctcccgagtagctgggattacaggcatgcaccaccacgcccagctaatttttatatttttagtagaggcggggtttcaccttgttggtcaggctggtctcgatttcttgaccttgtgacccgcccgcctcagcctcccaaagtgctgggattacaggcgtgagcctctgtgcctggccccggcatttattatattatttatacaattagccttttaccctttgcaaatttggcagattcgccttccagatccctatccagatcattgacagatgtgttgagctctgtgagaactagaagtcttatcttgggttgagatcaaaccatacgtcagcactcttgggatgtgcttattttaccatcagtgaattttatctgactgcgtggtccacaaagatcttcatgaaaaaaagaatgttctgtgtcattgtcctgtttttcaaatcaagaattaccacgaggaaaggaaatggagttagtctgttgtgacttgtgtgtgaaaccatttgggttcttagccttgacctccttttcgtctgagtgctctcaaataaactgtttcataatccattcttgaaaccaccttttcttcattaaggaaataaaagtattttccctattctagtttttgagatctttgttcttcataattcttctagagattattgaaaaggatgctataatcatcctatctttaagtctttcagttccttagaatttattttgtactgattttcctttaacttaaatggtttttcttgtccaatttgaagattattttccttgataaagataaaagcaaaatagaattttttttctattttttttagacccagctttactactatgttgttattcaaagatttttttctttttttttactaacgaagtctttatttcttttgttttcagctttccaatcagccagaaaacataaagtattttcaattcaaagttctagtaaagataggaagaactgggtgatggttttcataaatgaatgaatgaatgaacgaatggatgaatgtgtatcaagtgctctgtttttttaaattgatacatatgattatgtctgctattatttattctattggccatcagagcaatgatcctattcctttctaattctttatagaacttgccagataaccaatccactgacccaccagtctgccaattattttggtaatttgaaacataaaccttgattcattttgaacttatcttgctactattccaacagactactggctatgagaattacagctggaattagctagcagtaactgaatttgttgctcttggttatatgaccttttttcccatcttgaatatgttctttagaaacctgaactcatcaggaacttttctgggtagctgcctgctagagtcctaagttgggtatctaccacacttcttccttttagagtatctgtggttatattatgttttattattatattatctgaccttcccatcttcttgagagtttttggccctgggattatgtctatatttttatctgaacagtttgatttcttcattcctaaaggctagtgccctatatcctctttcataacttaagaatgcaaagatgggccagacgcggtggctcacgcctgtaatcccagcactctgggaggctgaggtgggtggatcatttgatgtcaggagtttgagaccagcctggccaacaaggtgaaatcctatctctactaaaaatacaaaaaaaaaaaaaaagaatgcaaagatgactttgtttcttcacaaggttcttgtcacttacttttaccaatacaagttctcctttgggggtcagaattcagtccaaaatgcgtgttctcttaactgttgctgttgataagacaagagccttttccccaaaattctgaagagcaccattttctaaatgagcagtgtattttcagatacaagctatgcttggtcatgtacctgcttgttatttcattaatgagttattgtcagagtcctctgggaactctcaagaaatggggtgattcatttcctgaggttatgttgggttcgaggagctcttaaagagaattaacttggcaacgtacacatagatagactttagcattaccactgagtgggcagatggctgccatcatgtctggataataggttgactctgttggttcagtttgctttaaaagtaatataaacctttagcttcacactggttacaagaaggagactgaatgagttaatttatccaaatatctgtttcaaaattttcttaaaccaaaagcatatctgccaggtgagatttctccccttgtgagagatttgtagggggagattacttagtctcccattgacatttattattctgccttgtaaccctaccagttggtttaacccctagcctttttgtagcagtatcttttttttttttttttaaggcagggtctcgctctgtcatccaggtgggactgcagtggtgcagtcatggcacactgcagcctcacactcttggactcaagcaatcctcacacctcagcctccagagaagtagctgggaccacagggggcaccaccacacgtgactaattttttaaaaaaattttctgtagagatgtggttctcattatgtttctcaggctggtctcaaactcctggcctcaaaagatccttctgccttggcctcccaaagtgctgggattacaggcatgtgccaccacgcctagccaaatcgattttaataatctcaatatgagatgaagtgtttggatagaatgatgtcacgaaaagatttctgtcaaggattagaatcccaaaggtgtaaaactaaaatctcaaaaacatgagaaaggtgaaagaaaaagttttgcatataatttggatttaagaaggacccagaagccctgtgattctaaagaaggcttgaattgagtgatttctcatgtcaagcgtctcaccagctcactgggtgataaaacaagtgttgggcagattttcttccttgcctccctctccgtccctcttctccttcttcgacaccaaagataatgtaaaatcagtgcagttactcaaatgctgcttagtttttcaagggctggcttcctgcttctgttatagtctgtcttggagactttcctcagtatatactttccttcaactttttactttttaatttctaagaccacgggaaagttggaaaaaccgtataacgaacacccatgaaaccttcacctagagtcacaaattgttagcatttgccggtttgctctacttctatcattggtctatttatctatcctgtgtatccatccattattttttagctgaatcattttaaagaaagttgcagacatcatgctccctcacagctacttaaatgtgtatctccaataaataagggcattttcctatataatcacaatgccattctcacacctaagaaaattaacatgaactcggtatgacttatagactatattttctcagttgtctcaaattatttatggccacttttccccttcaatccgggatttagccagtcctgaactaaatcctggattggatttacacattgcaaatttgtttagtcattgcatttggcttttatactcctttagtcttttaaaatctataacacattatctgccttttttctttatttatttggtttttgtggccttgatttttttttgaagaatctggagcagttatcgtgtagaatatcccacattttggatttgtccaattgtatagaatagtacacagaggatgtgttattctcaatgctttattcaggaggcacctaatatcaagttgtcctgctattgatgatgtttagttaagattgtgactctctgatcattcattgtaagattatgttttgtaaaattttatttccccatttgtagtgaatgatttgtctgttcagatcatctgaacatcctggccccaacactttcaccgaatggttttagcatccagtgatgatccttgtgtgatttagttattgcagtggggataatttttctgtaattatattatattatattataatatatatattgttgtgtccaacccttattaagtgccattctaatataagaaaaaaattgggggccagacacggtggctcatgactgtaatcccagcactttgggaggccgaggcaggcggatcacgaggtcaggaggtcgagatcatcctggctaacatggtgaaaccccgtctttactacaaatacaaatacaaaaaaaaaaaaaattagccgggtgtggtggcgggcacctatagtcccagctactcgggaggctgaggcaggagaatggcgtgaacccaggaggcagagcttgtagtgagccgagatcatgccactgcactccagcctgggtgacagagtgagactccatctcaaaaaaaaagaaaaaaaaaaagaaaaaaatttctcttttgctcctctgtcttttagtatcattagagacccatgtcctattttcattcaatgtgtaatctgttaccatcatttttcttttttatgtttgaattctcctaaattcggccagttggagccccatcaggctggttcctgtgttcttttgagatgactgcatttatttctgagcatttccttaaactttccctgccttagcccaggatcagccatttctccaaggagccctggttcctgttcctggtgaatgttatatggaaaccaagcctttgccttagagactttcactgcaaggattctcttacttgcatttgggcagatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggtaagctgctgcctccttggaccttttcacatggatatgcgtggacttcctgttatgtgcaaagcaccagcttagatactgtgtactcagaagagcctgacattcattgggggagatgggcccataagagttagcaaaaagcatagggaggtaattgaaggcctgctcaattcttcttagtaagactgggtgttattctttgtatcttagtttcctcatgcagttcctggcacataagaagtttaaatatatgtctgctgaatatgtagataaatgcatgaatgaaaaacatatttccaaatcagcagtgccaattggacgtattcagtgagtgtgcctgactgtctgtaagtcagtgtgccaagcgacacagggtcctctcaaagccatctaggatctagttgtgatctgctaatctagatacaggatgcataagtatgcagggagaagtgaaactcttcagcatcctctccctgcttccccatcttatcttaccctttcctacctctcagccttggctaacctgattctagctgcccggagtgccctgtttcttctcatttccacccgttcagcctcccctactcgaaatccttttcatatctcaggatccaacacatttgtggctgatatcccaaccagaagacgtctcccttcttctctatgtccagaacataagtgtatgcataactttgtgtctgtcactcggtgtgtttcaccttccattgactagattataaagcccttaaagataagaacttgccctgtgcatatttgtattgtacctactggaaagcctgatagcctaacagtctgtaggagtttaataagtttactgatttgcatggcattgagtcaaaggttgtgtatcagcttcgggtagtatctaatctgactgaagacacatatataagagacacaaagtgccaacatagacataggcatactttggaatgcttgtagaaagcaccctacttagacatttcgatgaacgtggcagatggagtgatggtgcaaggtatcttagcattttccagcctctttccatggagatcctgtaccttcaagtagggccagcgagccctccattgccttcgggccacactaccagatgtgccctcactgcctgaggaagcaggccaggaacattaacccccaatggtattgctcatcaaggattcagctgttccctagttctctaggagagaaacacttctgagtactcatttctaaagggcactgctgactcttctgtaatgtttcggaaatttggatagtgcctaaaggtggcttgcttctttccaacttttccaggcagatgcctgcgtttcaggtatccttttcattggcatagggctgcccagcttcaaagcaagctgattggagggtctgtgtgcttgcggggtggcaacagatagacaggaagtgggggttgaggccaggcaccttgaggcatagcaggaaaccctacatgggcctgcctctaatgcttcgtgctgtgttcctttttctttaggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtggtcagttcttctttgatggctggggactgagttgtgttttattcactcagcagtgttgggggaagagattaggcatggtccctttccctgagcaaaggaagggaatagaaggaaacaagtatttgtgaagcatcttttatgtgccaggaactgtgctaagcatgtttcatgtaagttgttttctttagttcttatagccaggtaatgcggtagaggtgtctaggagagctgcagctatttctacaggaatagatagctctgggatttatttctattagggtaacccaaaaatatgctgaaggtttcattgtttttaatccttctccttaggaccctattctagaggggatttatttctttatctgaaacgaggggatgttagtgtgtgtatatgtgtgtgtgtttgcatcatttattattccttaagcaaaatatccaaggcactgctgcgaatgctaaaagtaggagaagtgatttgtgcatggctaattggcacaggagatagaagagagcaagtgcctcagaggaggaactggtacttttattgtgactattgaaaggaaggagagggctgtggattgctgttggagaatgaggagatttttggaagaagtgctgtttgagctgggctctcagggagcatcaatatttgcagacagcagtgttttgagaccatgtgtctgcaacagtcaggtgtagaggcagcagggtgtggttgggagttgaattgggatgccttgttgggtgtatgacatggggatgacaattggagatgaggctgaaaagatagaatacagtaggggagaaagaccttagaggggatgaaccttattctataattaggaggaggccttcagcggcttttgaggagagttgatgatgagaacagagcttagctgtaggagcttttgaggagagttgatgatgagaacagagcttagctgtaggaagaggattctagtggcagagtacagaggatctcagagctcctggacagtcactgtagtctgtaattcagcatgaaatcattgtagtttagtcaggagcaccaagagagccatgggtatttaatataaatacacaactcatatttcagtggttgctgaggcacagaggaactagattttgctttgggcagctgtacttgtcttgactaaagccagaaacctctgatgtattctagaccagaggttggaacatggtcatatagtaaatgttttagactttgtaggccatatggtttctatgatctgtgttacaactcctcactttgcccatggcagtgcccatgggtgaatgaaagcagctctagaggaatgaacgtggctgtgatccagtaaatctctatttacaaaaatggccaaccaggtttggccacttctgttctcaaccagtgcttctgaaactttaaggtgcatatgaatcacttgcagattctgccttggtcacatgcagattctgcctcaggagttctggggctctgcgtttccatcaagctcccaagagatgtggatgctgcttatctgcacattcgccctttgagcagcaaggcttagaacagagaagacagtcatttccttagaaaggtgtgtgctcccaaggtaacgacacagactctttaacagcaaaagcacagggctggctgatgttcttggtgacttcagttccatgctgtttgccttctgctctttcttacacacttttgcattatagtctaatctaatctgagagctttgttggctccaggtagtcctccccagaccagcttgagactggagaggtcctaatccctgaaaagatcatagtgccctctctctcccctcttcctatccccaatatgtacttcaaaataaaattaagactaagtaaaaaataggtaagaaagtctaacaaatctttggggtttttttttttttcatgacatttaggcttaaaaacaaataacattaaaattttctctcttgccctacatttccccaaccctcaccaaaaaaaaaaaaaaaaaaaaaaaaaaaaaaatcacacccacaagaaaagaaatggagcttggtgtgccctcctgggtaaactggcctgggacctgctggtctaccatgcccaccccatctgccttgctggaacctgctgtatgctcaccctgcttgtatgtggagtgtttttattgtagaccagtaaaaccacctgctctgccccttgtggagttgggttgcaggccaaatgagatcgtggggtgatgaccctctgaaatggtaaggggtatatggatgtcagctgttccccgctccacccctcccaattgtttctctgcttgctgtagctgctggaaggcagccagcccaactatatggctcttggagatgtttgatggcattggactatggcactgagaaggaaaatggtcccaagatggacgtcaggaaatgagatgagaatgagcaagcttatagtatctttccattagttcaggtactggttgacaactgtgtttgaacaccaggttatttctgatagtccttttagaccacactgggaagcccagctattggcccatgtttcctgatttccatggtagattcttttatgttcttatatttctcgacattgccaagtcatacagctttcacattcttgactgcaacccctagtaaataatacattttctcttatgaccctgtacttacatatgtacgtgtagatacatacacacatataattaaaacacaagttttaggagacaacattgacttttaaatgtatgatggggccttttgcaatcttttgcacttttttgggaggggaagaatctagtcttgggcctcccaagtactctcagagtccactaggtcatgacctatggtcaaagaaagctgcccaggaagagtgctttgctattggaggcaaataagtaattagctaatgctttatctggttcctaaaaagatttaaagtggccgttcagtaataacgaactgaggtaatgaaagaggcacatttgatacagtgacaaaactgctgccttttgaacaattcttacaaactattaaatgtggattatgatataatgcacacaaatcactctctgtgtatctgttaatactttttgtgtcagaaatgtttaatgaatatttggagtttttctttttgttttttgtttttctgagacagagtctcactctgtcacccatgctggagtgcagtggtgcaatcttggctcactgcaacctctgcctcccaagttcaagccattctcttgcctcagcctccagagtagctgggattacaggtgcgtgccaccatgcccaactgatttttgtatttttagtagagacggggttttgccatgttgcccaggctggtctagaactcctgacctcaagtgagccacccgcctcagcctcccaaaatgctgggattacaggcgtgagctaccatgccggacctaaatatttgttgaattgaatagagcaaataaatgtgttctggtagagcacatgaacgtggaatatatgttctgttctataattctttgaatatattctgtaattcattgaattatagaatttacaggtttggaagggccttagaacattcatagtacagtcacctcgttttagaatcgtcttcgactgaggcctcctgcttcctactccaggatgctgcccttcaagctgggaggtttggcagatgtgactccagatcacaagaggtctcatgaacctaactactgtatctcaaagtacagggtgacttagctagtatgtggatatactcttaaataacattgaacccctagtcaaattttttctttttttctgagacaggggcttgctctgttgcccaggctggagtgcagtggcgcaatcacggctcactacagccttgacctcctgggctcaaatgattctcccacctcagcctcccaagtagctgggaccacaggtgtgcagcaccatacctggctatttttttttattcttttttgtagagacagggtcttaccatgttgcccatgttggtctggagctcctgggcttaaacaatatgtctgccttggcctcccaaagtgttgggattacaggcgtgaaccaccatgcccggccccaaataattttttaaaaaggttattcttttaaaattcctcttttacttcttcagattctgtcaaaaagaacgtctcattggttgctagtaactgtaacatttgcctaatcccttttaacagagagggcaggtccagagtcttaaattgggaactggatctggctaaaatttaatactgttttgatttggcatgatgattttttttttttttggtctatttatggcatgtgattgtgtttttccaactgtggttctgatataaatcttcttttgaagatgtattttatataaaaagtaaatattctttaaagggacatgttaaataacttataataaaagtgaaaagtagtaaggtaaagtcagcagaattggtacaggaatgcctgaaatgtataaaaccgtggccttaacaaagcccaattgcctttttagtgacttcggtttcaagatgagtgaagatttgtcattagaggtttgtgttccagatccggaattttctggaaagtcatactcccctcctgtgccttgccctgtgggttctacttacaggagaacgagagggtatgtatcacagaggttgccctgtcaggttctcagcggtccgcacatggagcgagagagcatagaggaccgtctggattgctctacactcgaaattctagaattccaagttaacagcctgcaagtagtttgggcaacattataaattatggtatttgtaaactctcctacctccacattgcaagtctgtaagcatccctgaaactctaggaatatcttaagtcatcaacttcagcagggaaacatcttcagaggaatgtattcaagagatatatttaaaaatcttggccaggacagtgccctaaattgtctgggcctgcctagtctaattataagcagaactgactcagaactacgaacatcctctttctagttctaaagagaaatgagtggatggactctactggccgtgggtagtaagtgtattcccagctgggatgcctttgtggctattcttccatgtttctgacctcttgctcttggggtggggtgacagctaccggaagatttctggggacacttgtagcggaggagatgttgaagcgcgactggaaggagagctggtcccctgtcccctggcaggtaagagaggtggtttcttccctttcatttcttgagacatggttgaagcagtatcacgatctcacccaagtccgggcttgtggctcctttaattgagtggagaaaaacaatggccgtcacaagcatcacagggcttcctcttttccctaaggttggtttccacactgaacttgtacatagccatacccgtttttaggaatggaaagtactttgtgtcagctcagtttctttgagggaaatccctttgttaattgaaaaatatttattcagcatccactggggtagaaagatccccacaggcttttgtgtgttccttaatctgtttgtcaaagttgagtataaagaggtgtgtgacttcttaggaagtagctaagtagtctatgttaattttataataaaactaactgtaactaaaattttaatggaattttatagatttcagtgtactttttatgtgttgccagtttaacccttttaacaactcagggaagcagatattatcaattttgttttttactttttcacgaggaagcatgttcagaggaggttaaatggcttaaggtcacacatctagtaagtgacaaagttgaaattcagactctaagccccatgctcttcattggacattgcccaaatggcaaataaatatcattctcactattttagataatcattatgcatgctaattaagaaaaacttctctgaaatgattcacatgctataaaggtatagtgtgttctaaaacacgtttctgctagatttagtggtgatgtaacatggggtctttaccacagagacatgaaattatgatactttgaaaaataatctcttagttgcttttcttcactctgtttccagttcttattcatttaaagcttctttattccctctgtgccctctttcctgcccattacctcttggtgaaggtaaatggctggagttaacttccgtctgtggtgggtggtggtgtcttacgtggacagccataagcaccgaatgaatcatgaaagaagtgtgtggtctccacaggcagggcagggcagccctctcttttgctcactgccgccagcttgccctggtgtttttcatgctaagttcgttagtcccttaatttaatctttcatcattaccagagtaattaacatacctcactatggaggcttgaaaagaaccaccacttcagcaaattccaacaaatgagcagataatattcaaatatttccctcacaagagctgttattgatgagggcgtgggttagtagggtttgagtgattgctcttgaggggctggagtgcctacttttgtaataaatatttctgaagataattcagcaagggacaaaacagtttgtttaaagccatctaaactggcaggaaagctattttctcttctactggaagatagaacagggaacgaagtggagaaatctcattccattgtgggccacctcctatgtaaaagagagaaaaaaaaaggcatggaataggaggcagggatataccaggaaagaaaaagatgctttcacaggactaatgggggccgtaatatctttgcaaagatgaggtaatctgggcatctggaaggattttttaaatgcaagaatttttcttcctttacaattactatgaaaacacacattccttggccaggaccagccaagaattccattccttttccaggttaagcattgcgcgctggaatgccgcatgctgctctgaacataatcctaaaacacgtatttctggattcaggttctactttatgggtattagtttcttagaggaaaaaaaagcccagagtgacagaatgaggtttatagatgctggagagagatgtggggcaaaagccttgctgctgcaaatgtagctttcatgtccctataccttagctggccccctccctgggaatgacagcgggaaggtttccttgacaaccaaaaggggaggtaggttaccatgtgatggtaacatagatacttctaaagtgacctggaaccaaaggaaaagaaggaaaacttaccttattaaaaattgtaggtagatttattttttgatgcattatctatattacagcttttataaagaaggtgagtggtacatgttaagtcactgagtgtatggaatcaggaagtgggcaggaatggctaacccaggcatgcagcaaaagaattccgatttgcatcttggtcccatatgcaacacactgtcaagatgcacactttagacacagatgctggtgtgctgcttgtgtccactcctggggaagaatctggatgtttcccaagccgttccctaagtggacaagacagtgtactgggtcttcctatttccagttgtctgacattaggtaagtatcttcagcactcaggaccttcatttctacatcttaaaaatcatccacggtagcgtctgtatcataacaggcagcacagtgtagtggttaaagcatagactctggatccagagtgcctgggttccaatcttggttctgccacttgctagttgtgtgaccttgggtgagttacttaacctctctggtctcagttttctcatttgtaaaatttggttaacaagagttctaccatcaggcagttgttgtgggtcttaaacaatacccgatacgtagtaagcacattatacacaatatgtacacaatttatatttgttgagtagaaacagaatttttgtggtgattatgttgtggaacattttgtaaatagccaagaacaaatgcattattagtattattttggagatctaagaggttcatagaattgccatatggtgttgtgaacaatatgaataagtgagcaaattgattagagagcttagttacaaagcttcagtgactaatggtctctcgtcaacaagatgatgatgctgtggtgatacagtcacgtgaggagggagaacagggcgattggtgtaattaggttggcaagtgtgacttgaagactggcaggcttagcccagaagtatggttgttgaagcatgcatattgggagatttagaataaagaaaaacataacaagtaaaacacttgcagatgaagaaacagattcactggagtttaagtaacttgcctgaggcagaaatgtgattccattacacacctcctgagtcttgatttctgtgctcttcacttggtccacaccacatgccaatgaatttgaggtttgtgtatgagaaacaaataggtcagatgtgctaggacctcttcagcatcccctgggtccaacctcccacgtgtcttgtgtgtctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccaggtgagtcagcgcttggtctgactgtgggagctgtgcatcgtgactgccctgtcctgataagctgcatgcagaatggcctatggaaatgggcagttagaagtttgtaagtgttactcatctcagggctgacaggtgaaagtttccagtcttctgtgttagtatttttctttctctgtcttcatctgttcatataggaaggataaagaaagccctaaatccacagacctgcttgaaagtgaggtcttgcttttcctgctgggaaggtgttgggactagtaatgtaggatgattagttgcccccctattgtgccaactgcctcttgagcatctttcttcccaagccatgatacagtaacacttgacttacccatagctcacataattatccacttcagctgttctgaacacaggtaagaaccaggaagtaagcattaaagagccctggacaggccaggtggatagccatacgctcacacccatgcatttaaaggagagctctttgatctttattcattgtctacttaatccttttagaaaagcaattccaacaaatttttatctagattccaacccaacagaaatttcacagtgcctgggtatttgaggggcttggggtgggggatggcggtgatgctgaatggagctgtccaacaatagcacttgatggctaagagcctcacagggaagaaagagtataaaagcagacacaagaactgaaatgtaacagcagtctggtttcacttattttaaaagcaaacagactcatacaatctcagtaatctctgactttattattgccatacagcataatttagtaaccagtgttcataatgataatgcagagtaatatatatgattaaattctctttattctgctttaaaaaacaaaaatgtagtatattttagaaatgctttcatgaaaacctggcttcatgtgtctggaaagtttactaacgtaaaacatctcatcccttgccagtcctgccagttgaataaagggttacccttcatgggactgacttggcagggggtcgtttgaacagttcctagcatttattattacttttctctcttaagcgcctctgtttgaatggaagcacagggcaagaggtgatcatcaattctggcctggagacagtagaagctttggcttttgaacccctcagccagctgctttactgggtagatgcaggcttcaaaaagattgaggtatgtgtattttcgtgctgttcttaattaagggagcaggcggggcacctgggctttgagccacatttgacacagaggcaagggccagtgtgtcagattactcaggaaatttactgcgagtttccagagaatggaccagctgagcctctggagaggagagaaaagggggtaagtacctgtgagttgatcttttggctagcagaagcttagctaataacaataaatggtaatatttttattttatttatatatgtacttacttattttatttatatattatttttgttttattttactacttttattaaacatgatggcaaaaactacaatcacttttgcatcagcctaatatcatggtattattataatgctataacaataatcgtctagtattattttattcgattagagtgatagcaacaatatcatcatcatcatcatcattgccactgttattaatccccatttctctgcaacttagctacctagtaacctgtcccaccttatatacccaaggcaaggatgatgagtgacctctaaactgccaaatctttgtctgggggaatgtagtgtgctcagctcactgcctcagcacctctttatactgactctgcatggagagacggcatgtgggtgaagtgggaagtgcagtagaagcagggagatgcagagggctaagaggagttgcaagacgaaagacacagactcgagagatagacccagatgtaggcttgactccactagctcagcgacatggggcaaggtgcttatgctttctaaacttcagttgcttcatgcgttagatggagattcatatattcgcacaaccatttgacaggggttctctgcatgatacatgtggtttaggttctgatgataaagcagtgggcaggacacacacgttcttgttccagtagagcttagattttagtggaggaagcaaaataataaatcagttctgttggtggtacatgctgcaaagactctgaagcagtgcagtgtgattgcgcttttggagagtggggcaacattagaataggcagacagagcaggcaacttgaggttgatgtcttagctgagccctggctgagaagaggatgatcttttgtccacctcctggggatgctgatagaagtgaactggcatctactgaatgctgcctcggtggttatgttattgctctttctctcctttctttaattgcgtgtggtcagcacttggctaggggctagaagaatgcaggtgatgcacaagcacccaccttttcacaggctgtggggcgaccactgcacaactcaaatactgttggtgcaaaatggtgtcagatgagccaaggtgcagagctactgatgcttattggtccaggtgggtcagaagagttaggaaagtaggcaggcctggcagtgaggtttgaaggagagttatgccttgattagattaagcagtggggcaggtaggcccaggatgggatgtggcaagagcagacagcagtgagtccgcatcaggcttggagaagcaagagatgaccagcctggctgacgggaaggagcaagaatatgagtcccacctgtggactcttcattgcaaggctgtgacattgagaatttgttttatgggagtgtggagtcatcgattgccttggaacgtggagtgacacgggatggtgaaataagtaaatgctcatttgcttatttacttatttgagtaatttacttattgatactgctttgtccagatcatcatgccctggaaactggggcttacatggttctagctcctctttcagaccacttgaaaattgtcccatgagtcagaggaaggaacagcgcattgtgactagaagttggggcaggtttcgcagatgggtcaggtcagggaaataggcaggcatggagggggcatgtctgtagcagaagctgagtagccatctttggcaatgggggtctttaaggagctccgatccatctcagcctcttttccccctgtttttgtcaggtagctaatccagatggcgacttccgactcacaatcgtcaattcctctgtgcttgatcgtcccagggctctggtcctcgtgccccaagaggggtaagtgttgccccaaaaggaaatcagtcttgcgtccaatgctacactaatagattctcatggaaacacagactgcgggacaaaaactctgtttctcatgatggtggttgaaatggtctattaactgagaagtttgagaccacagcttagtcatcgtggtcaggtaactccgttcgctttttgttagccagtgtcagagtctctttaggcatccagatgtcttgcatctgtgggttgtttctctagaaaagttgatgttaaaagagagcttctgtagacatagacaggcctgcttggatattgtgagaactttctcttgagtttcatgcatggtacaaacatttaattcattccatctttcccctgccttcccagcatgtgtaggttttcttacgtacaatcagtgtgcacttggggaaggcaaaggtgctttttattaactcattaactgaaggaaacataattaagagggaaattctggatttgacattctggcttttcctctctcgtagcatttatgatagagaattggcacaatttttttcaaggaaaattctaagagtaatgtatgtacttggttgacaatatttagagagaacagcactttatgaaaaaaatttgcattcttccttttcattcttaaccctttaccctcacacttcctagtggtaatcattgttaataatgtcttgtgtatctttcatgattgcttttacttatgtacaagtattatctttaaaacacacacatatacacacacatgcacgccaaataggattgtagtgtagttactattctgtacctttttaaacaaacttaatatgtattgaaaatagttctgtgtgagcatatatagatttttaggtttcacagtattctattatatgtaccataatgtgtcacttcctctgctgattaacatttagtttaatatacatacatatacatttctttgtatattatctttgcataatttgattttatctatagataaattctagtaaaggaatttccaggtgaaggaatttaagtagtttcaggtgttgtcattacatattgttataataatgctgaaataaccagccggatcattcgaaaggagtttctgaccttttctggagtagtatttgagctcccatttctctagtattgatgaggtatgtgttctgtccccattttcgctagggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaaggtgagtccatttgttgctgccggacagtctgctagagcgggtgaggagcatatgagatcaggagcctgcatccctgggctttgcagagaagctgtttaacttcttaaaggttgccttttttccaaatttgagataacttattttcagcctatggagggatgccaggcagaggcgccaagggtccaggctcccctgctgttcacatttcaaaaggttaaaagtgaaggctcttcccatgaacattcccagtttgcccctcagtgtcagtagcctcatttcagggtggtgtcttcattttttgtgcgctttgctcactttattctctgatgacttccggtgagctctgcaccacctatagtgccttgcagttctttttcgactctggagagcaacatggctcttcccaactctgggaaacagatttcaaactgagggggttgggtttgtgtcataaacttgaatgcttatcagatagtttcttttgggcagtttcttctgtggggttatatggtgaggtttggataaaattgctgtcctttgcatttaagtagaatcttgatcaggctagtcattcagccaataaatgttagttgtctcctgcctgggggaactcttacccttagagagaaccagaataaagaacgaaagagctggactaatgggcaaaggttttctttttagaatgaaatctactgggatgactggtcacagctcagcatattccgagcttccaaatacagtgggtcccagatggagattctggcaaaccagctcacggggctcatggacatgaagattttctacaaggggaagaacactggtaagccagagtctcttcttttgtctctgtagagttgatctcaagaaaggggctgcgtgtggccaatctctgctcagagtaggagctggcagcctgcatctttgttgtcacgacaacatgcacattatttaatttcttcctaatgacatcttaatttcttttctaatgatacacaaacagctggaagacagcatgcttttgcctgcctagagtgttggtgcttggtgggtaattacaccctcctcctgcccttggcccctgactgattggtggcgcggcttctgttgcagctgggagagtcctaacatgtgcttaatccctgtttggcatgcttgcaggaagagactctgtgctgggtgctcagatagttgttgcttcctgacagggcctcttgcttgttctctggttgcccagatgacctattgctcattgaccgtacctacctctgctggaatggcactgtgtagttaggtgttgttttaattaacttttcccaccatgaaaccctaaaccccatgaagaaagagatggtcttttttattccccgatagttttaccagtgtctagcactttgtaggtgctcaattcatatttgttgaaagaataagggatgaaaagggaggggaagaattgcagtgggtgcagacagtagctgtcttagagatctactgggtgaggcttcaagaactgctatgaggctttgacctgctagtcctggagtctgagactattcagtggaaagcctttatcatttcatgactgctctttgattttgcttatctcccagccatactattgattctagaggagaaagatcagaggattaccaggaagaatagtccctttaagaatttccctctttatctcagcaggattaaatggcatcctgggtttgctgattctcctttattgacaaactgctaagttttctgttcttaactggaatgttgatattgttttatggttcttggctgaccctatactaggagaaaattgacaggggaaataatactgttatagatatcattgttatcctcttgggattgtgaagatagcatgagaacaccctgggaaaactataaagtgtcttacaaatgtaagacgatattatttgttatgtcttcaccactgacctgtgaggtagggaaggctggtattatgatccatggtttatagattagggaattaaatctcagatatgaattagctttcccaaaatatcctcactagtttaggggctggccttttgttgcaattctgccgctaaatggagaagtcacattctttcttagaggaggcacctgttttagaatcaggagagttgaaggaatcttgcttctcagctccagtgactgaaatcttcagacctttgtttaatggaggacatccacccctactgatctgacttgctagctagcagagtggatttttagtatttctccaagtggatttttagcatttctccatgttaccacttagtccagaagagtgggtcttcatttttacaagtgcttgtatgcatgtgcttgtttgatttgcacacaggagcttctgaaacactgtgtgcagatgaagccagtggctacccggtcacaacttacttcccagtcttgactgtccacttcatcccaagaacttgggcacagctgacatgcagtcacacctgtgactgaggagcagtgcgggaggagagagtttgtggtctcagcacatgcaaacgtggtgtcttggtgccagtcagacaggtctgcaatcctcaccttaggtgtagtttccctttcatgcctcaaagagtcatcttcatttaagttagccagagtcattttggggcccagagtgaggtctggatagatgacaggctggtttaaaagggagatatgtattagcagggcatagtggcacatgcctgtagtctcagctactcaggaggcggaggtgggagcatcacctgagctcgggaggttgaggctgcagttagccaaggtcgtgctgctgcactccatcctgggtgacagagtgagaccctgtcaccgaaaaaaaaaaaaaaaaaaggctgggggagatctgtgttggtgagtagaacacagacctggacctgtgcatgggcggctgtgactctccctttggccatggccagttgtcgcctctctgctcctttctgtttgcctttgggattttctcttgctgtcctttggttgtgagcaggatacttccaggagacctactgcctccaaacacagggctggagaaagacgtttttgtctttctctgcagcccagttggggtcaaatcaaagcttttgcagtggtgtctggctgtcagcactgtctatgagcactccgcacctcttggccttgaacttgtttgctctaacctgcttgctttttttggacactgataggacacttgcttttttggacattgtattacagatccacggtgtgtgttggatctagcacttggagaaatgctaaaaatccactctgctagctagcaagtcagatcagtaggggtggatgtcctccatcaagcaagggcctgaatatttcagtcactggagctgagaagcaagattccttcaactctccttattttaaaacaggtgactcctctaagaaagaatgtgactcctgtccatctttattatttttgttgtctcctcctaacacattcgggactttctacagtagtctcctgcttatttgccattttgctttctgtgatttcagctacctgcggtcaaccactgtccaaaaatatatatggaagattccagaaataaacaatgtataagatttaaattgcttgctgttctgaatagtgtgatgaaatcttgtactgtctcctccctgtcccacctgggatgtgaatcctccctttgtccagcgtctcatgctgttgatgctgccggctcattagtccctttaggagccggctgggttatcagggtgtcaaagtactgcagttcttgtacgcaaggaacccttattttacttcatgatgaccctacacctcaagagtagtgattccagtaatttggatatgccaaagggaggttgtaaagtgcttcctttagggaaagggtgaaagttctagacttaataagggaggaaaaaaaatcttacaccgagtttgctaagatctgctgtaagaacgaaccttctatctctgaaattgtaaagaaagaaaaagaaattcatgcacagtataggtttggtcctatctgcagtttcaggtgtcagctaggggtcttggaattgggggttttggaataagaggggactactatattaaccaagtgttaaataataataattgatagtaactacatgtattgaggggttgctgtgttataagtaccacagtaatgtgctttgtgggcttgtataacctcacttcgtcttcccaaagacttctatatgtactatcaatatttccattttataggtgagaatatgaaagtctggtttagtaacttgtgtaggtcacacttttagtaagtggtaagaatttgcactgtggcccgttgacttcaaagcctgaacttcgataaaaccacccggctctgctccctctgtcatgtgttgctagaatagcagtgccctggtagtatgacagcagttcagaagtactgttctagattttgattgatgatggttcataataaaaatgttgttcagttgcaacatttatcaatttgaaatatttggtcctttatagctagctggtttttattttttatttgtttagttttttggagacagagtctcgttctgttaccccggctggagtgcagtgacgtgatcttggctcactgcaacctctgcctcctgggttcaagcaattctcatgcctcagcctcctaagtagctgggactaaaggcatgtgccaccatgcctggctaattttttgtattttagtagagattgggtttcaccatgttgcccaggctggtcttgaactcctgagctcaggcaatctgcacgccccggcctcccaaagtgctaggatttacaggtgtgagccactgtgtctggccactagctggtttttaaatggtataactggaatttattctttgtaaagtgtgttttttctttaaagaggttactttacaagattgttgatgtattcagttgctcctgcgatggctcttggagctttggaattcttttgcagttttggaattctcctttagagcctgcagtaagtatgtgcttttaagtatctataatgagggcacatatttattatttgaggtagatttgattttgataattgccaagtgtatagatacttgagatgatgacatttttggctcctaaagtattcctggaggaattttccaaacaggaaatgtgaaaatgttctgaacatgcccagtgaagacatcacggggctatgtgtttgatcttctaagggaatgtctttgaagatgattgtccactcttcacattgagataacggttttcatattgcctggtccactcaagacaattgtcatcctgtataaagggtctgtggctgtggtagaactgccatcataggagttggtgaattacccttccatcttcttccagcttctctctgatgcagctctcccattttccattctctggcttcagactagcctagacattcctgcccctgcctacctcttaggatcagtgacttggttagcttgttttgcagtttgcccctggttactgcctcagagtacagtttcatacatttctgcctagatcagcctcctgaaatatgataccccattttgagttctctactcttagctcttcttgcttgtttggataggaatatttgctctgcatatgaaaaggttagtgaaatgattttacagacatgatccctgtgaaaaaaatcatcctgtaatagagtagttttttttatttgttcgttttgtttgtttgtttgtttttgagacaggctctggctctgttacccaggctggagtgcagtggcgccatctcagctaactgcagcctctgtctcctgggcttaagcaatcttcccacttcagcctctgaagtggctgggatcacagatgtgtacccggctaattttgcttattttttttttgtggaggcggtcttcactatgttgctcagggtggtctcgaactcctgggctcgagtgatcctcccacctcggcctcccaaactgctgggattacagatgtgagccactgcacccagccggtaatagagtattttaaaataacatcatattccattattgttcaggatcttggaacattgagtgatatattgttctttgaatacaaaacacatgttcccacatccttgtttgagttgtttctcatgagtggtggctctatgtcaattctgcattccctcttgtagccagtggcctgtacctttgaactaaaggagccatctgtgcccactaatggatcagagtgaagggatgtctgggacttctgctctagtcagctggttagtctgctatggtaattaagctgttatgattgattatttactgaaccttttggactgtttcatcatgtggacttcccttcctctggaggtgtatgttttctctctatttactgaatcttttggaatgtttcatcatatgaacctcccttcctctggatgtgtgtgttttctctttggtaatacctcttactcttttccttggcatcataataacgttgttgccatagcattgtgatttttatttttatttgtaatgtaaattaaccaatgatgtgcccacacacccaaagctactgcgtatattatccatatcgacactgattatcattcatgaacttcgtctaacctgtaggccaggataggcatggcttagatgaatgcttggctgggtggcaacagatgatttggatatggtgctgaagtgtgggagggcatctctgtccatgacatagcacgaatgaagaattagcaattgagttttatctaagtttttatgttcatttttcccattttcatgattaataattgcagtcaaaagaaaaaacatgatttcatagtttctgtgaccccatagttgtatcatgtttcagattgttataaaatggtttatgcatcttcttacctgccatccccggaacgatgtaggggataggatggcacttttgccatcctcgttcatccacaaaggctccttctcaagagtgcagtggtggattttacgaactctctccggtgctgcctttagtaagctgaaccagagaaaagattggcaggagtgggctagatcagcatgaactagtccttacctgaacacattgcacagcagtggctgatgagtactgtggttggctcctcctttagctcttgaggggcactctggcacaaaggaattgagaaggggaggcctggatttttgtcctgggcccaccattaaccaggtgtatgttctaattaaggcctttggggccctaaggagcagaaacccactcaagctagctcaagtgaatggttttatggaatgaataaaggagcccaaagatgaaagtctaggagagcctcatggggactggagctgttctttctctttccctctcattaggcctcttctctctgtaagcctctttctttttaaaaaaaaaattattcggaattttgaaggcaatgttcaactatattatagccactagtgttgtaattgagaagtccaaagacattctggttcttttttaaattaaaaaaaaaaattttttttaagggataggatcttgctatattgcccaggctggattcgagctaccaggctcaagtgatcctcctgcctcagcctcctgagtagctggggctacaggtgcgtgctgccatgcctggcctccttaagtctcttttagtctcctgacggtctgcagactgagcttatctgcatacccagagttttgacttccacacggttttggcttgccatgtgccacttcaacacccatgctctgtgaccctttccctggctccagctccttggttgctttcttgtctttcagtgacccaattacaaattcccaggaggaaccctgctgcctggcttggctctggggcagtctgatctggctgaagacaggatgcaagtcactggttatactgagcagaagttttcagcacagtaggcgccccaaagcttgccacttgacccttgagagcttctcgctgtcctttccgtaagacgaggaggttgcagtgggtctccttcttgtattcagtacctccctcatggtgtgtattaacctacctgctgctgtttgtcttccctccaggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaagaaggtacttccctttttcttttttgcctgtcatcctccttcctttgtttcctgctccccgccaggggagggagggatagctctctgtttcctaaccttttcgtgttattggaaaaagtccaaggtaaaaatcaaacctaccagatactcataagaatactggtttgggttctaagtcctggtaagggtcaaagaggcccttcagtcctcactcagaacaggcctatgctgtacctttctaagtagtagctgtggtttttggtttcatgtcagatggcacaggctttcttcagggtctccctttttattcttttgcttcttcctctcctcacccatccctcacatccaggtttcttacctgctcctgttttgcataagttggaccaacctgattgggaaaaataaccagtgtgactccttccgcgtttactctcacctaacggttgtccatcctctcaccgtagcctagcccagtgtgtcctgaactttcagaccaatgtttgcaaagcactttgagtctagaccttatgccatgaccaagcagcaagagcagccttacacccactccccctctgaatttgaatatagagatttaacatttctttcctccgaaatttaaaaagtttttccttcctgtgtaatttttactgtcaccacttcccccgcctccagcatcacgtttctgtgagtgaggtgaacccctgcaagggcaccttgccatgaagtgcatggattgatggccagaatttctgcttttccttatctgtgattctatttgcctttttttttatatatattttaaagagacaagaaagagacagggtcttgctgtattgcccaggctggcacattcacggctcactgcagcttcaactcaaactcctgggctcaagggatcctcctgtctcagcttcccatgaagctaggactacaggcacgagcccagctaatttcttttatagggacgaggtctcactttgttgcccagtctggtcttgaacatctgggctcaagggatcctccctcctctgcctcccaaggagctgggatcacaggcatgagccactgtgcctactctatttgctttgtaatcctaaccctgcttctcacagcggcccaagtccaaggcagtgaaacacacaatacaagccttttagtcaatcttccttaagaaatataaacagaaaaaagatgagcctttctttcttagaaacaagagactttctttcaggctatggatacaatcttaaaactgtttggaaagaaatagaatcaacactaaattccaagagaaggggaagaaagctactccatatttcccattagaatgcctttgattatccaaatatgagaccaatcatcgcatgtccttgatgcagtttgccaaactatacattttttttctgtaaggaattttaattgcttgctttaaagtagtcatggggcagaaaaatttctcagagtattgagaaaatcttcataactcatttgcttgatagatagaatatatatggatatatataactatgtatataaaaacatacctatagatatattgaatctgtatgttttaattctgtgtagacacagtccattaaggagttctgtgtgtaattagtattttataatgttgatgtactgtattcactacccaatagactcaactggtattgtggttatccttcttaaagcattgtatctgcttctaaatatttcttccagcctcctcctctcttttgattttaactaaaagaggaaagcaagaggctagtatgggacatttccttccctgtagacacgtgtgcttggcattcctcctccccctttaccatcatgttacttgttgcgggaagtccgggaccccgaacggagggaccagctgaagccatggcagaagaacgtggattgtgaagattttatggacatttattagttccccaaattaatacttttataatttcttatgcctgtctttactgcagtctctgaacataaattgtgaagatttcacggacacttatcacttccccaatcaatacccttgtgatttcctatgcctgtctttactttaatctcttaatcccgtcatcttcgtaagctgaggaggatgtatgtcgcctcaggaccctgtgatgattgcattaactgcacaaattgtagagcatgtgtgtttgaacaatatgaaatctgggcaccttgaaaaaagaacaggataacagcaatgttcagggaacaagacagataaccttaaactctgactgccggtgagccgggcggaacagagccacatttctcttctttcaaaaggaaatgggagaaatatcgctgaattctttttcccagcaaggaacatccctgagaaagagaatgcgtccctgagggtaggcttctaaaatggccgcttcgaggggcggccatcttttatggtcgaagctgtagggatgaaataaaccccagtctcctgtagtgctcctaggcttattaggatgaggaaattcctgcctaataaattttggtcagactggttgtctgctctcaaactctgtctcctgataagatgttatcagtgacaatgcgtgcccaaaacttcattagcaattttaatttcgccccgtcctgtggtcctgtgatcttgccctgcctccatttgccttgtgatattctattaccttgtgaagcacgtgatctctgtgacccacaccttattcgtacactccctccccttttgaaatcactaataaaaacttggtggttttacggctcagggggcatcacggaacctgccgacatgtgatgtctccccagacacccagctttaaaatttctctctttttttacgctgtccctttatttctcagaccggccgacacttagggaaaatagaaaagaacctatgtgaaatatcgggggtgaatttcacccgatatctggctgaatttcccccgatagttactaaagggagggaaactcaaaagagaaagacctgtggtccagcagtaagaataatattggtttcatttcctcccctgccgcactctgatgggtagagaacacctgtcttcgcaaccagtatcgctgcagcaacgggaactgtatcaacagcatttggtggtgtgactttgacaacgactgtggagacatgagcgatgagagaaactgccgtgagtcttctggattggacgttaagcacttaccattactcagaagcctggttggctcttcccaggctgagggcctaaggtctagggcgagggccacccatgattggtgatgcccatctaagttgatggggcttagatgacagagaaaacatatttccatacacaggtagatattagatatataggattaatattatatacataatatttttttaaccaccccagaagtaccactcgttacaagagatttataaataaacgtcacatggctgaaactgaattgatttggcaatctgggctctaatcttggctgtggctctgtaataaagctggtgacttggggcgagtaaacaggtgatattctttgatttggaaattcaatattcagcctttttagggatgggaaatgagtatttactccagttggttgatgttggctacctaccaggctcaagagagattgttttcattggttagtaatgcatagcttggcctacagtgtggggccattggtgtacatgccatgtaagtgtcatctttaggctgtataatttttaagatctgacttctaaagtataagactgtggttagcagaagttaaaaccaaacaaccacaaataacagatagtttattaaccatgaattttcactatcttttcttcacttaatttttaatagcttcgacattatcttataaggagatgatttgcccttttgtcagtcatgcactcactcaacaagcagttgctatacaccctgtgttccaggctctgtgctgggcctgcatatatattgccgatcaaggcagaaacggagttcacagtctgaagtaggagtcagaaaaataggcagttacagtagagtgacgggcactgcgatgcggaagtgtcatatgcatgtaggatgggcacccaaagcaaacttgggcaggccctagcaaagagctctggagagtgtctggggtgaaccaagcagaggtggagggaatcaattcacaggcaagggagcagcatgtggggaagctggcatggccaggaaactggtttgagttatggagaatgggcatgggcacaggggccaaggtgaagttagatgagtgggcagcgcccaggacagcaagggctttgtggactttatcggagaagcagttgggaaccactgatgtcatgtgatgaaagttcatctttggaaggataagtagtgggcagaatgcgtttgatggagagagaccagaagcaggaaccaagtcagaggcttctcttttatatattttacctttggcaacccaggggctcatttacccatttgtactgtaagaacagattaatgggaagctctagatactcatttagccagtcatccgtggggcctgtgcccggctcccctgccacttcacccagaaagcaacttgtgaaatatccagctcattaaacacatctgggccctgcaatcctatagactcccccttttggctgatagagggttatttacaaagcctttccttaatcgttttcccttggattcagagggtgcctttcacaccgagggagtagagcttatttgctgaatggcagatttgggaaagcactagcctctctgtgtcttttctgcaaaaaataaggcctataaagcctcctttatcagagttgcaggaaggtgtgatatttgtgggggaatagccaaagctctttaaaaacattaatgcttattaacagcattgaagcagataatggaaaggagtttattacatatctgggtgggatagaagatgcttcttagaattaacaagttacaaggaaattgcccagacataattaggcacagtggaagcagggagatacaaaccagatgacctcatatccaagagtgagggacacaggtggcagagcattcctccttgtgcccttgggcttggtttctactaaatggacaagctgaatcttgtattggctccgagttttgagaggaatgaagacctgcatcttttgggaggcacctgctgcctccaatggcttcctcccacccagcccctgagctctgttgcagactgcacagttatgcatgaaggatggagctggccctgccctcctcccagcttggcgtgaatgtcagctgggattcactttccagagaccccgagacctactttctgctccgtcgtctccctgtttcacctggctcaggtctacacatgtcagatggagctgaggcgtggagaggaggaaccagaaggatttaaaactcagagactgggagtcaagagagaggggcttatctgtgcctgcatgtgtgtctccctcatcaaggaggttgcgtgtggaggagagaggttccctgtttctaagcagggctgcaggagctggaccgcagtgactgagtactgccatgtggggagttaagtgaggcaccctgccagctgccagggagcagtggaggaggggggacaccgggatgcaggagggtgttgtcagtgggtttccctccctcttacacagattcctctagctgggtgactgtcaggcactcagggttttgacgcgaatccctgcagtcttgtcattttgcattcatcccctgcctcccaccacgagctcaattacagagaagaaatggagcctcaaataagagctgccaggatgtctaacggcagcattgctatttggcatttcgtgcacgacaacccttcccccgtgccagcattctgttctgccacattttacctcctgggtcagcctttcactctcctgagagcagcctgccttcccctcgcctttcctggagggtgtttcacggggtgccagggattgtgcttaagcacaggaaatatctacttaggagaggaagaaaaatctaattctgtatccattctaatgccagaaggacatgaggaatgatgaggaagagaagtgacatttgtttagagcccattatatttacatcctatttaataggctctggttccaaacttgttccctggtttatcttcataataatgctaccaagtaaaggcaggttaagtaagttgtaggttgcagactcaattcaaatctagtctttctggctgggcgtggtggctcatgcctgtaatcctagcactttgggaggctgaggcaggcagatcacttgaggccaggagttcaagaccatcctggccaacatggcaaaaccccatctgtactaaaaatacaaaaattaactggggctggtggtgggtgcctgtaatcccagctactcaggaggctgaggctggagaaatcgcttgaacctgggaggcggaggttgcagtgagccgagattgcgccactgcactccagcctgggcaacagagcgagactccatctcaaaaaacagaaaaacaaatctagtctctctgactgtgatctcaagcactaggacacattatcttacccagttttactgttgagaaaacagccgtagggagattaaaattaatttccccaggaagaggtagagccacgatttggtacccagtcttgactgactgcagacagagcctatgttcctactgtagaattctacctccatgctgcctttaccatctgtacaatgaagtgctaacttcttgtgtgaaattgagcttctctaatcgtagtttcatagataaaggtatttctgtcacttatttaggaagacacttttcgcgtctgaagggatcttaggaggtcacctagcctgtcactctctctcgccaacagatgacagtttctcacttttccccgtcctgttccgatctggaagctgtccacagaaagatatgcccttatctctcttggttgtaaatttcaagctctcatgtaatttatgtcttctgtaagtctaggtttaatttctgttgctacaattaatacctgctttcttctattttttaattggttttccagtaggatgtttacatttgtgggaaatcaattgtacctaaggaatatgttgtctttctatcccattttagctaccaccatctgtgacctggacacccagtttcgttgccaggagtctgggacttgtatcccactgtcctataaatgtgaccttgaggatgactgtggagacaacagtgatgaaagtcattgtggtaaggggacatcacatcctgaaaccctgctctggagaggggggtcattgtgctccctcacagggctgtactggtatgtactggttttctgatagccgtctcaggatttatgatattctagctgaatggctttctccatccacatggtggggttgagtcatttctctgtccattcttaaagagtttgtttgctgcttttcacgaggattcagttcgctggagacacttgcgaactgggaccctagattcccattaactctggatgggaccctagattcccattaactctggatcaagtgtctccagcagaactgaatcctcatgattcatggtcagaaaagatggagcctggactcagctcctgtcacttactcttagattagcctttgttttctagtctgaaaaatggggaaatggaccctgctttgccttggagagatgctataaggatgaaaggtgatggtaaggaagtaaatttctgaatgaattcagggggttattaacagctctacaggcttggcccacatgtctcagtgggtgtgagattagcctgctgaagacacaaatctgcacctctgtgaactgttcttttttttttaaccaatttaattcattcaactctgttattattagaagttagcagatggtataggcattgagtgagcatctgttttctgaatggacatttttatatttagaaaaacagtgggttacaattccaaggaatgatagagattctctggtccaatccttttaatttctactttctaaagtgactgaggtctgtagaggtcagggggcttattcaaggtgacacaattagtttgtgtcagaatggggaactggaatccatgtctcccattttctaatcctccactatttctgttgcacagtacctccttgtcagtttcatgagacccatcttagttaacagtccctggtcccagactcatagttgctgacctccgaaggagacattatgcaatcagcatggtgtgccagattgaggcatgagagggaagtgagagtggaggtcagacgctgacccagacgtggtgatgagttggcggggccctactgtgccctctctccctgtccacggggggcaggtccagccacgctgtgcttacgcacatggacacagcctgcttgattatgagcaggtggtttgactcacagcagctgaaataaggggagcaagggcagcttgtaaatcatctcaatgcaagttaaccagcagagcagagcctaggccatttccacacagaaaatacccctagcctggctcttggaaggtttttaaaaaattcccagttttccttcttcaagtgcctgaaaacatgtccttggaatgtgcaactatttccccttcatccctgccatttccttcccagcactcttagaaggttgaaatgtgtagctagttttgccctagtaagaaggaaacttcacgtggttccctctttctggtatcattgagctcacgtactgggtacatgtttgactgtgaagcagtttcagccccccgatcctctgttcatggctcattcttactagtttgtcctgaattcatcccagggtcccggttagccccttcctctgatgcaggtcctcttcgtaagtttccacactcttcctcaaaaatatctgatttactagctttgccatcaacaagcctcttggcgagaatgactgagacggctgccttgggccccacgcttggctgctcctgttttctgacgctctgtaaactccatgtgaaagttctatgccacagtctatttgggctgtgataacaaaatacttagtgtaggtaatttataaacaatagtattttgtttctcacagtactggagactgggaggtccaagactgaggtgccagcagacttattgtctagtgagggcctgttcctcatagatggtaccttcactgcagcgtcagatggcacctctgcttctggaaggactgcagggaaatgcttctatctgtacgcaagcgtggcagaaggagtgaacagctccctcccacctctttcttaaggacactaatcctattcatgagggctctgcccccatgacttaattacctcacaggggtcccatctcttaataatatcacattggtgattaagtttcaacatacaaatttgaagtttcaacatatgaagtataaacatttgaattttcctagcctccagaaccgagagaaataaattgctattgtttataagctcagcctatagcattctgtcttcatgatctccccaggagctttgaaggctattgccagggcagcctccttccccttcttggtcaagctctgctggttggttcttaccaggcccccacccttctagagacagcgcatccacccgtgtccctggagctctgcccacagaaagtcccgagttatgtttcctccgttttgggagctcagcactgattttactctctctgactgagcatctcacggtgatcagctcatgcagacctctcggcactccttttctcaaaccacaggctgtgtctgtaggagtcctctgtttcttgaaagttctacttcctggcctcctctatcactgcttcctaaccttcttcccatcatagcaagcatagaaaataatatatgtggagagcactgggatgaatggacaaggatgctgttgtcaagaggcaagcagctctaagggtctgagggtctcagaatctcagcccacctgtaacccatttgcggcacactgactggaagctgttaaatgaccttttgtccctggtaaaagtctcttcgttcatggtctctgtggatcattggtgatcacgggtccatctccatcctttatgagagctttgacaccagagacaaaattctgaacaagcttttgtcctcacctctctgtttatggtctcacctgcagaaatgcaccagtgccggagtgacgagtacaactgcagttccggcatgtgcatccgctcctcctgggtatgtgacggggacaacgactgcagggactggtctgatgaagccaactgtaccggtcagtacttcctggactcagttgacagcactcatccgttcatgcagtggttaacattatagctttaaacgatcggaaaatctaggctctgagaattagcttggaccttagaaatcagcgagtttcatgcttctcaaagagctggtctttgatgagataaggaacctgtgccagaatgtaaatcaacaccctgctttcaactgattaaacagtgttctgagtgatatcgttgatttatgttctggctcaagcttcttattcattcaggaccagtgttaaacagttttcagaccagcccctcggctggggtccatactttgagtaagcactgaactagctcatgttttttaaaatggagcatcagggggttccccagacaaggaaaatgtaaactgtgtttgtacccgttttgggtaagattttattaaaagtaaagatggaaacaacatgaatgtgctaggtgctataaggtaggggtagtgttctcattcttttgttgggttcgcttatgttcattacattatttttatgaatgagtggatgaatggtggccagatatattatgatggggcagggcagactgggggtgataggcagtgggtagtgcaaggagttgagaagcttgtggagaaatgaaaacaaattccattttataatcatcactttgtaccccattgtaatttgtccaaaaaacaaaaattaaggaatttttgttccagattttattactcattgagtaaatttgctctacagcctccttgagaagctgttattcagttctgtcttgaacccctctagtgattttggactagggagataaagatgtttcctttaaacatttcatggtaaggacagatctgtttttacactcggataattcagacttcattgtgtaattcattgttgagtcatcttctcaattatctgaagccagctattaatcttgtgaattattggacttttaaatctcatgtcttaacctcctctgcccccagagtatcccagcacttcctacactgcccggcatctggcggctcaaagcacgcctactaattggtaaaaggaaatacaaagaaggtacatctgttatatctcagacctaaggataaataactgtgcattatgctctggcttagacttgcttccccacggagagagatgacctcttcttttactcttttgtattctctgcagtgtccagcacataatagagtatgtgctcagagaacctttgtggattgagtaattttatgcaactgcttccctccattccttttagtttggaggtgacctcatatggccttaagggagtgaatagatctcttcaaatgccatatacatcacatgggatattctgtggtgttaccaaatcctgttcgcttgtaaagtccacccatgttctttctggcgcagcctctgtgtctgcacctctgcttctgaaaagactgcaggaaaatgcttctctctgtatattaaagcatggtctgcagaaggaggaagaaccgaggcccataaaggagctgccgttggcacaggaaacacgtgaatgctgtttggaagctttgggtttggatggatacttagttaatagattagaagggtgcacttggacattgcagtttgtaaattgcagtatgattgaacatcttgttaacacaactgccttactcaaatttgcatttcagcagcatgtgccggtcttacagaatgaattgattacttcatttctataggcaagcttgtataaactcctggttttttctctgattttcttccggcaaggcaaactggagaaaacttaagagtccttgctgctcagctgcagccttgttccaagggctgttcttccaaacctttcaaggatgatccaccttctctgtcatctcaaaatagttggaggtcagatgtgagctcatggtgatgtgtggcatgacacctcattttcagacctactaaattaagctgcgtacagtgccaaaagaaataggtcaaggtagctgacctcctgttggcatcagcttggatgcgcactctgctgtgcgtcctctttgcttttcttttcgccacttttactttccacgaggctgtttctttattcacctcaacccaccgctattgtttttaaacgtgtacatctgatttctgtgtgtttttttaggacaattacctgtagacattttatttgtattcttaacatctttcctctctcctagatatatggggactttagaatttgatccaaatctctgcctacagttccagtactaaaatacctagtattttaaacactaaatatttagtattttagttttatattaaaaaatcctaaacttcactgttactctttttaaataaccacacttctgcataggcacacaggtattaccaactacctctgtgtcttgttgctaatgcctcccaccaatgtacatccttcaggggttttgcagcaggagtctatgagtggcaaactctttcaaggttttgttattatagacatatatttaatcctcaatcttgaattcaaatgggtctgggtttctaggcttttagtaattttccgtattttcatagaattcttccatttcttcctggcctcttttgtgttgatttgaattctgctcttagttgtctgttcaaataataacagacactcttttctttctaattacctttaggttatattgctcttagttttacctacctaggtgtggaattatttttacttatcctgcttgagactttgtttgttttaagatctgagaatttttcgaaagacaactctgggaagttacagctactaactcttcaactatacctgttggctactttctctggtcttgtcttcagcagttactctaagccattcgttggactgcctcattctgttgttctcttccctcctgtttttatatttgctgtctctttatgactctgtgctagaatctgagcgacttctctagatttatcttccagttcaacaattctcttttcagctaactctaatctgctgtttcacatatacatggagctgttttttttatttccatgagtatacgttttgtatctagaatttctgtttggttctttttcaaatctgccttttatttttcagtgttctttttttaatactttatgttttttcttctctgtcattaatcattcaaattgtgatgatagtcatttttttcctcatgcacttacttttttttttttttttttgagacagggttttgtcttgtctcccaggctggagggtagtggcgcgatgacagctcactgtagccttgacctcctgggctcaatccatcttcccgccttagcctcttgagtagctggggctacagacatgtgccatcatgcctggctaatttttgtatgttttgtagagatggggttttgccatattgcccaggctggtctcgaactcctgggtgcaagtgatcctcttaccttgtcctctcaaagtgctgggattacaggtatgagctactgcacctggtccccttctcatacacttttttttttttttttgagacggggtctctgtcgcccaggctagagtacagtggtgcgatcttggcttactgcatcctctgtctcccaggttcaagcaattctcctgcctcagcctcacgagtagctgggactacagatgtgtgccagcaggcctggctagttttgtgtttttagtagagatgaggttttaccatgttggccaagcttgtctctaactcctgatctcaaagtgatccaccctcctcggcctcccaaagtgctgggattacaggtatgagctaccacgcctcatgcgtttctttatagtctagcgctttgtaagaaataaggcagtactttccctgttatactacttatttcatccattctactctgctcatgtttggttaatgcttttaatcaggcattccagcaggtcttgatgaatcaggaaagttctgcctgagtcaaagattaagttgtaggatattgacctatattagaaactgatgttagatttccacgattgtttaccacacgaacttcaccattcttatagttacaatgaatcctaccatgcagaggattctttttcttccctaaattcttcagtctggattaaagtccatctcttccatccttgtaattaaaaaaaaaatatgtattaagcatgcagtatttaccgggcactcaaaatcagagctcataagttactaagaagatagaaaaatctagaaaaagataatgcgttatgtattccagccatacctggccacttgaatgcaaactgattactctttctgagctcagcttctgtgatagaatctggagatctcagccatgcctcccagaattgtcatttggaaacttcactagcactctgaaatggttttcaattaaaaatgaaatgcagaggctgaataataactagattagtatggcaattggtttaggcaactttatattttatgaatgtgagcaaggtgtcggtgagggatgttttgaaaggctgtcagacttgtgacacgaataaatcaaaagtattccaggcgatggctgttactggggcagaaactcatgtaacatgcatgatacatttattcctcttatcagaaataagtatagtttttaaagatgtttaatggattctgagtgccaaaggttgtaaatattgaaacttcttatagttgtatatacatgctgccaaatacagccttggtccttggagagatgggaagacatagataatgagctaccacttgttttaaagtggtttgaaaaatcaggttctttggatttctgaccattgcaaaaaatagcctcaaatgcagtaaaattcctgaggacatcataaaccaattttcccagtccttgggcagcttactgccaactgtctcagttgaatagaaaactatagtttgctctcagcaacccacttctgtgtgttttgtttctttccgttgtggtgtcatcctctccacacagttaaactaacagagagtccgtctatctaggttctattatcttatgctggttgtaaacaaggccagtcctggcttgcattcagcaatgaacagacacaaacagctttctgtttcagaggaggaagaggaaatcagatggagaggaccgttaggagtgttggttgggttggaggcacatattacgcatttgaactagtgtttgactgagtttttgaggtggttctaaatgacttccaggtggcctcagcccatgtgtgcagaggaggctgttcatgtttaacagtgactctctttcactagcttcttttttgcttctagtgattatagtggacaccacatattattggctggtagatgttcctctcaactctacagaaagacaatttcaagttcttaggcctgctttctttgtgattttggatgactcttttatattcctctggcctgaggtttttcacacttgaaattggattttttttttaaagaattgtaatgtatggccttccagaacttagcagggcccttaggtttcactgtaaggatggtgaatttgagatcaccacacagtggctgcaccaggtccaggactccgtctcctgagcacaggctgccgctccttatttctcagcatctggatgagtaagaggacttaggtgagaaggcaaactaccagggtatagcagaagaagtgcaggcttgggccttggactgccttggtgttactacttaatgatctctaattttcctattctctctaagcctgttctcatttgtgaaaggggaataatccttaccttgtaggttgtcgtgaagagcaagtgattttttaacgtgtgcatctgtccctgggcaatggcctgggtcatgtttataaatccataggctcaagtccaccgagggagctgcccaaggtcagcccaagtgcccaattctcagccaaggagaaacccagatgctcccacagttcagaccttattcctacctcatgcaaacctcttttcagcccacccccttggacagttggtgggggatggagatgaggggtgtgcgactgtgtctctcttctctgttacagccatctatcacacctgtgaggcctccaacttccagtgccgaaacgggcactgcatcccccagcggtgggcgtgtgacggggatacggactgccaggatggttccgatgaggatccagtcaactgtggtaaatgcaaattccccagctccctccctgagcctccccagtgtctgctgttcaggaagagaggccacagagagccaggggatgaaatgctgttctcctatgcctgtatttacactctgaaaccaaataagcccatctactttctatgttatattgccatatgatgtatcagattatattatatagtcttaagagttgcaggcaagcagtttgccccacacacaaactatataaaatgctgccacgtaaacaaaatatataaaatgttttttgaaaccaaatatgtttaaggttctctatccttttgccaaacattccaagttttcaggggatgttagttgtctacatgttgttatacattctactccttaagtaaagatgtttatgcaactctgtttttgtgtagtaagcattttcatggaggatgcatattcactttatgctaccataacctagtttacatggttgcttcctggttgggtgtttgaggtttttagatttatactgttatgctagtaccactattcgtgtctttggaaatggcctgatttttctttgagatattttctgagaggcgttcttcagtatggagttgtaaggtgaaaggttctgaccagtttttgagtctctctgttaccaaattgggtttccaagggattacatcaaatgtgtctctaccagtaaaacgttgcatgtttccccaagtctccttgatattagatttgtatctttttagttgcttccactaatgtaatatgtgtgtttgcctcatgtagttttgatttatacctcttttaaaatactttttctacctagtgacattaaccatttctccaaatagtggtgcttgtttactgtttctgtttgatatcctttggctaatttcccagaaatgattactttttacaggattaaaacacattttcatacttatacctaatcctcaaggaactattctacacagagctcagtttgcaaaggctatctatgactgcctcattagaagtgattttcttttttttttttgagatagggtctcactctgtcacccaggctggagtatagtagtatgattgtggctcactgcagctttgacctcctgggcgcaaggcatcttcctacttcagcctcctgagtagctgggaccacaggggttggccaccacgcccagctaatttttgtatttttttgtagagatgaggttttcgccatgtggctcaggctggtctcaaactcctgggttcaagtgatctgcccaccttggcctcccaaagtgctgcgattataggcacgagccactgcgcctggccagaactgattttcaagtccaatgcctggcaataactttttgctcaggagaaagggtgacctagtactaaagattctgatcaagataccttagttgtagtttaatttcccctggaactgttgtgaaacctcaggctcttagcatttctaggcaaactttctccaaaacaactttgctttagaattcctccagaattaaggtggtgagtgatttaaatagctttataaaactaggatttcatactcaagattcatattgtgctttttctattcattgaagcttttctttttcttctaaaaaatatacttagatcaggtatggtggctcatgcctgtaatcccagcactttaggaggctgaggcgggaggatggcttgagcccaggaatttgagatcagcctgggcaacatagcaagaccccatctctacaaaaatacaaaaattagccaggcacagtggcgcacgcctgtggtcccagctactcaggaggctgaggtggcaggattgcttgagcacgggaggtggaggctgcagtgaactgtgatcacgccgctgcactccaggttgggtgacagagcaagactctgccttaaaaaaaaaaatgtatatacacacacacacacacacacacacacacacacacacacttatcaaaatggaaatgttcaaaatagaaaagatacaaaaagatataatctctcaggtgtaggttgatctcctcacctgcccagttcccactttttcctaataggaaaccaagttgtatattttttcagaatatttttgtgcatatataaacaaatttaagtatactctgtattattgtcctatttcatacccataatgtttaactttgcgtattgttttgcaccttgtttttttcacagaactgtttatctagggcataatttttatagagcacttcttgcatctctttatagctgtctgtgttccagtgtacagtaatttattaaacagtctgttattgatggactgttttcaatctattacacagttttgcaatgcaacacttgtacttgtgggcggttttcaacctgttacaaacagtgttgtaatgcaacccttgtacttatattaagta[450 bp omitted]ctgagttgatccctgagtacttggctaggactcctggaggctgatcgtggcagagagacagggtttggttaaaggagagcaggaaggaagaaagcagggttgggggcgatggtgggattagatcgaacttcagtgaaagttattgtttagttgaaatatgttctattaattgaccagttgttttgaatcggccacttatttctacttgattggttttgttagtgttgctgagtatcactgggggtagagtggggcgggggggggcatttttaggccagatgaccctttttatcttcagttttctttagccccagaaagattgccttgggtcactggtgctcatccttgattatatattggaatcacctggggagctttaaaaccacctggtgcctggaccttacccccagagattctgatttaattagcgtaggtgtggctgggacttgggacatttatggtgctcctggtgattctactgtgcagtccgggttgagagctaatgttatcagtgcagggagtggcaaactagcctgtgggcaaaatccagtccctaacctgctctattaaatgaagtttgatttgcatacagtaactactatttgtttacatattgtatatggctgctctcatgctgtagtggtggacttgagcagttgtgacagagtctgtatgacctgaaaaccctgcaatagttgctttctagttgtgttagttggggttagttggggttctccagaggaataggaccaataggatatgcatatgtatatatatagatttactttaaggaaccatcatgcaattttggaggctggcaagtcccaaatttgctaggtgagccagcaggctggagacccagggacacactgaggctatatagttcaagtccaaaggctgtcaggctgcaaaccttggagagagccagttgcagttcaagtacgaaggtcttgctgtgtcctcacatggccctttctctgtgtgggcattcctggtgtctctctcttctcaaaggacacgaattcttttgagtttaggccccattcttatggtttcatttaacctccattacctttttaaaggccctatctccaaatacagtcaaattggggatcagggcttcaacatacaaattttgggggaacacagtgcattccataatattagttccttacagaaaaatttgcctacccccgtattagagagtcagtatctattaatcatgcttgagattgggggtttgatgccagacagctctggatttcacttttggcttcatcttcatcagctgtgtactcttggcaaaatacttaatgctactgcccttgttttctcattttgaattagcgacaataaaatctctcctaatgttgtcttgagggtttaatgatgcactttatgtcaaatgctttagctctaggcttggcagaaaacaagtgctcaataaattgtggcttttactgttgcttcctgaagccacatctgtactcgtgtgcacttgcccagggctagagggcccagccagccgcagtgctcatggcctcttcccttctctggatcccttacagagcccctctgtacgcacttcatggactttgtgtgtaagaaccgccagcagtgcctgttccactccatggtctgtgacggaatcatccagtgccgcgacgggtccgatgaggatgcggcgtttgcaggatgctgtgagttggggcaggcaggggaggtgactcacggtcactaaagaacttgcatgggggtttggccaccctggggttgtgtctctatttaataactgacaggtcttggttgagtgtcgagggtttgaccaccctggagttgcacctctatttagcttacatgtctaggttgagcatccaagcttgccttttctgagaaagactttcttttgttgcttaaggaatcctgcttttcagttgtgggtgtatgtataaggggcaggatggcgagtgaccagggtcttggctcaagggtcgctgaaagtgagaggcctttcttgccagtactgtatcagatggcactcccagcgtgccgtagccccttaccctgcttcgatgatcctgtcacaacttgccccaatttggacctgtctgttcattttgctgcctgagctttacaggagcaggggcttgttttgtgcattgctatggccctctcctaaaatagtgcccttcttggagcagctcttatatttgtttcctgggactgctgtagcagagtaccacagaccagatggctcaaacaacagaaatttatttcttgcaagcctggaagctagcagtccaagatcaaggtgtcggcagggttgggttcctccgaggcctctctccctggcctcatagatggctgcctggctgccttctccctggctcttcacacggtctttcctctgtacacatctgtgtctaaatttcctcttctgtaaggacaccaggcctattagattcgggccacccagatcacctcattctaacgtttcctctttcaagcccttatctctaaatacagtcctgtttctgagagactagaggttgggacttaaacacatgatttttgggaggataaactcagctcataacacgactcggtaaagattcatggaatggattaattaacaaagtgtgtgctctgtttagattaggtttggcttttgctttcaaggcatggtttagccagacagtcctttgccagaactcactgctgttcccccttgcttctgggcaccactgctgcttcgacccctcagcatggaagttcctggacttcatggatgtttgttccctctgtagcccaagatcctgagttccacaaggtatgtgatgagttcggtttccagtgtcagaatggagtgtgcatcagtttgatttggaagtgcgacgggatggatgattgcggcgattattctgatgaagccaactgcggtaagatgtccagtctgcctcctcacatcctaatcctctagttaacagtgatgcctgcagttacagggacactcaccggcaaccccactgcagacttggccttcccgtaactcagcagcagttgctgccagttcctgaatactcatacgagttgagtcttgaagggggcagctggcacccagcaggtgctagggaaaagtttatttgatctcctttcctttctgtggttgggaagaccacattatgtataaggaaggtggtagataaggaattatggtaaatattatggagtgacctccccctaaaagtgacaggccacaatgtaatagttattgtcatgattggattaccatcaatagttgttttattcctttggtaaaatgtcagaattaaaattcaggtgattgttctcaggatattgtagtatagatcagaggaacatgggttaggggctgggaagatggggttttgtttagtttgtaggtgtattttttgttccccattgggtccatgaagctgccttatctctttatgggtgggaagtgtgggttgccctggaacttgggtctggaggaggatgcctagagttggagccctgtgttcacactgatgcagggaaagcaactgatgatgtggttgatctctgcagaaaaccccacagaagccccaaactgctcccgctacttccagtttcggtgtgagaatggccactgcatccccaacagatggaaatgtgacagggagaacgactgtggggactggtctgatgagaaggattgtggaggtaagaggcccctggggcctgggttagccccataaccaagacacaccagaatagttccaccagctatgcaggatgtgcctggctgattccgtgttttggggggcatatttttgtgagaggagtgactcaaattttttctgttcctctttctcattttgaaataagtgtggttggtttctcctattttcaggctatttattccgtatttgcagggcagagtgagaagtctagagccttcctactcaaagtatggtttgcaaccagtagcatctgcatctccttggaacttgttagaaatgtagaatctctgacctcaccccagacctacagagtcagaatctgcatgctaataagcccccaggtcctgtgtgctccacaatgcatttgaggagcactcatgtggaatgcagacttgcccctttcctttctggcattctcatctctgaaccaggtcgtggagtagttgcggttgaattaactagaacacaatgctttgcctcagtaggaattctcttagccaccctgtgcctcctcagccacctgtttctttcaccagcccctgcaaaagcaaacttatctgaatattaaccgaaatcaaatatagtaagggaaatctactccccaaaagggaaaagaatattgcctcttctgacaacccattatacatgatttctagattagccgctgctcagagctgtgccagtcactggcctccctcagcaggtacagctaaaactgggacatccgcactaggtttgggacatatttggtctaagatcaagctgcttctaatgttttgggtttccgtgcttggtgtttttctcagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttggtgagttctggcccaggtcctctcctgtggtacctgctattgtggagaggaccttctgggggtgtgctctgggcacaatccaaccgggccccatgccctgctgtctgggactctgctgtgtggccaggttgcctgttactaatggtgtacctccagggaaggctgatttctagcattttttcctggatcatagatgcataggaaattggaatgggagcatctcatcctctataactggcctctgaccttcctgcaagatgccagccaccctgatttccacccaggctatggttatgccacctttgctgccttcttagtgggaaagtacaaattggaattaatgtggaactttttgtgtgtgtattaaactctggggagagagcccaattcagcttgctagttggccggcctgtccaactaaaagaagggtaagcactgccatctagtggctaaactcaaagaggcagctgaaggtctgtagtcaccatattgttggaggtggggtagaacttgaaatcccatttcgtgtgtgctcctaacagcaggcggaacagaggtgaggatcctgtgttctttcctaagcaggagtctacttcaaactcagttataataggagaacaaataattttttgcatgctttgcatgatcttttcccttcttctgtgagcatgttctttccattgcttccttgtttaaaaacatcaaaatcccaaactttagtgaacctaaagcatgtagggatctcctgggttccacccagaaattctgattctatgttttttataaaacattataaaaatgatgtttttactagggtggtctttttgccatattgagtttcctcttgttctcctgtctagaagatcaatttttgacaatttctattttccaggccctctgtgagctgattcctccttgcctccctggattccttacatcagccaagctagattcctgatcttcttcagatagacttgcttctttcctgcctgtgcacctgcagcaaggttttgccctcagcaggaactcctgtaccctcaaccttgtcttcctactttccttatcactgaaacccaccatccatcagtgcaaacagaagcatggattttatagcaaaagagaccttgatatattcatatcatcagaacttctcaaaatgtgatgcaaagaccaccctaatggaatcgcctggggtgtttataaaaaaatgtagaatcagaatttctgggtggagcccaggagatccccatatgattcttaggttcacaaaagtttgggatttctgctttgaacaagtagggtattattctcctttcaagctccacctctgtggcgctttcactgattcctttaaatgatttccatctcttttccagtctcattaaacttacccattgaccttttgattcttaactatgatctgccatatattgcttcctaattatttcatgcgtgttgatctttgcttccatagccattgtgtggacttcctgtttgggaatcatgctgtctactactttgagtcctgctctgtgtctcctacaataataggcaaatagtcagtatcccctaaaatgcttctcaaattaaaatgaattgtaaaagagaaaacaaaactttgtgtctgtcctttctcctcaaggcctacatatttattgaataacttgattatcctcttcaagttgtttttgcttattgaaactctgaccaggacattaatagactctagcaaattctgactaatccagtgagcagatctctgtttatatatcctgttcagcttttgtactttcttttttgtgcgcagtgctgggacaaatttaaactcattgttatctgtagctcgtggatcttctttgtttagtgtagaagtcttctaactggcttattaacctcatatttctccccctttcagtttttcttctgataaggcccatactgatgaatgctcatgtcctccccagtattggagccctctgatgcctcccttattgtccagggcatgatttgccttggcctggcattctccgcctttttattttttatcacctgtctccatgtaccttgtgtttctgcagagtggttctgagatatagggaaagcccctttgaaaatccaatgaaaactatagaatatgcacaatatcctgaagttaataattgcttttttcatttgtttgcttaggttgttttgtaccatttgccaatgctttctgcctttcagtcgccactcaggataactttccacaggtcaacatgtccagggatttatcaagtccagtttttctcttggagatactccttctaacaacgtggattctcctttcgggacagattgttctctagtcctgctgtgtgcctgttacccagggactttcactgcctccttggaattctctttgcctttctcccagtttagattccttgtttcctggatcttgtgtgttgctttttcttggtttactcccttgtttgggtggagtgcatccttcagtagccttgtcaggtgaatatgatgacgcagtggccaaggacactgtgatgacagctctcaggtgtttgtctcttgaattttgctgctctggtttgtattggttgccctgtatacctggggcacaactgccttttaggacgttgcaccatcatcatcttcaggatttcctttacctccatctcctgttggaactcctgttttctgtgtcccagtttttctctttttagtttaatcccatgtttcagtagagcacgttttctggaaaatgcctgagaaaatgtatgtgggaggcctgtgtgaggtcttgcttgtcttaaagtgttttaattctgtcttcagacttaattgatagttgggctgggtttggcgtgctagattgtaagtaattttccttcagagttttgaaggttttgttccactgccttcaagcagcttttcggaaatccaaaagccattttgattctgattttttttttttgtatgtaacctgtttttaatcctctagaagcttgtagaatcttccctttggcaccagtgttttaaaatttcacaatgatgtgctttgctctgagaccctttccatccagcatagcggacacttgcatgctttttgatatggaagtttatatattttagttcaaggaatttttcttgaagtttttattaatgatatttccctctctgttttctcttatttcctggaactcttgtcattcatatattgtctcctgatctggtcttcttccttatttttttgtttaatcttttatagttttgaaaattcccttcccccacccccccaattttctaggagatttactcaactttatatttcaactctttgctgagtttttcatctttgttgtcatggttttaactttaagagcttctccatttttaccactgtccctttttatggtatcctgttttctttttttcttggataaataatatattctttctttctgaacgtattaaggatatttgtttttgaagttttcttcttgcaaagcctctatttcctccaaatggcctttttgggggttagggctctgtttggctttctgcctttcatgtcaaagccttttctcagatagttcttggttgctgcttgtatttaaggctggggactaaagtgctggtaagtaattctgagcacatgggtgggcttgtcaacttcgaggttcatggctgggaaccatgggggaactctgaatcttggttacttcagggttagtctctgaagctggtcattttccccagagaagattattagatctcctgcctagacaataattaccttattgctaggatcctcggagaagaggactgggacttccatatgtaggtttaatcccccttttatcagtaggatatacttgctgtcaactacgcctatctaaacaactctctgtttttactttctccaaataacaaccctccattcttctattggggtgacgtatgggttggttgcctcgtgggactgataggaggggatataaggaatgtagctgcgtcttaaacatcattcagtcagttcccttattttaactccttcttcacttccagttagatgccagtttctgaacttttggaggactgtgtgttgttgatctgattggttctgagctttctcctgtgacggcttagggtaggacgcagccttcgctggcctctttagtcacataccgctatctgtcttctttccagctcccaaatctcattatccatgtcctcgtggatttaggtctttgaaaacaatctcttgactgtggctttagtgggatcctgtggggaagcaacattagatgtctgtatctactctgctctctatccggaactcgcatttgtcttcaggttcccattgtaatttctaaagcaccgtaatctcctagcatattgattggttgctgttattggccagctccctcaatattaaaaagtaaattttaaaaatcttttattttagcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccgtgagtagtcagagagcccttcaccccctgggcacgtttctgcagagagcacagttctggtgcttctgcttcatttctggatcagcacacgcctgtgtgtgagtctgtgtacttgcgtaaccatgctcttactgcattctccacaagcgctttgccacgtgcacccataccattgcgttagtcaccttctttttaataagttgactgcgttttaaataccaggagcgtgtccaataaaaatactttctgaatgactaagataaatattttaaataggtttcataagcatgtttaactctttaaaaacgcccttggggaaagccacaactcttctgtatgtacattcattcttctggaagtatttagtgagcacttactgggcgtagaagctgtgttattagagggtttgcctctagcaccccattaagaaaattcattctcagtccttagggtaattatggttggtgagatagtgtgccgagccacatggggaataatcacagggccatctgagcccagtgtgaggtgatgcatgcattctctacgggtttggagttggtgggtcctggtgtttggtcctctgatgaacccagggaggatctttgcagtgagtgatggagggagacactggcttctgcaagcgtttatcctcatgtgaccagtcagcgcttttcagtccctggctgcacgctaatgccgccgttggctggtctgtcctactgtagcagacttgggagggcatggctggacggtgcttatgcagccccccaccggcctgcctctctgacggttgggtgctgctctggctcggggatccctgctttgcgggcctcccctccatccagtctcctgctggctgcagacagcagacgtcctagccagtcacactcccttccttgccaggataagggcttcgtccgtgcttgcctgattcctgtcctggtgaatgtagaagacgcccctctcactctctgctgagagcctccctgccgccaagccctaaccctaagcagcaaacgcctcagttcctccactttgatccctgttctggtcccattttttttttaatcttaaaataatgacttcctcaaccaatgaaaaactgagcctcacttggaatcctaccaagtcttaccatttagagatggaatagaatctgaggtggaggttagtcatctcttaattcctctaattcagtatttacaaaatttatgggacttagcaggatcatgtggaagtgcttataagagatgtgaatttggtgatctcacctcagaccactgaatcaagagcaatggtggaggagatgctcgggaacccaagccttttcagaggtgccctgtctgattcttagcatcagacaagattggcaaatactgctctgtcctaaatagttcacccagtaaggctcagggggaaagggaagagggagtcggccgtcccttctctgtctgtagcgttgttctccacagggtgcccgactgggctctccctggagaggcttggttaagaggaaggagtgtggatccagtaacatcttcagtttggttggacaaatttttgttgatcatgcacagcgtggcaggcattgatcaggtttctggcaatacaaattctttgtgttttttttctggcaggcattgatcaggtttctggcaatacaaattctttgtgtgtttgtttgttttttttttttttcttttgagatgtcatctcgctctgttgcccaggctggagtgcaggggcgggtgggatctcagctcactgcagcttccgcctttcgagctcaagtgattctcttgcctcagcctcccgagtagctgggacgacaggcatgcggcaccatgcctggctaattttatgttttcagtacagacaggttttgccatgttggccaggctggtctcgaactcctgacctcaagtgatctgcccaccttggcctcccaaagtgctgggattacaggcctgagccaccacgcccggtgactggcaatacagattctagtgggagggacatcaagtcagcagctatcctacagtgtggtgtaggcagtagcagaagttatccaaggaactggcatagtttgcaggtgggctagcttcctggagaggtggggacaggccaggagaggcagccccattgatggtgcctggacaacggtgggacaaggtggcagatgatgggcattctagacacaagggacagcatgtatattccaaggctcagaggcataagaaaacagacctgtagagtggctgtgggtgggacaaaggtgagtgcagagaggtaggcatgaggtagatagggcgacccctgtgcttggagtttatttttctggtcctaaggagcccttgaagatttcagagatggggtgtttatatcttagatcacttggacttcatcatggggggaatgggttatagaagaaggctgaggtgagattggaagccaggtgcccattaggaggctaatttgatgggactgtgaagatgaaaaaggaagagtgacctctttgtatattggaggtactattaacagcatccagtgagtttttttggctgtggtaataaggaaaaaggaagaatgagggttttccccaggatgacagtgaaagctgatgctaccagctatgtgggggttactgaggatgaggagtcgcagctttccctgggtggggctagcacgatggtgggttcattgattgacatcagcatctgaggtagtgcaagtcatcctggaagaaactgaaaaggggaggtcagaaaccggggcattcttgtcttccttttcattttactgcattaattgtccatgcaagtgatcttcgcttgcctgttgcaatgagtctttgccagttttcacacttttgttgttccttgtgatgatctctacggtgatggacttctggagacgaatttcattctaggccttgatgtgctctgacttgagagaaaaatcatcttggccaagtccttaacttgaaatatgaaactaatttatttccaccatgcataggtttttctcctaacacttggcttttcggaggggtcccaggacccccatcgttgatgcgtcctttcctctccaggaatgtcacttttgcttttgtttcggctgcctgaagggtcttttctttgactaaaagtcaaggaattggataagttgctacctagaggtctttttttcaagaaacaccctttgagtctttccaattcttcaatttccaaggtagggtgatttctttttgttttgtttatttatttgtttgtttattttagtttaggaaaatcataaggaatctttcattactaaactattcctgttggaactcagatccattttggggttggatttctctctgtccagaacatgccacttgttatctggaacccaagaaccaaaaagattaagataatttgatatctcttgatacttgtgtataaatccatataaataaataaatgaatctatataaataaaccaaataggccaggcgcggtggctcacacctgtaatcccagcactttgggaggccaaggcgggtggatcacctgaggtcgggagtttgagaccagcctgaccaatatggagaaaccccatctctactaaaaatgtaaaattagctgggcatggcggcgcatgcctgtaatcctagctatttgggaggctgaggcaggagaattgcttgaacccgggaggcggaggttgcagtgagctgagatcgggccattgcactccagcctgggcaacaagagcgaaactgtcaaataaataaaaaaataaaccaaataaattcagatggtgggggatattttaatctccttggttaacatttccatattacatctctttctcatttctttgtcatgtctttcagttgtaaggttgagctttgtcatttactttcaaagttaatgcaagtttgcacaaataagtgtttggatttgctgatggagtttgtcttcaatataattaattctcctgctgtgtacttttttttttttgaagttcttcggtgtttagcaggatgcggcagcctttgataaaccttaaaagattcttatttctctttctgtcgccttatgcctgtttgctttcctgcattttggctgttttgtttttcactttgctttatcataagtggtctttttcaggctgcttctgctttactctttctatttgctgtggtaatattttctgatgctttttaaagtggccctatcttctttacaaagtcattaatgaccagatgaaaacttggaaggcatgcctgtcatacttgcaagtaatacagagttacccagatagcttattttctggcaaaacactcaggatttacaaagggaagctaaactttggtggtgggttttaatgtgctattcattattctcaagcaaatcatgtattcgtttcacttaattctcaaaataactgcgattttggtcttatctcctttgtggagataggagaattaaggtcccaagaggatcacctagccagtaccagattgggttatttatttaggttgaaagccatgttgaaagttctcatcagggaagaatacaccaaaactaacacagatgaactgagtagggattagtgtacagttctacacttacattaaaggaatgaacaaagtagactcctagagtgttaaaccaacagggacaggttgatcccacactcaccaaaatgacagtaggaacatctgaggcgaataagcaaccacataataagatgaacattggagataattaagaaagagaaaagaaatgggacctccctcctgggtgatattaattcattaattggcattctttaaatcagtgttttcagcctgtttccaatctggcttattcacagggatgttgcctggtaaagggtcttaaaatcaagatgtgttatatccacggtttttttccaacattaatttgataaccttatctaaaaatgaaatgagattagtgtggtgcgattctttttagagaacctgtcccctgaaggcgactaagttctattctaagtgcctgttaatcatcggttaattatcagtttaagaattttcagagttaatgacaactttattcccagattctattgtttttttgttttaatttaaggctctttttttttattatactttaagttttagggtacatgtgcacattgtgcacgttagttacatatgtatacatgtgccatgctagtgtgctgcacccactaactcgtcatctaacattaggtatatctcccagtgctatccctcccccctccccccaccccacaacagtccccagagtgtgatattccccttcctgtgtccatgtgatctcattgttcagttcccacctatgagtgagaatatgtggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttccagatccctgaggaatcgccacactgacttccacaatggttgaactagtttacagtcccaccaacagtgtaaaagtgttcctatttctccacctcctctccagcacctgttgtttcctgactttttaatgatttgtttttttttttttttttaagaaacagggtctggttatgttacccaggctggtctcagactcctggactcaagcaatccagcctcagcctcccaagtagctgggattacaggtgcacactaccgcacccagcttacttccagagtctaaagcccatgcttttttgctcttaaaattttgagacatactttataaagaaacctccaacgtcctcagctctactgcttagctgttgtttgattatatttgaccacattgttacccagtagaatacttctgtgatgggggttttggtatttttcaaaataatcccctctgggcatagtctctccctggcaatcctatataaaatggcataacctgatcagattaatgtacttgtttgcagtttctctcaatagaagataactccctgaggacaggtccttcatctgttttacatatccccatatttttaacatctggagcagtgcccgagtcatggtaggacctccatgaatgttcacagaattccatcttgggcttctgagactattacagtagtggttctcaaacctttctctaattcttgaatacacgtttatttgtcatgagcttccccccaccatggcaaaccaatttcagctcagtatataatagaattctgaaatgcaatgatcttcctggagaatgggggattatagtttgtgaaaagcctcataaatggttttgatagttcccttctattgacaattttttatcaggattgtttttgaataagtagtgaactgaagtctgtacctccatcctagagactcgtgcaaagaagtcttaattcttctttctcatgaaaactcatcagtggagaacacttgtcagagtggtctgcatgtcttctcaccacctcccccatccttgtatcttttcacctctaggaaaatatccctggatcctttatccattcctcttgaccatcctggttgctctcatgggaacattatccagtttctctacctatatctcaaagtgtggttgtttatgttaggaggaaggagaagagggagggggtcgaggtcaagaggtgacccatgaccacatgcctgggtctgaagtggggcgtatgaagcttccttgctcaggtcacaatgctcatatcacctttaacataactttgttacttgtgtgtacactctctttatttcctcagggcttagtttcaggaagggactattatcatccttgctttaaaattaaactataaacaaaattccttccatagttagcttggcctacgtgcagagataggcagaggccgttaacctacaagatgtcaccatgggcagggggcagggtgcggggagcagaatggagccactcatgttcagcctccttttgtctgttataatttccccattttcaaagccagtgatgttgcatgtctctcacctgtcttctgtattctctctgtctctcaccacaaccagaaaagggtctctgcttttaaggacccatgtcattagacagagcccacctggataatccaggctgaactctcctacctatgggtccttaatctaatcacacctgcaaagttgctttgttacataaggtaacatattacaggttccagggattaggatgtggacgtctttgacttggaggagcaagattgattttagaccctcatcactggtgggattggatttctgatgtagcccttccttgtccaggactgggcaggcaggtgtgaatctgtataaggaaggcctcaagttactgttcctgggctcaaccagctacatagcagatttgtaccacccaggtacacagcctgcatagcagatttgctgtctacagccattctcaccttttctcttttcaggagcatttgcaattatacggtcattgctttctttttggagcctcccgtgcagttttaatctactttcagaactggagagcacatcacattttggtcaatagcctagacatacagttgcataacccttaacttaccagtgctcattatttgcattatttcattttctgttcaagtactttgaaaagccaaacaactttaaatactacataaagtatgcatgcctcttaatattgttgggattcatctcattgttatttctgttactcaaaccagaaatcagctcctctttctagattgcaaactaataatagtagcagaataattaatagtactatagagtaatagctacagtttgttgatgccggccaggagccaggcagtgttccaggtgtgtgatctcattagatccttgcagacatgatagtgatggaattgttacttccattttttatagggcaactgaactcaggtgatattaagctgtttgctcaagctcatgcagatctaggatttaaactctagtttgtttgactccaaagtgctcactcttcccgaatgcagattccagttgttaatgttagatgagatggcaccttagtgccggtatagattccaccactggtcattccagaggtgtgttttgaagcagaagccaattagtactttgcctaaatgggaataaacttgggcccagcctttagtaccatacggcccctccccgtggacttaagaagcctctctgtgtttcagccacacacagcaccttgacttgcatgagcagggagttccagtgcgaggacggggaggcctgcattgtgctctcggagcgctgcgacggcttcctggactgctcggacgagagcgatgaaaaggcctgcagtggtgagtgccggtccacgggctgggctgggctgggctgggctgggaggctcgcttaccccagggcccctcctgtgtagaccttgagctaggacccttttgaactgttgctcaatctaaggataaaacagatttgtgcctagttttggagccccaagtgaggtgagccttggccagactctgatacaacatgcagctgtctcctccctgttagtgaaatgctagtcttggattttttttttttatggacttcccacctcatgcccatacaccatggctctcacagtctcaatctgctggtgggattaactcagttcttatctctggagtgtctagtaatggaccctatgacatggtccttggacttgtagcattctctatggagaaataggcttaaattgtcataggcaggaggaagatgaaattcgagggaaaatatcacgaccggaaaagtaggagaccctaggagggattgtatagggaggtttcaactacattttctgagatttcttttcagataatgattatggcctcctgataatctagatcatggtagttctgtttaaaagcaggagtcctttgaaatctaaggatttgtaagatgtaacttttttttttttgtatttttagtagagacggggtttagccacattgcccaggccagtctcgaactcctgagctcaggcaatttgcccgcctcggcctcccaaagtgctaggattacaggcgtgagccaccacgcccagccaagatgtaactttgtttgactttttctcctttatctctctagatgagttgactgtgtacaaagtacagaatcttcagtggacagctgacttctctggggatgtgactttgacctggatgaggcccaaaaaaatgccctctgcttcttgtgtatataatgtctactacaggtaggtcccatctttgtcatgggagatgaaaatgatgtcttcattgccccaggatgttctgtaaactctctagtggcatgcaccatgctattaacggagtcagacatctcagccccccatgctgctccagtgtgacaatatctttatttttttttgggccagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggatgtaagtgtttcagttaatttttatggcatgggtaagacctcaggtcggggtttgtgagggtctttctgagtattctcaggaatgtgggaacatatgtgtgcctcacatgtacagaagtatggtggctaagctttatagtcttgccagagttgtcaaacatctgttcttcttactgcatcagagactgttcttgtaccttaagttaatttaagattctctccaccattgccctcttgcattttttgtctagtttctacctctacgttcctcctctagatatttcctagtacttggtacttaggaggaggtcatcgtcattaaaatatgaggcatatcagcaattttgtggctaagtttttttctttttggagacaaggtctcactctgacacccacactggagtgcagtggaggcgcaatcactgctcaccacctcagtcttcccaggctcaggtggtcctcccgcctcagcctctcgcatagctgagactataggtgtgtgccaccatgctcagctagctttttgtatttttgtacagaaagggttttgccgtgttacctaggctggtcttgagctactgagctcaagcaatccacctacttcagcctcccaaaatgttgggattacaggtgtgagccactgcacctggctttgtggctaagtttttaagaaatttaccaaatttatgtgtctaagagagttcctcgcctcctccctacttcaaagtagttgacatgagcaactgtctgcttgaatgtcatcttttttcattgcctaaagtatcctgaatatgctagcgctaaactcattaaggaacctgctttgaagatgatcaaattcatttggatatagaaattctgtgatgttacaaaattagtcttattttttggtagtcatgcccacagtacagtttttgttgtacaagaagcagaggcagcaggtgctgtcattgacaattaagatctcagcatggaagtctcagggtcagtggtgactcagcctgcccaagtgattctatcctgcagcccttatgagccacaaatttaccacacactcaactgagccatgatgtgatgtgtggacggcacaccttgctttttggaagaagaggaaaagtgtcttttcaatgtgacgaccaagctagcagcctttctagtggatagtctcaatgccggctgtggagtcgttcttgtccttgttctaagcccaggaaaattcctctggttggctgctatgcagatgggttttaaccttgagttgactctttttctagtgccagatgcccctcgaaatctccagctgtcactccccagggaagcagaaggtgtgattgtaggccactgggctcctcccatccacacccatggcctcatccgtgagtacattgtaagtaccttccatgagttggctgtatgtgtgttgggggtgctaggagatttctgggtattctgtatgacgagggggttgatttggtttagctttgtaggtgatgacccatccgtcagaacattttgctcctcaccatcttttctctcctccagcctccttgcaagatattaggatgccctggacctttggttccctttactcacattttttttcttctccctttaggtagaatacagcaggagtggttccaagatgtgggcctcccagagggctgctagtaactttacagaaatcaagaacttattggtcaacactctatacaccgtcagagtgagtgtcgtcatccattccagccatccatgcagtcttagaactgagcgaaattgctgctgttttgtgagaactctctactcacctttgtgagatgcatattagtaatctgcaaaatacccaacttcttgccctgggacgggggagctcagagtttctttcagtctcttaaatggacaccacaaagagcttgacatcagagtttctgtagataaccgggcgtttatgggaatgccgctttccctgcttttaactccggtattctgctagctttccagctcctatacttttgcagtcagctctttcctgcttatctttagctgcaggatgatgcagagctatgataagtagtctttctaaactgattttatgaggttcttatgaaatatatttttagtatttttagcagaaagagatagattttgtgaacaacatgtttgctgagaccattaagtgtacacattcatgactctcacactgataattttgtcagtaccctttttgtatatgtgtgtatttatgaacacacccccccatacacctgccctttagaagaaccttgatatttgtggatcaatagaaattttctgatctcaggactgtcataatgccctttacccaagctccttcccttggcttttttgccctcttatttcagatgctggggcctctgaatattctggatcactctgtataaaatttttccagcctcactgccaaaatctcacccctttagctcattcagtattcttactgtatggtgtatggtgtattgcctttatttcatattaattcaccctctgatttgaaaaggtggctgcggtgactagtcgtggaataggaaactggagcgattctaaatccattaccaccataaaaggaaaaggtaaatgatcccagcatttgcagatttagagaaaatattatacaaaccctttcaaatgactttcagtatgaccggaaaatggagaaacgtagtttagaaaaacatcacacaactttcttctccccaacacacgcacatttttgggtgtctctgtagtgctttagatagagtctttttggggtgactgagtgtctttttcctcctagtattgagcatttcttctaatgcagacatacaaagggatttccaaaggccatcatgcgcagccctttgtgagtagtcaaaatatctaaaatagaaggagtccttccttctcaccaaagctgaagatgattttgtgcatgttcacttacggggttttaaagaaagcaccatgctgactcttgttattctcccagtggcactggcaaactgtgtgtaggtggttttttatcttgtactagagctgatattagtaataactgatggcttgccaagggcaggacactctagagtgttcactgctttgcgtacatcagctcatctaattgaacagtcagaacaactacaagaaaggataaggaactggaatgaggttatgtcacttgtcccaggccacacaatcagtaagtgacagagctggccctggaacctgatctgcctgactccaaagcctgtgctcttaaccactgtgctccacgcttctctctgggctgagacacatgcggcctactggaccgccctgcttgccgggggtggcgggctcagcatcttgcacgagtgcctcatgagggcagagatctggtctgtttttctctactctatcacgggcatctagtagagactaaggaaataattgatgattgagtgaatcgaagcagttaaatgaagggttctggcatactttgggagatggactacaactcattttccagagtggttttcctgaccttagccttgacactggggacttgcatttctggacttccaggtattaaaaccagatggacactgtggcatgcaataggactggaagattttactttaacctaagcctgtgaggaataggctctgggtcatggagagtcactatctagtcccctctaaaatctggagcctttgagatcagggcccaaggcggccaaacgtagtgccaccagatggtctttggagctgaatgcttgcaggtattagagaaagcctgctgaattcacactctcctagaatttttattgttgtatctcttctctctacaaagtctgtttcaaaacactgaccacacataccaagaagggatgttggaagagcaaccaaatacatgtaccttgaattccgaaggcacaagtcacaactgcatttgaaaatctcagtggatggttggttctctttaacttcttttctgtgattttgatgaatctcagctgcttgcatatatttgggctaggatttgtacagaaggcagctgtgtgccacatccaaaaagtgtttgttgtaaaatatctgtgacatagtatcataataacgttttaagataaaggacaaagacagcagaggcatcagccagacgcgccaggttaattggtgaatgtagtggattagtaatgacaatgagaaaagccaccattccctgagcacttcttatacactaagcaccatgctattgttgctcgtgaatggatcccttattaatccttatgaatcctatgagataagtatccttatcctcattgtgtagctgaggaaacgggtttggagtggattgtgacttgtccctggttgccatgattataattcaagtcagctttaccatatgcagcactcgcactgttttgctctgtgttggccgcctgaagcttccaatatcctttcttcttccggttattgcattttcctgaagcctagttttattacatgattgatcatctggacagacctcttcagactttgacacatctcttttgccaccaaatcttatctgctcctttgagtctctcttgcccagtctatagaaggggcatatgtgtggagagtctaatatgcaagttgttgtttaaataatattttctgataatattgatccattgagctcttttagatcatgctgggccaagcactgtcagccatctggtgggaagaccttccagatgacaagcatggcgctcattggttgaactgagaggggtcttttccttggccacttctccttgccccctcgactcttagcttgagctccagtctttttgagagcaccagtggtttctagttgtttagttggccatatgtgacgctatattggaaaggaagagaaagagagtatcagttgagtgctaggcatcacacatacattattttagttaaccttcccagctctgtgaaatgcagataacatctctaggctccaggaagatcagtaacttgcctaggttacacagatgccagaacaggaattcgaactcaagtttgccagcttccagaggccacattctttccattttgccacacgcacgtttaccatttacgatttactccattgtcagccttccgaaaggacttgagattggtgggactttgttagtgccaatcaagatgccactcgcagtgaatgatccctgttcctttaagaaccaggctgaagctgggctgttttgggacctttacaaaatggaacttttctgcctgacctaattgccaggatagccgactgagccaagatagttttgtgttcaccaagcaactgtggaccaaccttagcttcaggaaaacagtggtaaaaaaagatcgatgaggaacactgccaaagaaataccctttcttccccgactgaaagatggctttgtccgttgagttgaaaactattaagtcctgccttcctcacttttcatcacgtggcttctgtttttgaattcctttttgttttcagtgatcccaccaccagatatccacattgacagctatggtgaaaattatctaagcttcaccctgaccatggagagtgatatcaaggtaatgtgggaatttcaagccagcagctggatggggctttattttgtatgggaactgaaaggacatagcacagtaagactggaaaaaaacaaaaaacaaaaaacaaaaaaaacgaacggctagatctagtgaagctaaaataccaggactagggtggttccttcccccatgaagaacaacttgagtcttcacatgtaattattctgcctcagcctggtgcctttttatccttaaccatataattaaatggttcacagctacagtgcaaataaagagttggtgttaacagaatatgtatgccctgtaattttcagctttattggatttcctggtgctaagcgctaatgctgaggcgctcacagtggaagaacaaccttcttgtgggagagttggataccttggaaacatattcactttccatccacctaagatcttcctcttccagcaccgccatcccctctactggccctctgcatagccgacttcatcattgttacctgtgcccatgtggttcctcaagctgagatccgctttccatagtgttccttcttatctgtccctcctcacagcctctccattgatgaatttgtgttgggacaagttgggacaagcaaccttcagagtctttctgccatttacttaactgccatttagtgtcatgaccttggcttcagaatgggttgatataagaaatggcctcggccgggcatggtggctcacgcctgtaatcccagcactttgggaggctgagatgggtggatcacctgaggtcgggagttcgagaccagcctggccaacatggtgaaaccccgtctctactaaaaatacaaaaattagccaggtgtggtggtgcatgcctgtaatcccagctacttggaggctggggcaggagaatcgcttgaacctgggacgcagaggctacagtgagtcaagatcatgccactgcagtccagcctgggcaacagagtgagactctgtctcaaaaaaaagaaaaaaagaaaagaaagaaaaaagaagtgggcttatatgcttcttgtcttgtagtctttgatcttgaaaatatttttgttagttgtcccatatttaacgatcttcagatcaaatctttttatgagctcaggacttggaaaaggtagtctttcctgatgggtggatgtattttctgtagttagacaatgagatctaaccagcctgttttgtatggattgtcttcttggccttgactgcaaggatttatccttaatttccatggcctaattatctttccagtgtttcctctttctacctttattaattggttctcgtccttttattcttcattcacttttttgtttcattgaatctataaattaaatatggtctcgtttgtttttagaagtaggtggagtacaactaaatattagctaatggtagcacaagtagaacctgtttaaaatttttaaaaaacaacctgttcactgtaagaatgagatacccaaggaaagaacaggaaagaggtgtatttttaatcctgccttttgtatttagtgtgccccatgactagctgttcatctaacatgcttcttggttctcggcaggtgaatggctatgtggtgaaccttttctgggcatttgacacccacaagcaagagaggagaactttgaacttccgaggaagcatattgtcacacaaaggtaacactttggtgctggtcagtgtgtgtgcaggaaggggtaaggctggaccaatgctttcccgctgtagagcttgactgggggtgccagggaaggggaggtattctctggaagctgttctgtgttgacaggttcttgtgcattgaggatcctataagtgtgctgctgattctaggcagagggattcactcagtggcccctcgagccctcctccaacctcatgacccttagtggaagttgggggccataaggaggaaaattggacagaggcaagactaattctctgcagatgagttttgatttccaaaagaaagagttcttagatatagacagttacctgtctgtcctttctagtctggttcactctcccgttgctaatgagagacagcagaaggccttatgcataactggtgttcagtaaatacatgttgactggagaaatggacaacaaactaagggaggagtggtccagtccctgttacgtatgtaccagcagcaagtctcagctaaaattcctctatctaagcacgtgctaaaggatggattttaatttatttctaagtggcgaaagctgcctgtaactgttgagaatgacttgggagcttcttcctgtctcctccttctaggctgtgaagcactttcagtcatgtttttattgagtccttgtcatagccttataaagtagagactacaaatgttctattgttactttttttttttaactgaaagtctacaaggtgcccgaggaggctgttattttgacttttgcacattgagcacctaccatgtacaggcatttacacaggcattctacgcatattatttacataaccccaagtataattccgtgagatatgcccgctttacagaggcaaaactgaagttgaaagaataagtcatacgctcagacggtggcagagccaggattggaacccacatctttctaactccacagcctatgatctcattgccttagtgttgccccagtagaaactggcagagtcaggagcagaagccttaactagctgttgtttgaaatctattagggctagtgcgatgctaggcattatgccaagcacttcctaagcattttctttttttctccctgccagccagcagctgctgtaagtgctgttatttttttctccatcttacaaacaaggaaatagagagtttaaatactttacccaaggttatacaaccacaaagtatagagtcaggccttaaaccccagtccttctgattccaaaggctatcttgttagcgtaacctcccccttctcacttttctttttcttagttttaatagcatttcctctgatcagaaaggggatacatatttgtttcagaaaattgagagaacaaaaagagtgtaatgaaaattaaaattgcctataatttcacttttacatttcagatatcttctaatatatttttccatggattgatctctttatatcttttttctaaaatcagaataatgccataggtagtattgtatcctgcccttttcacttcacataaaattgtgagaattttccagtgtcatcaaatatttttgaaacaacctttagtgcctgcacagtagttgatggaatgcacattatttaattattatcctgttactagacaatcaaattacattcagttttttcctgctgtaacactgtgatggggatccttgttaaacacacttttgagtctttctctgacttcatgggataactggattgaagggtatgatttccaaggttcttgttatacaaggccaaatggcttccaggagcgttgtaccaactcctatccgcggatgggcagctttaaagaaattacccagtgcttgtgcagtgtgttacgtaccgtcatcatcagtacataaacgttgaatgaatttgtcatctaatgacagtcctacagcacatgggactcatttaagtcaagagattactatttttttttaaaaaagtgcatgtaccaagacacgttcttgactaacacccccaacttcctcctggaatctccttttcctgttttcacagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtgagtcagccagaatgaccatcacaaagtgagtgtggactgtcccctaatgctacgccaccacacaactccagggcttttctctcttttgcaaatgttccggtgcccctgctgctcttggatataggcctttctttttcctttgttttcatacgtgcattatgattcactatgatcagatctgtgctcctttttgagtctactgttttactttccactcctccccagtgtgtcccctttgcttttagatcaaccgtcccaaggctcttggcacattcgtccccctcttgcctctgtacttggcttatgccctttctcctccttggtgtccttccctcctcttgctatgcaagaaaatcctcccttctatagttgatctctctccctatgaactcctaatatatttatagttggttccatatagcatgatatttcattgaatacagctttaccctatttgataatttttgtctgttactcttaccttcctaactagtttgtaagttccttgaagggaaggattgttttctggattttctcaatggaaaagcatacagaagtaaatttataataaggaattagtaaatccttagtgatgagcggaggaactagcctaggtctggtcttctgaggatatcttcagcgtgcatttgtcacagggctgagtcatagggaaataaccaaagtttgcaagtagctgtctgtaaaatcagtgaagaagaaggaagaagtaagatttactgagcagccagtaagtgccaggaacaatataaaatccgataaacccatgttcccccttattcctttcattggttctgtgggtaaatattcccattttgccagcaaggaaactaaggctcagtgaggcgaagtaacttgccagagttaaagctctcacaagcagtagactgagtttcagctcaggtctggctaatttaacagcctctgctcttttgtgtgtcccagcacctgacgctgaggcagggacagtgatgagaagccctgacctatccccggagctctcttttacctggaagttgagtctactcgtaaagaaccctttctttccatttatatacctggcagcacatgaccgcctcatcacccccaactatctctccagagtagggcaattgcacagaacactgaagcctgacttgatttagggtctccaattgtgcatgaagttggaggaggcttcctgcacctcatctcagctcatgcactggtcacactaaaggtggctttcagaggtgagagcgcaaatgagatcacctgtaggaagctctctgcttctgcccctctttagttcattgaggaccctggcagctctcatgattttcctgtctactgtgagaagtgccattgtcactgtgcatgtggggaacctctcatcccttggctcccgtggctctgtggacccctttcctctccagagacaccccatccctggcggtcaccagccttgtcctcggtgatgtcatcctccctctgtactctaagccccgacttggcctactcccatctcatgctttgcagctccacctgcatttgctttgggacccctttgagtccctcagcgcttctctttcctacatcctcccaggcgatcacccccttcggggcttcccttcctgtttctctgtctgtgttctcccatctgtctgtcctttctcatctgtcaacaaaaagagtcaaactctgtaaaatatatgaaaagatttattctgagccaaataggagtgaccatggcccgtgacacagccctcaggaggtcctgagaacatgtgcccaaggtggccgggatgcagcttggttttatacattttagggaggcatgagacatccatcaaatacatttaggaaatacactggtttggtccagaaaggcaggacaactcaaagtgggcatggggaagcaggggtttccaggctatagggaaatttaaacattttctggttgtcaattggttgagtttgtctaaagacctgagattgacggaaaggagatgttcaggttaagataaaagattgtggagaccaaggttcttttgacgtcttttagtggctgcctttaggggaaatagatgacagatgtttcctatccagatctttaaaaggtgcaagacttttagctaatgtctttaggattgggagggcctggaagaaaaagatctagctatgttaatagagattctttacagatgcgaaggttcccccacaaaggacagcttttcagggccatttcaagatatgacaaagaaacatgttttggggtaaaatattttgattttcttccttgtctcataatgttatgccagagtcaacttggaaagtaagtcacgatatataggattaaataaaacccatctgatgagaatttatggtttgtaggacatgactccccagaccccttagatagggatttgggcaagatttaaaaaatcagagcttagtcctcacagctgctgagcagtgctggagaaagtcaccctgttgcctgggacttggaaatccctttgtggatccccgctcagttcctgctcatcccatggatcctgcagctcctacagtcctcgtcaagcccatgtcttacatgtgcacataactcttggagaaaatgctctttgattgtgccttacaaagaaagcttcctcagctcccaccctccagttataaactccctcggcttccactttctgctgtaaacttcatcccattcccacttccctgcttgaaactccctcagtttccaacgtttaccagttaggactaagcagggatgcatagagcagaggaagtgacagtaacagtggcttcgaacagtttatttcctcttgtaattaaaacaagtttagagttgagcagtgcagggcttctgtcgtggcagcacgatttgattgggcacctgagccctgtcatctccagcctgtggcatgtgtcttcaagctcacctcatggtacaagaggcctcctgggcctgcagtcatgatctgtattccaggcgaccagagggcaggaagaagggctcctccctctgttgtaatgagccctcctaaagcttttcctgcgacacttctgcatctcaatggctggaagctctttgtctagcctcttctagcttagggaggttcgcagtttagactttttccaggcagcaattctcaatcagaaccagagttctgaggaagaaagggaggatgggtacctgttggacagccagccgtgtctgctctccttccctccctccacatacttcctggggtgttcgcatccactgtgcaagctcccatggctttccttcccactcagcacatccccttggagcccacgtctgtgctgccaatggtagaatgacaccccctctttaataaccccccgttccctggctcatcatgtgggtttctggtgtagcatctaacactctatgtttgccacttgttatttataattatgtatgtttttcttctctgcccgcctctcctccagaaggagcgctttgaggacagagaccacatcatatttatttttgtagctctacatacagtgcctggcccaagtgccttctctgtaaatgctgtaaatgtaataaatgttgaatgaagacttctctgtgagctcttttgaagcagttccagggtcttaaattggagatttcaaggaaatgagatcatcggcccatgagctgatgtcctcttccattctctgcttttaccaggtttatggtattttctatgccacgtcctttcttgacctctatcgcaacccgaagagcttgactacttcactccacaacaagacggtcattgtcagtaaggatgagcagtatttgtttctggtaagtttcccataccgtttcagttttttaagggatgtcttaagtcctgggctctggtctcaacccaggacctggggagcttgcatacctggactccaggattgatgtgtgtgacgagaggcaacttcctcttcttcataagcatcatcaggttcttgcttgaaatacagaatgaacggccactttcaccaactgcagctccgttatggaggactgataacttggcagatgatcacaagtatagataaatcaaaaatttttatcaggttccacttctaggaatttagcctacatacttttatgtgtgtgccaagatatatggagaaagatacatggtacgttattattcttatgatagcaaaagatgtgaagcaacttaaatgtctatgaagagaggactggttaaacatatcatggtttattcatgcaatggaatgcaggacagccgttcataagaagtatgacaactctaaatgtactgatatggaaaaatctctacgctatattattatataaaagaagccaagagcataatatgtgtgccattttctcagttgtataaaaaatatttgaggaagataggcttcatatacacgtgcatatatgtgtaaggatacacgtacatacatatccttccttatatatgcataggggatttctggaaggaagcacaaaaactcttaccagtggtacctcttggaaaatgatttggggtaggtgggaaattattttatattttatggttttttgtactaactgaattttaattgttgtcattattttgttgaaaaaatactttaataaagattgcataaggccatgatgtattttttttcctacgtgtgtgcttgggcttcaggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttggtgagtgggttgggcttccaggcctctttgtttattcctggcctggttagggtggggtgggatggaaggggatcctctaatggggcaagaaacacaggcctggtttctggcgctcagcaggaggtctctctcccatttcagtctgaccaaagatggggtccgtacagggacctcttcttagttggcacttctccattattcctagctaccattttggtttgtccctctttctcctccgctgctgatatttccttccctgaccctctcacacagggattagcaaacaaaggcctgcaggccaaacacagcccattgcctatttttttaaaataaagttttattggaaccaagtcatgcctatttgtttatatattatatctgaccactttcatgcaatgatcagcagagttgttgtggtggagactatctggccctcaacacctacagtattactgtgtgtggacccttacaaaaagtttctgacccctctttaaaaggagcattgatcctaaacaaaacaaaaaaactgccattttttccttgctctgggttgctcttccctctctcctctctccactccccttcatccagcggtggttggtttaaaatgcttggttgctaatactcctctcaactctccacttccttgtcatgattgaatttcctgtgcttactatatgccctgttattttccccttgcccccctatacccagaagcagcctgggagaaagtaagtagagccttgccctttagagccaggattgaacactttggttcattctctctccaccaacaacatccatgaactattgcagtggtggagatgtggaagttgagtactgagtttggatgtgcttgcttgttccaacctacctgctgatgtcacgataaatgtggccctccctagagggttaaaaaaattttagttgataactctatgtgcaattctatgagtgaatagttattttaagattggatctggtcactccaaaggccttccaaagaatggagtcagatttcgggactcaaactcttgttgctgtgggtcccagctattaatatactacattgtccaccattgaactacaaagagtgaaaaatgtcaactttctgattatcattcacttgttcttttttggtcctagttgtatgcaattgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacaggtaagcaggagagaggttagaggtcttctcacacagcctgccctcagtgctgtgccgctagacctccagagacagacttttcattaggcgtttgtttcacagggagtgcaaacgctgcccttcaatattcctacaggggcagagtagtgcagaggctccagggtctgagccgtggcgtggtggccagggcacagtgggctggggagtggctatcgttttctttattttctaagtctttttaactcccctcgctggttttgatattactaaaggaaaagaggagggatgcccaagagaggaaataaaactgaatagttgccactaagaccaagtgctgtatctgagaatctggatgacaggttctcagtggtccattgtggcaatctgacatgttgaaatggagggagacccacagctgggcagtagatcaaagggcagtcaggctcaagttcagagagctggtagtaagctccgttgctcagacagcagcaggtattattgggagttttgatattgggtaatggaggcccagccccatttatgctggtggcgtgcagtgggcctgggccatgtgccattgtcactccagtgtcctgtcttcagatggaactccttatcccatcccattccttcctcaccacccttctacccaaccccatttgtttttgtacacacttggttacaagggctattaagtactgtccaaatttcttggctaaagatgttataacaacaataaaagagatgccaataaagaatatctaccatgtgctaggttctgtactcagcaatctatgtgttttattttttctgtaacccagccctccaaggctagcattatttaatctctctttgatagacaagaaaatagagtttcaaatgtatatccactaaccgcatcccatctcatctttaattttcagtttcattatcagcacctgatgccttaaaaatcataacagaaaatgatcatgttcttctgttttggaaaagcctggctttaaaggaaaagcattttaatgaaagcagggtaagttcctccctcattctcaaggactttggaaatttaattgaaatgctgtttcagagatgagcttgttgacagcatgctggcatagatagtgtaaaaaaaaaagaaagaaaaagaataggacatggacatgaacttgagaattaaaggaccattttcagtgggattgctaattagcgaaatgcttatactgcccgttaaagatgagaatctctgcactaagcacttttcaatcctgacttgtcttcccctgaagaaagacaaatgggctggaggccatgctgtgcttcccgcagaagctgcagctgggctggggctcagggtgttaaaccaggagcctattccacactcgctgagggtgggactgtggcttcagtaccaggagttgagctgcactctcagcctggcatctcagcactctcttcccagataaattacagggagcaggaggcacttgaagatactgtgctaacttatgaagaacaccttgattttgtttggttttgctattggtaggccaatatggtattcacagcaaaagacaggggaagaggagtgagacctgggagtagatttaccacccaagggtggacagattcttgagtaaagctgggttggccccagagacagcaaagcctttgctaaataggaatgtgatgaatcaactatggctacctggagatgcagcataggcaaagagccatgggttctaaatagtcaccgtgcaataccaaagcaaagtgaaattaaaattggaaaattctcaccacacactctgtgagaattctcataactcttgtaactatgacatctaaatggctaatatccttaaatagaaggaaagctttcaagtaagttcaaaatggaaatattctaattttgaagaagggacatgtaacaaagcggaaaattccagcagcagtaagcaaaaggagaaaagttcaacctcaccggtaatctaaataacaaagaggtaaccctctcatgttaaattggtaaagatttgcagggaagagtataactggtatgaatagtagttggggaagtaaacgttctgggaatatgaattggttcaaactcaagtaaggttcttgggtaatacctatcaaaaacgttgaaagtgttcacacccattgatccagcagttgtaggattttactctaaagcagcaacgtgcatgaagaatttgtgtgtagtatttatgacagcaagaaagaggaaacagccgagatgccgaacagaagaggatgggttaaataacgtatgggtggttgatgttgtgtaatctcaattattttctttataacctttgtgtattttacaaatgatcgacaccagatatctattaggtggaaggtaataactgctggcttataggaaagaatgcggggatgagattccaggcaggtattgggaatcccagttcggcagccagtcgccattaggggatccttcctgggtggctggagcccggctcttaggttaagattctaggttagtatttcgttcctagtggagggtctggcataggcatagcatgtccttcttcccttcccctgacaaggagttcaaagaattgtattagtccgtttccacagtgccaataaagacatacccaagcctgggtaatttataaaggaaggaggtttaattgactcacagttccacatggctgcggaggcctctccatcatggtggaaggcaaagaggagcaaagccacatcttacatggcggcagacaaagagagaatgagagccaagtgaaaggggaaacttcttataaaaccatcagatcttgtgagactattcactaccatgagaacagtataggggaagccgcacccatgatccagtgatctctcaccgggtccctcccacagcacaggagaattataggagctagaattcaagatgagatttgggtggggacacagccaaaccacatcaagaatagatgggtcagtggtattgggatcaagagactgtgattatgcaagggggcccaatatgtggctagagaaaagtgatggagtcttttcagggggatggtggagagtgtcagtagctttgacactggaatagttggggatcagcagagaagtcaggttgtcagccctcatcccagctagtatcctgggccagggctgtccccaggatggctttttccagcaccagagtccagggctgtaactaggaagacatttcatcctctcctccagtgaacaggggcctgagctggcttcagtgcttctgatttcaaggccaggttgttggggggctgagatcggctcagaaggagctagagagcagggagacaggaagtgagccgacaaggtcattcctacatattgttctggggacaaatgtcttgtcttttctaattgcaagttctcctttctcaccccattgctggagtccactgcgacctggatttattattagtcaaattccattatggcaaactgttcagattcttggtggcatttaatattgcttgagacaggcagactgctgagcaaatctctgagtgtggctttggtaaaatgactttcctgagggccacagttttcatttccacaatatagcttgttgtgggggggtggtgtggcagttatttgagatattggagatgagaaaaattttcattttctgaatccagtatctcagtggtaatgtaaaaagaacaaggagaaacccagggcgctttcgcgtctgtagcagcccacagtgaggagctcacataaagatggaaccagtaatagaggctgtcagtttccatattcgacttcctgagcaatctcttgtgtttgttttcagggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgagttgcgattgctgcccgtttctgtcttcagttctagggaaatagcaagaatgtcatatggtttcatgaccatgtgtctttctaaaacacatggaagatattctcagcttaaaagaaaatcatttatatatcagtttggtcaggtagtgatgtatttaacaaatacttcctgagctgaacatggtacaggaagctgagattacagggggaccggattctgaacataaagtgcaagaaaggcaaggctttgtttaaaaagggaaactctaggttcacaagagtttcatttgttttttgtgggacttctcagcacctctaacatgctaatatatcctgtggatctccaagccagtagatcatctccttgtcatggattttacatgtaaaatcatataactgattttacagtgcacacctctgccccgccccggcttcatcttagctctcagcataagcttaggactggaatttgtcctgggatctctgtcttatgtcttatgctgggccatgctagtgatggaagagaggacccttccgttcatacagaaagtctgcttacattatagtagtttggccaggatttcaacaaatgttttgccactggtcttttttagttccatttactctcagccaagaactaaccagtgctcaagccaaaatcttgtgttagagttgttaaatgttccgtctcatagtgtttctcagggtgagatcttgtgcaatatttatccttggcaccccccactaagagagggaaacactgcctgccacttcccttgggagaatcttaacatattagaggttctaagaaggtcctacaaaaaccagcccaactcttgttgacctagtatttcctcaacagagccccatttttaggcaaaactaattggcaacctgtgaaatatgctttgggaaaaattcctgtgcagacccctcccggccacctttatggaaccaaggttgtcaggcagaagggctcttggccaacatcttgccccttcacgttcaccttccccttggaagtggggtgggggagggagggcactccttcctggagctcccagccttcattgtgccgacttcctcttcactgctccagccgcacacacccccttcattaaccactgcacagttggaataggttggaacatattaaataagatgttgctagagtttttttttttttctggcaaggaaataatgaaagaaatgtaaatacagacacgaatattgaattgttagattaggtttgcaagaaacaattgttctctggcccatcttgatgaataccctgtcagggtgaatgcctggggagtgacagagctttctagtgaagcagagacctggcctgcgccacctctcccgacaccagggagcaaccctgagcctgttgaggctcctcatggagacctagactgagggaagtccagtctgtttcctttgccaaaaactgattcctaggtttcattttcaagttcagacttaccctgggatttttaacatgaaaagtctaccgttttcaaggagactggcccctaccccagcaggatgggacgtggggcatggctttgccctagagccctggtggtacaaatctattagtgaatcatcacagagcctgtttgtttaagtcaataggaaggggccatgtttgttaggttataaatgccgaaacggctttgcaaataactttaaaaaatgttaaatgtatatggaaagttgtttttctccctcactctctttttcacttaagtgaaaaacctcataaaacttcatgagctgttaagtctgtattgtggtgtaggaatctcgtttgtatcacttaatggagcttcaggtaattgcagttcagagtgactttggtgccaagtagggggaaataattgcaatctcgttaattagtggtctgatttcacatcctcttatgtaaggcaagcaagtggtcttaagtaataatgctaatgaaatcaatgttgataccccaacaaaggtctcccttccaagagattatctaaataaccaacaaggcagtgattaggagtctaatgtaattaccatatttgcatgcacaaggcccttggtctatcagctcatggcaagtagtggggaagcaatcaggcatcacgcacatgcagaaacgtctcacaccagacaggcagtttgtgtagctgtggctatcgcccagctttttttggtgggtggggccttgaggagtcatctggtctgttctcctgccctcaggtgggcttattggtgggaactttgccttggcaggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggtaagtggggcagggagagtcggttcttcctcccagggctgacccccacgcagccaatgacttgattaggaaacacccaccttcagctcctcttttgaccctggaggagctcttcatcagccagcgatttgattccatgagttttggttaaaccattcagagccctcactttttaacttttaagttaaattaaaatgttgtattctctttgattgtgtagttctggcctgaaacagggagcttgccccaggccttgagactcccaaagtatcggaaaatcctcaagaatatctgacccctgtctcatccttcactgagctggaggtctgacatctctggagatcctaactcaagataaaaaataatgctttcccaatcagcttctatcaaaggagaccctttccatcttgctgtttctctttctggttgctagtgtaacctcaccagccattcttttatgtaccttaacacagtggtccccaaccttttttgcaccagggaccagttttgtggaagataattcttttttcactggaccagcggtggagggggaagggttgggggatgatttcaggatgagactgttccacctcagatcagcaggcattagattctcatagggagcgctcagtctggatcccttgcacgctcagttcacgatagggtttgtgctcctgtgagaatctaatgctgccctgatctgacaggaggcgaggctcaggctgtaatgctctgactcaccactcacagcctgctgtgcggccccccattcctaacaggccatgtactggtactgatggccctcggcccgggcattggggatccctgtcttaacacatagcaagggaaaaagtaagaagtttcccgttttgaaatctttgcacaatgaaaaccctaaatgctaatagagatagtaagatagtaatataataaagtgggtgtgttacgaggcttccccaaacttagactaatcactgtgaatgtacaagtttatttctttccgttaactagttacaattatatatctatgtttataaagacatttgtatattccccttcactgatcatatgatgttagctctgttccctttccttgtcagtttcctttcttgcctaataagccggcacctggactgccttgtgtgaatggggcggcttctttgcttctgccgttggaggcaacaggagtggacccatcagcataccctgcgatagtcactgagtgtcggtccacacttggtgacacaggattataccgggcgtcacaaggggacagctgttagtctgggaagctgtcctcaaaatgcttaaactcctcccagatccttttcctcagagcactttgggttcagaagagaaagcagacactgaagttcactgtgctagtgtagggtatagataactcaaactggggaacccaaactacccacttagcttttgagtaggtaataagagtcttctcctgagaagctttgttttcctaatttggctacgttcaaacgaccactaaaataaatgtgaggatccatcgatgggtagaaggtggccaggagggacagtgggaagctgggctaggtttcacagctgattatggtggctgcctggctatggcattgaccttctcagctagagggttgtggtagggttgaggggtgggtagagtggtgggatatggggtcaggtgaaaatgtgttggaactcaccaaggcctgactgttttgtctctaggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaacaaaaaaaaaaaaaaggaaagaaaggaatgaataaactttgtagtaatcaactgtgaacttcaaaccaggttgattttagtaacccaattgctttgatttgacattaatgtagtcttacagggctgtgcttgctgggcatgcttttacgtctgtgagataatttcggttcagtaaattggccaatctttttatttttctaagacacagaaatgtatttaataaaaacctcgagagagtgatgggtggaaccccttctccttgaaagtgtgtacagatattccattttgtttggatatagtttataggaaagtgtgtggatgtattatggcggaaggtttctttatgttattttgttaatttattgggactctgtgtaaggccaggctttagtggtcattagacaccacatgtgttatgagccccttacccatagggttgggggtgggaagagaagcatatttttttgccattccggaagcaatccatttttattcacttgtgtgtcatgtaatggtctttggcaggagagagcactgagtcattgctggagttcagttcaacagagctgcagcttgggaagccctgtaagcccacagcttcctctcttatattaattgatggaattttactgtatgtgcctctgtacaagatgtagctttgagagctacaaaatgataacactgctttattacacactggtttcattgtcattgcaaaaacttaccctggttgtgggggagagttctagatctgtgccatgatccatacactggctaatagagtacataatttttccattttccattttttgtttttacttactactgaaggatctcagatgtaaaattatgtatttggtttgagatggccacttattgtccttaaaaatccatactgatatatgcagtcattttgaattggacagtgccttctctttttttttctcctcttcttccatctccctcacccatgcccccacccaatctaaagagacagtgctgtacattctcatagagatagagaagatctaaaaagttgagactactcaatccagttaacaacagcaggagcactagagtttgttcatttattctctctgtaaaacaagctgtgctttttttcttctgcctttaaaatgccacccgtgtattcaaaccatggccacttgatacttatgtagaatccatcgtgggctgatgcaagccctttatttaggcttagtgttgtgggcaccaatgtcgagcatcgttgtgacttgtgctgtatgattctcactgaagaatttcctttcagccaagaagcagtgaggtctgggaatattccaaagtcatgtctctgaatatgtgtccttgacgtgcaagctttgtaaaaccccatccccgcttaggtgcgaggcatcaccttctcacaagtgtttagtttcttttaaccacaagtatcattcttgggtgataatatagtttcattctacttagggattgtttagaaaacaaagaaagagccaattaaattttttagtttttgaaatttttatttatatgtatacttagatgagtattttaagctgtcgacctttagtttgccatacgggtaggactgtatttcatgttaacaactggtggtaatgataagccttcttctagcgtattttctcttctttcctgtcactttcctaagtttttttttttaaagactggaattttttttggctttatcttgtcttaccgtagagatttgttcaaaactctaagccctaccacctcccctttaataagctctttaaatagttgaatcattaacaacctggtgggaggcaagtcatttaattgaaccactaggaagtgtattttcttttctttttctgccaactttttggtggcatttgtaaaagctgatataaaaggctctgagatgttattttcagttattccataggcaagcctttttacagagcatatgtctccagttggcagcttgagatatttccgagcatccggttctagctaccagtgcctcccaatgcttagtgcacagtactgtagactggccatcacccctctccttggaaaatgccactgtgctgtttgaaaaaaagcagccttttagggctagagtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaggtgaccacataactgtcttcactgtgaccaatcggagtccctgcttgcttgtgaagaaggggcttttgtaccttgttggagatgccacctcagaagttcacactgtgcaggaaaaaggttttattctctcctggcatacattagaatgtcagatgcttgcatccatgtggaccacgatgggcctctaaaaattggtgggcagggggtttgcttatgagttttctctggaaaccgattttactcctggatgtattgaatgccccttgagctttatgagatacgagtccacatggataaaatgttagagagtggagttctacagaggattccaggaagaggccatgtctgtgcagtcctagttccagacaggtgagaagctccaggaactactggctaccttgacaagctgggtaaatagttatcattctgggtaactggttgaaactctgacttttggacaagtaattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgtgtaataaaagccagtgcattaagtttatatagactactttctatgcaagactgagatatggaatagataggaagagatatgtactgctgggtacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcaaaataaaggcctattctactcttatttaaagtgaaacactgtatacttgtttctctccaaagcgaaattaagtatttataatttcaattgcctcgataagtttccaagtcactgaaatctgctgaaggttttactgtattgttgcacaactttaagataatttttgtctcaatgtcaacttttttcactgaataaaaatttaactgggtcaagaaaacacctctttgaaaatccactgtctctgtgtgtctcgagctgttctttagagcgcaataaagatggctgacgcagtctccaaaccccatttgattggtctgttttaaacggatgtttatttcatagatgagagaacaccaaggcctggaataattttgttattaacaagctggtctcagatggtggatccttgaagaacacgatgtctttgtgttggttgaggagggggaagatgtgctggctgttttgaagtaaacagaattattccgtagggacaatgactaaagtggctcccttaaatttgtaactacatttgctaagagacagtttgctaagaaggcaattttcaaatctaagagacggaagcacagcagtatagatgagctgtgtgtctaagagcacttctatgggtttccatagacagtcttgtgaggagtgctgcgtgtacctattatgggcagctgaatggccatgggcctgtaagtcaggattggaggctgtggaactgggtgggggagggaggcaggtttttaagaatttaacaggtcttctggtatgctgctttt

SEQ ID NO: 14185 - DNA, 43366 bp, Human
  misc_feature (1)...(43366): n = A,T,C or G
ttttatcctataaaaatgttgtcattgtggaacttgtagaattaagttacagatactcatgccctagtttagaaagattacatgtaagtgcattctgcttttctctgtgtttatgctgtagaatctctcataagcaaaatttcaagaaatacgtactatcaactcatagcttagccctgaggcttccagtacttaagaaacctccttccttgctccttaggatcgcagagttctcagggccctctggtaatattctttttttttttttttttttgcatttaatttttatttttattatttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacgtatgagtgagaatatgtggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatagctgggtcaaatggtatttctagttctagatccctgaggaatcgccacactgacttccacaaaggaaacaacaggtgctggagaggatgtggagaaataggaacacttttacactgttggtgggactggtaatattcttaagtatctatggctaccacaaattgagagtttgcttacttcaaatgccagcaaaggtgttgctttttcattttcagcccctcacgtggtgcccatccctgagagttcctttgccccaatccagacttacaagaccccatcttatccctcaatttctggttccatttagcagtagcaagatcttaaaactagtatctactggaatatgtcagttctgtaatgctgactgaagcttgagtaaaccaggtgcttgtaaagtggcatgaaatatccagaaataaactttactttctacgggcattaaatttacttccaccttttagaaagagacttcaatttaccttattaaataactgaccaatctgtattcaccactaaaacattctaagtagcatattgaaataagctaatctttacagtagtataactgattttatctgtgatgaaaatcccaaatatttattgtcacgatttttgttttttaatgtgtttttctacctatgtgttagcttctttaattcgaatgttattctctatgaattaaaaatattttaatagcattctcttaggatcttgcgtttatggttcctttttctttgcagccaaagattttctatctcccacattcgagactgagaaacaccttctatctgccctataaaatcttataatcagcaacgttatgtaccctttgatatcatgcttcgagaagggcatatcacctctgtggtatccttcgcaatcattcatgacctcaatctaatcatgagaaaacatcaggcaaaccgaacgggaaaaatgttctgtacaatagccgaccagtcctcttggaaattttacaagtaactcacattccattaaacaagccatgttgtcgaaagcacacattctatcaatttgacaaagattgaaaatccctgaaaaattattcttttagaaagatattttattaaatcaatgaaaagtgatcaaaatgttacctgtcagtttgcctaaaataagtgtgaacaaatagttttataacacttttccatcacttctctctgcaggtgactctgctaatctaacctgcagagctttctttgggtacagcggagatgtcagtcctttaatttactggatgaaaggagaaaaatttattgaagatctggatgaaaatcgagtttgggaaagtgacattaggtaattttttttccttttaacctgtatagtcaagattaacatttactccattagtgaatagaaagtaagctgaaaggatttttttttgttttactagtatcataataaaaatactacaatatttaatgataaagaagcaaaacactgttaacagacttactatggaattgcaaaacatgaatgccatttgcaaagaatttaagaaaaataacgaagattgttcattaagccacatactgagtgcggctgggggtggtggctctcgcctgtaatcccagcactttgggaggtcagattgggcggattgcttgaggccaagagtttgagactagcttggccaacatggagaaacgttgtctctactaaaaatacaaaaattagccaggcatggtggtgcgtgcctattgtccgggctactcgggaggctgaggcatgagaatcacttgaacctgggaggcagaggctgcagtgagccaagattctgccactgcactccagcctgaacaacagagtgagactctgtctccaaaaaaaaaaaaaaaaaaaaaatatatatatatatatatatatatatagtgagatcaaaataccataaaatatagaaaatgttagtgtactttttgtatatgagacctttttttttaaaaaaaaaaaaaaaaatgttctttgggaggccgaggtgggcggatcacctgaggtcaagagtttgagaccagcctggccaacatggtgaaccccgtctctactgaaaatacaaaattagccgggcatggtggtgggcgcctgtagtcccagctactcgggaggctgaggcaggagaatcacctgaacctgggaggtggaggttgcagtgagccgagatcgcaccattgcactgcagcctgggcaacaagagcgaaactctgtctcaaaaaaaaaaaaaaaaaaaaattttcacaggaaacattaacaaggtacagggactcaagcaaacacaatctctgtcatttcctgctacgtatttttacatatttgagccaccaagtggaatataagcttttgatggtagtgataaggatacacaaaatgtgtttatcgcctttcttagtctgactttaaggtcgaaatatttgtatagtgggaatgataacatgaaaatatttgaaggcataatgcctaagccccttttttgttcaatgtgtttacttatttattcatttaagtatcaattataattcattcaatgctagctgtaattatgctttggcatagatacttatttttattcataatgtaaatatgcaagaacgttaataataataagtaagttacaaccacatcaaaatgatgattacttctaaacatactcccatctaaagattgcatcttctgggtatatacaaacattttaatcatggtcccccattctaaatgtcaagacttttaaaactttatcaaaggtaaaaaagaaaatgattttcaatagaaaaataacacattttctattgggaccttctttctggcaacaaatacataagaatattgtactctagaatgccccagtgggattccagaaggctagatggacaattgtctaatatgtactaaaacatttttctgctgattttcgtatttaaaacttcactcttatcttttacccatggtctatgaaatgctaaaataaatgaaggacaattaacctcctaacttttaccccctctggctttgtgtgtgttcagggaagtttctagaaaggtagtttaattctgcatttaaaaatgttgaacagagatgacaacgaggttagtgagcatttaccattaattttaatgtcagagttaaatacttcaccagaacttttagtctacaggtttatagtttcacgttccttcaaaaacaggcaatttgttagtatcattaacaaaagtcagactgaacatttcaactgaaatgtcaaaatagctcagaaattttcttttcttttttaaaaaattaacctgacatgtaattaggccttcagcctgagacattagaatttttatctcaacttacataatatttcttcttaaagggaaagcaatttgtaaactttttcttcaaggtctttctcacctctttattatgacagtgtgattgtcctgctaagggagataattaactgcaacttcattagcatctacaaagacaagcttcctcattacaagtgaagaagaaaagggcataacttaattaacacagcatcaattcatagccaaattagaagcacagattttgtaggtagttttacatcagattcggattcatctacatttctttcttgtttgtgtatgtgtctgtttgtgtggatttttgttttgttgctttacattttagaattcttaaggagcatcttggggaacaggaagtttccatctcattaattgtggactctgtggaagaaggtgacttgggaaattactcctgttatgttgaaaatggaaatggacgtcgacacgccagcgttctccttcataaacgaggtgagtgtaaccttctaagcttcggtggtcaactgaatgtatgatgggagaaaaaatcattgggaaccaagaaacaaatttagttttgtttttctccacaaagttctcctaaataaaataatcatatttgcattagagccaccgaggcaaacagcacagtagatgggtgagtaactcagtctctaaaatcaaatttgaaatccttgcttttctttaataccaactgtgtaactttgggcaaaacatttaacttccctaagctttagttatctgataaatagaatggggaaaataatagtatcaacccttcagtatgttgtcagaataaaataagacaaaaaaatgtgaagggcttgacagagcctatacaaggaaagtcgttaaatgctatttattattattagaaatagatattaggggccgggtgcagtggctcacacctgtaatcccagcactgtgggaggccaaggcaggtggatcacttgaggtcaggagttcaagaccagcctggccaacattgtgaaaccctgtctctactaaaaatacaaaaattagctggcggtagtggtgcaagtctgtaatcccagctatttgagaggctgaggcaggagaatcacttgagcctgggaggtggaggttgcggttaggcgagattgcgccattgcactccagcctgggtgacagagtgagaccctgtctcaaaaaaaaaaaaaaaaaaaaaaaagaaaagaaaagaaagaaaagagaaaaaaaaaaaacaactaaatggttttaagtcaaagattgtatttcttactggaagattgctcctttagtgtaagaactgtctggtgaattccccactgcagtattttttgacatattgtttctgccttggataactttcatttgtacaatagtctccaatgatgaataataatgcatttttaagtaagataagctgtggttaagtgcaatgtctgttgtgctaactctgcctctacagcaccccatcaccttttgcatagggttaagtgcatttaaatgtatattgaattgtttgaaataagtgacaactgtaaaatgtgagccattcctgttagtaaaattgtttgtgtatattacaagagaaaaataatttttctacattatgctaagttaaaactttctactctttggaacaagcacacttgatgttctcttactcagcaaatttacaacgattttaatttcaaagcccgtgtttaatcctagactctttgaggtttgaaaagaaagagaacattgaaggctgttcccccttctttattgggcaatagattccctttgaataatattactgaatgctgttaaaatagacacctctgttgtcaaggtgactatggtactaaaatagtctaccttttagggatgtgagtcaaggagaaaggtatgcagcagctaacaatatgattgtatctttctatagtttagtatatagccaatcaaggaagagattttagtagaaatatcatacatatacaaggacagaagtagcttctcatagttaaaagcaacttaagtgttgtgtaattgaacttcttatcctgccataacatcttctgaagtgatctatcagcttatactggatcacattcccttctcaaggaagtccattttatctttggaaaaatccgttagaaagcatttcactttcactgtctatccattggccctagttctgtacttttaatcactcttccccaagacagcccttcaagtgtttgatgacagtcaccatgagtctctgaacctttacttcactagattcagcctctttagcttcttttactcattcttcatttgtattagcgaaatacttttaccattctggtcactctcttgaatctgctttaattaaagagtttgaattagtcctcaaaaatggagttaggggagagaagatatagggcacataaaaatgtgttgacttgaacaacatattttggggggggacaagggaggggtgacagttaagtaggaatcaaaggagaaggggaggaaaatgaattatatctaaggataaagctattaaagctctgtttttacagagaggcacacagccaagaaggggtcaaaaaacctccaggctaagttgcccaaagctatgaaaccttccatttctagaaaaataaatgaagaatgaagaaaattatttgaaattttttccagtaatatttgatttcctaaacatgaaaaaaatgtggtcaatgttagagtattcttcagtacttaagtcttttagtatgtttttcaaatatgcgtttataccaacggcattttattcttgataaataaaagcattaacaagccaaaaaaaggtccttccaagacatgtactccaaaagtccctcttaaagtgaatgtatgccttccttttaagggagctgcagcaaatgagtcatcaattcacaaagacaccaatggatgcaatttcctgctcttgagggactcatgattatatggaatgatctatcccacccatcttggggggataaaaaggactttcgttcacatatgacatgacctgaactttaccagccctgcaaggttcaggagaacagcacacagcatatatgaaattataggtttgggtctttgatcattgagtctctaaaaagtcaaatgtctgtcatgctaacaattatgtaattatcaggtgagttgctatattactcagaatactaaggcttagataaggaactggaagctttcactattaattgtatttttctgccacttactcataaattccttaacttataagccttcacagtcttcccttttaaaacctccctagagagacatgttcaaacatttgttgaatactgatcttgtataccacaagctgtcattgcttctgacaggtaaaccttccaggacattcctttgccaaaattatctaagcaatttttccttcactgttaccttttgttcattatcattgacataataaaatgatttcagagccctccaatgggtggtatggattctttgaaacattgcttccttgtatcaaatgtgtcttccttaatgccaaggggatactataataaataattcagctacatttgagctaggctatgttctgggtcagccttttatctgcgtaaaagaatcataattccatgaaagcctgcagaaaatctaccaagaaatttgaccatagaaaaatcttgctcgagaatatccaaagttgccaattcctgcagccagaaaaggtattaggttcatcagaatctcatcagacatgcaatatagatatatttcacttactatacagagcactagaatatgcagcaagagaaagacagagaatgaaacggcaaggcccatgggccatattggtttatgactgccctgctccttactcttcactcctgccagaagcttctattcaatcctctttgccagactctggcctggcaagcttgagcattagatcctggcttcaaaaataataatcaaagtaaagcgctgacaaattagatattgggttatttcttgttcttgttattgctcatacttgattgaattccacatctgagtctttgaatcttttacccagatacacttgctactgcctgtccaacacacactgaacactgaccttcagttctcctccaaagctctgatctgtcctattctctccattttttacattttccatttctctgacacaaacaatagtccaggtagatacctagaagtattgtgctctgacctcaggcctagacactcttgtacccatcaagctgtctcagattccttcttcactctctgtgccttctgtctatactctcattttgaatgacctcacagtgtagacatgtttattatcttaatggttaagagcatggacttaggagtagggctggctgtgttcaaaacccaactctgttcttactagctgtgctatctggggcaaattacttaatcactttgagcctcaaatttctcttctataaaatgggaataataataagacctctcacatagagcagctgtgaggattcaatgaactcgtatgtgtaaatacttatcacagtgtctgacacatacttagcacccaaaaaatgttaagctattacaagatttccttgctctaactatgtgatactctggctaatgaaggatgcagcaattgtgtgttccattaaaaattccctgaattctaattcatctttcattaaaatcatcagctttagctccagcaattttgttctgtcaattctgaatttgactttataatagatatactgtggtttgaatgtactgtcctaaaggataattttgtttatttattcatgcatttaatgatgactaagaacctactatgtgcctggcatttgtgctggccaaagttacaggcatgaaaattaaaattaaatgaacaggaaataaggactaatataatttggaatgccatccactactttttaaattacagtgatattaaacattcctaatgtatgattgtgcttcctagtgaatgtttcactttgaaactgtcacattggggatgttcattagcaatcttactctgaagggttatgtttccttatatggattacaaaaatatggcaattcattaatcaaaatttagtttgggaactggcaaagtatctatctgagagactcagcactagttaataatgataaacatctaggttttctttatttcccatctaacccattttacttcttgtgtgcactctctttatcccttcaaagaatgtaatcgatagaaattagacctgctcaataaactccctagacctaaaagtatctttagtaatgtaattaagtgcacatcatttaggatgcattgttttaaagccagatgaatttaaacccagtggactcctttaacccttcttgtaacgaatcatccttgtaatatgtgccccatccttgttagtatttgcctagtgaatttatttactgagagttacagtaaggtcataaaacggtgcaaacttcttttggggctggccatttgacgtctttgaccattgatttcagaatatgttaaagccaaacttcgttcagaaatcaaaacctcctacctctctttatggcagcatttccctagaaagacaatgacccattaaaagctgagctaatgtcaatgaaatggatacttttactgagtcttagcttatgcagtgccaaaatattaaggaattttagtaatgttgctgcagcatctccaaataaaagtcaacaagtttaacaaattctctccttggataagatttgacattttatagtcaaaattttcttctgtcccgtaactgtttttttttttttttttttttttttttttttttgctggggggggcttctctgctcatttgtataagacgtctaatagcacaaattatccaatactaatgattttgtacctctgcacttcttttattatttatgtttatttttacagacaaggcctcattctgttgcccaggctagagtgcagtggtgtaatcatggctcaccgcaacctcgaattcctgggttcaagcaatcctctggcctcagcctcccttgtggctaggactacaggtgcatgccactacacctggctatttaaaaaaaaaaaattgtagagacagggtctccctatgtttcccaggctggtcttgaactcctcggcttaagcgatcctcctgtctcagtctcccaaagtggtgggattacaggcatgagccactgtgcccaactccctgtgtgcttcttgatacggatattccaacaaggctattgattgccaccaaagttgcagacatgactattaaccacttgagctatttccttagacttagaatatattatttaaatgagattaatcccaagttagttatttttttgcctcaaccgtgaaatgttttgaaggcttttttttttttttgagacggagtctcgctctatcgcacaggctggagtgcagtggtgtgatctcagctcactgcaacctccacctcctgagttcaagcaattctgttgaaggccttttgatcctagtttttgctaatcagttttaatatggaagtatgtcatgtaacattgtttggcctcttagccattttggtcacacagttttcttctctatgaatgagaataaccaagtagcatcattgttagaaaagaaaaggaccattgtctgctgatgattaacttttttctcaattaataaatgacaagagggtgatcctggacaaaaccaatgtcgagggccaagaataataaactctttagtctttaatcatgcctgttgatcattcatgtgggccaaagctcttaaatatttaattatacatggttatagtcactggaagtccttttttgctttattgagttttacacttgttttcttaactaaatgttcaattcttgatacagatctttaactagtatttctctcttacatgcttcaaagtaccaaacccacttagtaaatgtgatgaatgggctgattaagtgtattctgagtgatctaaactttgtctatagcaggatttctcaatcttgtcactactgacattttgggcttgataattctttgtcgttgtgggggctgtcctgtgcattgtagaccgtttagcagtactcctagcctctgcccactacatgtcaatacaaccttcctcagttatgaaaatcagaaatgtctccagacattgccagatgtccccaggggtcaaaattgctcctggtgacaagcactgctctacagtatagatataaaaaactcagtcttcctggaaatgatttcaacacttaagctgctcaatgtagggaaattcaaaatagaaggacaagtattttaatcttgaaaaccttccaagattataccaaatgtgactagaaggtcaacagaatggctgttcttacaccataggaattgacaaaagttaggtttcttctatttccatgcttagagagtcagctaaaagcccctagaccagtgcttcacaaactttacagtatgcacaaatcacctgggaactttgttaaaaagcaattcattagcctggggtaggactcaagattccaatttcaatcgagttccttattggtgttgccactattggtctgtggaccgcagctggcataccaaagcccttgcctagacaatagatctttctaattagcttggtagcctctaataggtaaagagaaactagttatcttgagctcactgtctccatgagaaaggaaccaaagctgagtagagccagtcagtaggactgtttttaattaattgcctcattctttttacatggtcaacacctttgaacctatttgaacagtggttcattgccctcacactctactcttaatgaggttacttgtttcacctattcaatgaattgtgctatataacatacttgctactcagagagatgtctgacagggcattttcttcaagtattcaaataattaacctcttaaatgaagagggccctcactgttggacccatttcctatttatctcattttttaaaaaggaaataaacttaggaatgtctcaacgacatatatatggatatacacatatgttttagcctatgcaaataggttgaatctcagcctatgcaaataacatatggaggaacacgatgtatggtgaacacgaaatactgctgattttctgttttgaacacttacttgtattcagctaactctcaattaagtgtggtaagaaaggatggaaatggtatggaaattgaactgccacatattattggtcaatgatatgcttcaaaagcaggagggagggagggagggagggagagaagggaagagaagggaagggagggaaggaaggagaggaaagaaggaaagaccatagaccatagcaacacagactggttaaaaccatctctccgagttcaaaagtttaattcattttaaaaggcatctgtctagcatctaacagaggctataaaacacaagtatttttacagctgaagcaactaaactagtgtgtgtatagtcaacagtacacaatgtatttgaatactgccaatttttatgtgaccactgagctgccagtggcagcagtctactcaagtgagggcagaaggaatccactggaactcatatcgatgtattagaaaatgataaacaggcagtgtagaaaaaataattaagtttaaaacatttgcaggaagcccacagaaattatctagcacacagcaaaattccacttgtgtaatcagagattccaaacaagatagtatattcctagccaccacctaccaacaaccaacccctcactcctccttctcagaaccaccttcatattttcattatttctgggtcaaaacaacctgttgattgacaatacttcataatcccactacaaatctcacttcactgcaggctgcttaaaagagataattcatataatgctgttgtttgaaaaagcgacaaatcattctaattcaacaaatatgtattgagtgccagctatgggcaaagcactgggttaggcatccttactagtggactgactgaccgctgccagaaggatatctaccaccatcctggagcattaaaacagcatttttgggaagagggagatagctgtgcatttttatggctgcaaattcctgcatttggtagagaaatggcacaactgggtcataaaatgcaaggtataacttttaataagtagttcctgtacgttgaacttttgacaaccaggtcagtaaagtgagaaattagacatgacgcatacaaaaatgctaactactatctcgggtcatatagtagggagaaaacgtgttgatttccagtaaattaccatggtaacttgtatagattttagtgttgagaattacatttgccatctgtgggaaatatattatctttttgtatctaattttagggcatgtgttctatttttagcatgtgttctatgaaaaataataaattgggaggccaatttggataaattaaaagtggatattaaaatgctataaaaatagaatttatttttaattcaaaaagaaaatccagtagtacatttaggaaagcacacaaaggtcatttttaaaaccacctcaaaattgttaccattaagcgaaatttgatatgaatgagaattgactaaaaagtgagaaattctgaactgtgataaaaaaaaatggacagttacctgagagtattttgcttttgactctttagctttgtgtgacctagagccaatctctttgtgtcattgttcttcagttttatcatttgtaaactaattgcccctagccgcactgtgggaatcttgaaagagcatatatgatactgggtgactaataatatacattagaccatttgtcagattttacagattctctgagtttttacacattgtgcctcaattttgccaattttgaaagtgagatatggtggttgctcttcctagggattttcttatgccttaagtgtttgaaaagttgactcagatctttagatggcaagtttctgtaactgcaaagtagaaattacaattccttacgacatgcaactgcagttcaaagtaccgacttacaatggttgccaaattcatgcaaactaaagtggaagaggccattttcaaagcctgaaagtattaaatataaattacctgacttaaatcagcttagaattataattctactctgtatgtgatgtaaaatgaatttgacttaaaaatttatttataccacctcacaatttcaaggtaatgactcacaactgcttgggtccatttctaattctccccaaacaaatatgtctgtaacatttaaataccttaatgttgaaagcaacttaaagaaatacattaaagataccgcaataaaattctatttagttaggcttcttcggtagactgctaccactggcaattcagcagtcacataaaagttggcagtattaaaatacattttcttctgtgggctgttcacatactagtttagtttcttcatctgaaaaacaatgcaattagtcaaaatgaaatttgaaatttttacctcctctaaaatcagatgattgactccacgttttatgtgaatattcataaactgttgccaaaactgattattatttatgaagagaaaagctccacagtggtgtttaaaaaattcctgttagacttgcattgctgaaccaggcatctttaaatgatagttgcataaacagataggcaaataaataaataattaggctaaagtggttaccaagagaactcttagcagaacatagcttgcaaaccacactggacaaattccattccaaactgtccagaataaaaggcaaaatataagctattttgtagtactagtatttaaagccatagatcaattacctatgttaaggctacatgaaaacctaatacattagaaagagatgcattaaataatttagtgaagtattaacagtggttacctcgaggtggcatgattccatgtgatctttaatttcttatcatccttatgcatttttcaaattctttactaaaagcatgttttatagagtcagaagaaaagtgagaaaataaatctattttggtatagctactgaatatttttgaaaatgcttataggaaacctatcattactctctgctataaaatcaagttatttacacatttttcaagtatattgaaatctatttgcttgaatatgtactcttgctcccactttgtctattttataaaaaaacattttaggggacaccttacttctacattattttctcaagccactgctagttttcatatgctgaaaatcaatacatacagtgggatgataaggtaatgctctattctttgtgaagcagagctatgttatgctattttggtaaaagataattcattattgaggacaagcccttcatgtataccagtacagaggccactaaactatgtgagccacagacttcttctcaagtttgtcatggtttaaggaaccatttactgctccctttggatgaggcaagtaatggtagggtctcctattggtagctcccaaaacatgctcattttttcatagattgttaatggggaggggggattttttttttaaaggttaacagagtcttgaaagcatctctttacaaaatgagaaagaaaggcaaatttaccactattttcctcagcatgtttatgaattcagaagtgttcataaacattcaacatagagaataaatatatttttctgttattcccactgggggaaatgaaccaacatatgatttttgctttaatgctttgtaactctggaatcaccaagattttgcatgaaacttgtctcaagagataaactattaccaacaaattttgccacacacattttcttctaatgctttcagtaaggtcagaatcatttaaccccttaagagacaatattaagatggatgcattagattctgaaggttaataatgtatccatttgtatattgccatacaatcagttnnnnnnnnnnnnnnnnnnnnttcactattctatattatgataataacatattattctgaagtttattaatgtatcccatttgtatattgcaatacaatcagtttatatgtgtgtacaatattttctaaatgtagttccatcaattaaatatactataaatcatcatactatatttgtttagaagagttcaatatttctgtagtaaacatggcttcttctattggttatctaggcagtccagatgttctgggttctttggccaatccaaagcattcccaatggaagaccaaattgttctaactatgacaatataccctcttgaggaaaattgctttcaggataaacatcacatcccttaacaaggagtaaaatggcaatgccaccttcactctgacagttttctctcaagagatgttttgtaacattccatctgtgcctgtctgtttgtatgacatgttaagaaggaaattcctagtagagggaaagcaatacttttctaaggtattttcttttaggcatcagtgaagtttgacaccttgatatacaatagccctgtcttctaagctggtcacctgaggccctttttgtttgttattataacagtatcttccttctttgtctgtcttctccccatcatacttaatcttatgagatctgagataaaggaagccccatctgaatactttgtacctgtatgtgtgtgcaaacacacataatggtctgtgtacatctcacattatagtctttagatagaaatatttcaaacactgcctttataatctaaaggggaaaggttttctgcaataaagctctgtctgtgttagtaacttcacagtatacattttgaaaatatatggcaatttttcccaagggagaatcattgtcctattgtactgacctaactttgcgaaacctggtttaatgggttccatgaatccgcaaacaaatatttattgaaaaggtacatgctatttgctttgaaaataaaaaaagataacatattctagctgagaaatcaaagcatgagtttgcctaccttcacctatcacatcacacattcattttcccagtgctccagaccaaactacttgccaaaatcctttgcagctacctttgcattgtgtcattctgtgtctgacccctgtctctaaaatactcctacagaaacacacacacatacaaataccccaactgaatttctcatctggcttataattgtgatacttataatgtagcatttcttatataaaaggggtctagcacagtgacacttaagtgctcaataaatatcagctcttattattattatttattattatctgcttacatgtctgactctgaaactagacatgagcacctttaacgcaaaaacatatttcatccatcactttcactttatcactagaactcaaaagcactgtacctggtacagagaaggcacttataaaacaaatagaaaatgtatgtattagtaagaaaatttgaatagcagtatcaaagatgtgaagcagtacatgattgatttccaaatgtcaagtgaatacaaacattcttagttctgtaagtctatacaagactgtattgtcattagctttgtgaatgaaaaaaagaacagaaaccaaacaccacatgttctcactcataagtgggagtagaacaatgagaacacagggacacagggaggggaacatcacacaccggggcctgtctcagggtgggggcctaggggagggatagcattaggagaaatacctcatgtagatgacaggttgatgggtgcagcaaaccaccatgccacgtgtatacctatgtaacaaacctgcgcgttctgcacatgtaccccagaacttataataaaagaaaatggaacaataatttttaaatctatactatgaagttgatcatttttctatatattaaaagtttattcctaacttaatggactgaatattaatgctataattataccttatcagttgcttgaaccttaggatacattgactagatacacagacatattcttggaattttagaatagaaacacataaaacctagctttttattcaaaattgggtttgttcttaatcatctaatcagtcattcattttcactgaatatctttaatgtgtcagatagttagcaaggtatttgggataagtagtgaaagatatagacaaaatagacaaaaaaaaaaaaaaaagagagagaagacaaaaaacttgtcctgatggaatttaaatcccagtggaagacaaataataaacaataatacatttattgataagcaaatgaaatattatgttatatagtgatgaatactataaaaaataaagacaagtagatgcaaaatgcagccacaggtttgtgacttggaacgagtggtcagtgtatccaattgagaaggtgccgtatgagcagagacttgaagaagcaaagagagaggcatgtagaaatctaggggaaatactctctagtcagagggaagccagagcaaaggtcctaagataaagtcattgcttacaatgtaaaacaataaacaaaactaactctgatataattcaatatggtaaatgaaaaaaaaaaggaacaggaaatacatgttctaaagaggaaaaaaatcacgtttagttggaaaagttatattggaagtgcaagatcctaacctttccttgaaggactggttgggttttggtaaatgaagaacttctggtttggaacaaaaaactcatgtcaaatttaatttacattagaaggatgattatggctaaaggttagttagctgcttcaattaaaggaataaagaaacttaaatgcccacataaggggtttagactttgttccatgggcaatgtaaatcagctaagagatcctgcagaaaattccagggtgaagacatgatctgggaagatgaaattgaaggctttgtgcagattcgtgtacaatagctgtaaataacagaattttaatacaaaggtaatcaacctgaagtacactctaattacaataacacttgcaattattatcttacaatttgaccttttattttttaactttctattttggaatacaaaaactgcagatattatagaaaattacaagaacagtgcaataaattttcatatatcttctccacctagatttaccaattaatagatttgccacatttaccttatctctcttcctacatataggtaggtaaaaagagctgcactacatatacacacacacacacaacatatcattgctaaaccccatgagagcacattgcagacactgaaactaaattcttcaatgtgaatcccctaaaaacaagaattttttatgtaaccaggatacatttatcaaattcaggaaaattcaaaattacaaaatgccattgcctatgatatagtctatattcaaatttcaaaaattgtcccagtacataccctttacaccatatttaccatctaggataatgcactgcatttaactgccaattctctttagtctcctttaatctggtatggttcctcagcttttcttcgtctttgataacactgacatttcgaagagtagaagctagatggttttattttttatagttgtccctcagtttggattggctggacatttccttattttttttggatgtttatgtgtttctggctataatactacttaaatgatattgtgccctcttattgcagtacaccgggggtgggggggatgatatcaagttgtcccgttattggtgatgttaaatttggtcacttccttaaaatgatgtccatttttccccagtgaggaggtactatgagacggtgtgaatatcctgcctcaccaatctttcaaccaataattttaacgtctattgataatttttgcctgaatcaattattattatgatggctgaaaaatggtcatttctaactatatcgttcatttcatatttaccggttgacattctgctcttagggagagctttcccttcttgttggtttatttgtaactaatatgaacacatggatttgtgctttattcagttactgccattattcattttaactcatcttttaaaacataccacctatgaatacttcttaattcacagagagaaaaaccagcttaacacccttcttgcctagttgaaagagaaaaaaagcacattccaagggtaggctctagcatgctgtgaagagaatgttacactttttcttctagcctttcattttatttttcactttgaatagttcattaacacataacaatgaagttccaaggacctgtgggaccttagtctaactgggctctaatgatgggtcctagccaacaaccatatttgcattttgattggcagtaagtagaagttaatttggtgcttcgtctaaaaacctctttccaaatggcaaaatatactactttggaggtaatcttttgcccaaatgtttggtcatacagattaagccgctccattcagggatcatttttatttttattattataattttgggggtttataccctgacttcccaaaaaggacttttgcaagatcaaaactgttattcttacatactggtttgtactttcccaaaacattttcttcctttatgtgaatagcagcttgatttgttaatgtgtttcccccaccccccgcaaaaataactgcttttaaattacactgatgtattgtagaactgagttgagtatctttgtaggctgagcataattatcctcctgccaggaacaaataagttatactgctccagagaaataaatatgcatatgaatttatgtggatggataaattcttataaactttagctctttataacacaatgagagaaaaagaaatgtacctggtgaggctaatgaataaactgggatcattataatgtctgtcatgcattttccccacaaacttgcattttactgcatataaatgagggaagaacacttcaaaagactttttataatgaacgaaccaactttaggataaactacacaaaagtaagccatctaaaatcttcagttataccttctggcaaaattctatatatataggaacacacacacacacacacacacacacacacacacacacacagatcaaatagagatactgactaaaaactgcaagtcaagagttcaaaaatacatatgaacttttacttactttgttaaaagctttaccttttcgaagatttctagcagaaaatgtttgcaaacaataacaccaggtacaggccaagaaaagaacatagtttcccatagtatactaggtaattgcagcaagatcagtggaaaccaaatgcatttattatttgcaatgtaattcaatatactaagagatggcacgcactttattttaattagctgtttcttttaaggggttgcttgctcccactgtcttgataagaaaaaattgtagtcattgctcaaaatgcttgtagcaaatctagttttaaattgaaacaatttattccaaagcagtctactactgcagcaataatcaatgtgttttcccttagcctgtactggagctttcctaggactattgttaattgcctgtaactaaatgatcgctggggcccttaaatgcaactctttggcacttgttcatttgttgtttttaaccaaatgccagttttccctaggttttgcctagcaattttgctttacaattttcaatattcagtctcagtcccttaaagggggcagagtctatcattttaacaaaatacacaaaggctaaacagattttaaaaggtctgcatttctccttctgtcctcagatgttgaattgtgctgaaatgatatctttttattttttaaatgctgccactccaggcaacttgaactagagctgaaaagtagatcccatttcaaagggaaaatgacatttgctggggcaacaccatttacattgtaatgtaaagataaaatacagcagtgggcccaaatgatttctcttaactgtgacagaatttaatccttagtaattttgtataacccaaaggataagcaataataggtagcgcatgtattaatgaatctgtctggcttggagcaaaagaatacagaggctaaatctaatgcacaattttctttgaaagggttttcatatgctatataaaccagtgtgacttaaatagaaaaaaaatttaacttgcatacatgtataatgtgtaggcttgtatattacactcctgcatagaaatattgtaataactgaggggcaggcactgtgcaccatggggaaagacacatttccattttgttcctgacctctttataaggacattataagaacactatgcttctgcaatgtaatactacagaagtctctgggggaaagtctgtgatgctctcaggatctcaggataaattagctccttgtaaattctgtttctttagacttgtttttggtattcctattattagtaaatgactatctatggcccagaagaattattcttgcttattgctcattctctaagcatatataacttttcatatgtttgtaccctaaaggagtttttcatgtgacacaagactgtttctgtaactgctaagctacatcaaccctgctctctttttcttattatattttaaacaacactattgattggctatgtagagtattctaagtaatgtatatcatttcttaaatggctcgtgacatgtagcaatgggagtaactcctatctgggtaattactttgctaaaaataagaaggacttattttcatacaatttttctctaatttacctgtattcaatttctcaaaattaaaaaagtatgtagagaccagtattataaataccatctggagaaaatgagagttctgtttattagattgatcagattatatttcaggcaaatattttttattatttccaaagctcctcgactatctatgggcacttaaggcatgccacatgcccagcccctgtgtagtgcctccagatataaagaatgtgcttgggggcaccgtaaaagaatcattccctgcctgggcccttatctacagcagagcagctttcctgactcccagctttcttcccacacttctccccacataggcctttggttagaacttacgtttttcttaaaaaaagaaaaatcaaaatgttaaagaattgaaatatgattcacataatataaagcgtgtagctctaagtgtttggctaaatgagttccgacaaatataaacacttgtgtatccacaccataaacctatttcctttaccccagaaagtttcctcttgctccattccaacaagtttcccttcactcatcatcaatgaatctattttctgatttatgtcactatggatcatgttggtctgttcttgagtgtaatttaaatagaatcatacagtaggtattatttcttgtctggcttcctttttctaacataattttgtgagagtcatgcatgttttgcgtatcagtagtttactacttttattgctgagtatattctatcatatgaacatacaatagtttgttcatcatttcctgttaatggacatttaagttgtctctatttgtggctgctgtgaataaataagactattctgagcattctcatacaactcttcttgcagatatctgcttatatttctcttggacaaatacctaggagtggaactgctattgatatggtagatttttatttaattttattagaaattaccccaaagtttacaatgtggtaatatcactgggtactctcactagcaatgtttgggagtggaagctaagtgttcttgattctttttccatttctttttttgtacaagaaatttttgagtggtaaattcctagtgtttaatatactaaattagaaaatcttaaaagaagccatagtcaaaatgcttatttctcacattatatccaatgtattttaaatcatatcttcctgatgtataaatcaccctgtgggcataagttagaattttacacaggcttctgtgtatggtggagtttattatcttgagtgaacaagacccaatgtatccccacaggattagccgctcaccctttctgttcatataatagggggaaaacattatactgaagagctttttgtattttgttcctggtatttttgtagtactgtcttgtgtggttccccacaatgttaatcagataagctgctggaggtatttttcagtgttttacacttcatattaatttacttagactctaaaagagttgatctcactttattttttcttagatgcatacagttcaatcgttttaaataagattttcttcaatttcccatttaattttaataattacagaaaaacacacttgattaaacagcagttaatgtgttgtttattaaactgtagaattagaaatcaagggctaggtaataggaaatatgaatgaggattttttttttttttttttttgagacggagtctcgttctgtcgcccaggctggagtgtagtggcgcgatctcagctcactgcaacctccacctcctgggttcaagcgattctcctgtctcagcctcccaagtagctgggattacaggtgcctgccaccatccccagctaatttttgtatttttagtagagacagggtttcgccacgttggccaggctggtctcaaactcctgacctcaggtgatctgcccgccttggcctcccaaagtgctgggattacatgtgtgagccaccgtgcccagtctgaggactttttttcctgtaattattacaggaaaagtgacatcacctgcacacacacacatacacaatgttcttgtaagaaaatgatggccgtgcttttcagattatttgtcactcatattacaccagtcccatcatgatttcaccccatttgtgagaactcaggactgatctgataacctgagggtacttgttaccagcaaaaccgtggatcattttaaagttctcagtctaagcttacattgactgtgttatgaaattagataacttactggtggattctgaattacagaatcaagaataacattattttacagctttaatttcagaaatgtttatatttaattgtagttaaggaaactagtacttttcaaggtagttgtcaactgcagggaacaatggctacccatcagtaacaacatttgggctgtgatgattaccgacaacgcttaaagtgagtttcaaaaatctatgcatgatggcttactatttaaataccaatatccttatttttgttacaatgtccatggttctaaagaaggaaaaaataacaaaaaattttatctccaagttttcctgataagttttgatctaaggtagatattcagtagaaaaaggagaatttgtatacagtgagtgtcaagaaaattccttttttggatagaacgtagtaacatgcctggtaaaaggggaagcaaaaatcttaaaaagtaaacggttgaatgaaaataaaacaccaccaacatattcatatactgtcccatccactaggaggcctacttcttacacccaaaaagcattcagcctccaagattatggtagaccaccttggtatcactgtattcaggaagatacagcagaggagctattgctcctggcaggagtcagcagacagcattcattagatagtcttcccaacattctatgcaacaatccacagtgctctcctgaaactgtgttgtttgacctctcacctttctttggcccccaacccacaggtgacagctcaagtgagagggatcaagattctcattgggagaggccaaaagtcatcctggcttaaaagcttcatatccacaggaatcagtatttattttatcaaccccataagcatagcttccgggatctccacaagtgatacatttatataagagagttatggtactctgttaaacccaatattatagtttccaatcagatatttacaattctcttaatccaaatgcaagctaccaaccaaggttcatttttaccacaagcaatgttgcttagcaacatggttgtcacataccaccttatctagttaccaaggaaacagagctagaaagttatcaaaaggtcaaattctcatgcaaaaaggaaaggggttgtgtcaacccgttaacccacatctgatctcatccaggaaaatgtgaaatcaaactgagtttaatttatgattttggatgtgaataccatataattccccattgtggttttttctttctagagctaatgtacacagtggaacttgctggaggccttggtgctatactcttgctgcttgtatgtttggtgaccatctacaagtgttacaagatagaaatcatgctcttctacaggaatcattttggagctgaagagctcgatggaggtaggatgttacctcttttattgttctttctgaatgttctaatttctttcttgtctttgttttattaaggggaaaaaaattacgtgcataatcaatggcagcagctcgtatattctttcagtgctcagtttgtaaatttctcttttgtaaggaaatgtgtgatgctttatagccaatactgtaggtattttcctctgaaagttgtaaagcaacacctatccattttagaattgtattccaaacacttacaaattacaaacactgattgcaatgccatcagagtgttccttttctctcaccttgtaatcaggactgaaaggccagttttacttttttttaggtaaggagtgtctcttttaattgtgttttctagcccagtagtttgaagcgaatctcaatttgctcctgtttagactgatccgttataataaactgtactgagtattttaaattcatccagcagtcttttcaatcttgtttatttagctatatttagatagcctaatttttattccaagtgtggaccaacagaaaaatgcacaagcacattaatttcatagtaatgcatctcatatttttactgtacgtagacaaataaatattgttttgtggaaatcataattagtatttgcttctggtcaccaatgaatatgtgtacaatctaagaggaaaatggagtccttaaaattcagctccctaaactgcacattagacttatgtttttaaaaaataacaaaaaggaaaataaactaagataaaccagcaagatgggaagcatatgcaaactgacaatgaatagtacagatgacaaagctttcttcatcattttttttttttttagtgaggtggagtttcactcttgttgcccaagctggagtgcaatggcgcgatctcagctcactgcaacctccgcctcccgggttcaagcgatcctcctgcttcaacctcccgagtagctgggattacaggcgcccgtcatcacacccagctaattttttgtatttttaatagagacagggtttcaccatgttggtcaggctggtcttgaacccctgacctcaggtgatccccccatctcggcctcccaaagtgctgggattacaggcacgagctactgcacccggtctcatcatatttatatactgtttttttttcagtgattttcagttttgcagtaaatggtaccaaggaaaatgaggcaattgcctatgttgccacgtttccagggtcctctggaataataaatccacaagcaaaactagttttgcaggtttgtaaagagaagtggtttattcagaatgcctaacactcctcttggtttacccttctctccttcccattagggtgaagcctgagctgcagcaaaaccctttctttttcttaagtttttaattgctgatttgcctatttgtttctaactttcttgcctattgatgcaaattattattattactattgctgctgttttaaagaaatataaggactttgccattgtcggaactactgttgaatgagcaccaagcatagtgctaggcattcttagagtcattcttgctaaccctcacaaacatcctgaggtcaatattgtaatctccattttactgataaggcaactgagactttcagaggttaaataacttactcaagaagataacacaaatactgtaagtgtccaagatgggatttgaaaataagtctattcccaaagcctttatcttatcggatactctctattatttgtattttttttaaatttagtatgttcagtatcatctaaagatctactgttgtttgcacaattagcacagtacatggtatttgaaaaagcacattacctaaacaagtctccccttttctattaaccctgttttgaatatgtttattttgtgttctgaatgagatgaatcattttaccaaactatcaatttctagggcagtaatctgtcattttctgaatgtagaaaattctggaatataatgaaaatgaattaatcatacgcagtggaactttcagtgattcgaagtttcgtttagtgggtcctgctaattgtaaacacttcagtgactgacttgggtagccttaccatatttcattgctgttctgaagctgctgggttctcagttttttaaaaaatgttttaagtaagaaaacaaagcagacagacactaacaaacagtattctaacagatgagaaggttctcttggaaagcaatttagttaataaatcctttagcgattcttagaactctgtctctgaggccatcttaagcacaatcgagggtctaactattagggcttttcttgaaatgccactgaaaatgaattagacccaaagaaaaccaagataacaaacttaactgtcatctggaatatgttaatgtacaagttattcccctaaaaagcggggggcagggggaagcaaagactgtcaaggcagtgattgttcaaatggttttatgggaagaaattattactagaaccgcaatcacatgttcagcctccctatattaaagcagacccgttcctgctgaaatggtggtcagggccccactcttaactcgtatctcccgctgcatcacacctaacctctagaacttccagacactgttttatcagaaccatacagcagtactaataattatatagcaagtttaaaatctatatcttaacaaaagttagaagtgtataattgcaactttctttaattctctagtgctctaaaaccattcagcttggctctcaagttcccatttctactgagaaaaaactcataaccttgcttctccaagattactccgtcacttctggtttggaattcagcttcttgtgggttaacactcagttgaaaattggaatattccatttcccttcttctcttttactcttgtttaaacctgtttccagggaactcatatgtagctttctggtaaaggaaaaagtcacctggtgcatatgccatcccttcctcacttgagatactaccacctggtctttggacatgttgagcactgacttctgaaggcgtagatccttgtcatggcctccagtcacaagtttcacacacttgcccagatgtttctcccttgggaatttcagacattcttacctgtgtttctagtcccataaactcggctacacgcatacccaccttcccattaaaaaaaaaaaagtaatcatcttcttcatcctttgcctctttcatatacggtttccacattgagtgcaggatttctctatgaagtttacagtttcccaagattttccctgggaaacttgacacaaatcctcgcccttctcagattctgcctcaaaccatatgaagttctgttatcctcttctcctctctgtggccctgagggcccccttctcagaaacccatgcaggctgtaaaccttagtcacagccccttagagcctcctatacatgcttttatggtcaaagaatggtctactcttccaatagtgaaaaacttctctgacatcatcaaatccccatgcttcctagctctgcaagctttttcctcttccaaagaagagatggctattcaacaaaacccaaggctttgtaaattcttgtcttttaaaaaatgtaatttagagtcaaacctgagtattgccttctttattcatggctatcatatttaccttccctgaaggggtaatttataaaatacttttgaaagtaagataaggcaaaaagtgtgaaaaataaccagggaaaaatgtttaataatatcctactatagcaatatgataataatagattcaatggccatttattgaataacaagtgatgtgttgactactttatcaataatcagagaatcacacaattagaaagacagaatttaagctccggtctaaatggctctaaattccaagatatacagccattttatcagacttgcagatggagtttctggcatcagggacacattcactcagttcctttggagtcattacaaaaggcattacctggctatatcagttctttatcagaaggattatgattgatatagaaggattctaatattttttaaagatagaacatattgatgcttttctctctcagttcgttcacatcactccttgttcccctctatataaccttacattttattatctcccctgcattcagtccttagcatttccaattccacaacactccccgcccatactcattctttgtcatcctccattttacacctcagttcctggtatcaccttctatctcattggccacactttcccctcatatgccatttctaattagtcatcaatatcagtcaattgcacctctcaaaaatagatattttccttacccttaattgcaactgctttgtccaagcctcctacaccaccctcttgttttcattctctacttctctatcttatccttcacattctaacagaattatctaagtacaaatttactgttccattttttaaaatgcctccattttgcctgctagaacagtctagacttagctcagaaagcaattgccatcaaagggtgacccaccttacttttgtagcattgccacccccatgggatctcaacatgcagagttctagttagaataagatgttagtctttgtaataacacagctattgagaatgacctaagacaatgtaatcttgcataattctctgaggtttttggggaaaatgaagtaaccacaatggttaaggggaggagaagatacgctatccccctaccactttgattccacaataaaaggaaagaaagtttggataaattctgccagaaaaatatttattagcagacagccttatcactcaacttataaatcagaagaagttccaattctgttgtatatgtgtgtgtttgtgtgcatgtatgaatctgcatgtgtgcatgcttttcagaaaccttgcaagaaattttctcccaaggcaaatgtggcaatactccagtggtaggattgaactcaccttctgttgacatccaagaataattttcatcaagaccattttggaattaagcctagaagatcttctccaagggggcagaccactggccctgctagatttttgtaagggtgggaatgtgtttctaaattgtgttaagtaattcatatgtcttgattaacactgattttaccatggaaataccatttccaagacccattgtacacagtaaaaagccactatctttagcaatgaaacttgatttctaatatccattgtgttaattgatgaagcatctacttttgatcagaaatatagtttaagtgcttgtagtgaccgcctctggagtgttgcctcattttagttaaatgcttgctgaccatcctaataagggcaagctactgtctttagagtagaacttatactaacaaagtaccaccaccatttatgctggaaagattttaaaaaacaatacagacatcacaacagtgttagactcctttgctcctccatgtctctgaatggagtgtcccttcaagttttgtttaaagttataatcctactttatatatttttttcagagtgtaaaatggtttttgttgttgttttcagctttttttccttctctgactatgaagtatgtggggcatgcttactcataatgacgccagggcaagcttataagaacactgtaatcactaacacgaatcctattttaaagatgaagaaagagatctcctagtcctacgttgggagttattacaggcattgaacaaaattagttagagcaattttttataatctccacctccatctcagaaaatgtgaacatctgttccatttcaggcatattaagcacattggcatctatgaaatcttaggccatagaatttctttttctttctctttcaatgacaaggtcactcactattcatagtttcaggaattattgtcctcatgtccatcagtgaaacatagtacctctgcaaatcatttaaaaaccttatagggattttttttggtgtttttttttttttttggtgggggggtgggtggtggtggtagttagaccatttacatacacaggaataatctttagaagctagaacaagtttttggatcccagaaggagagatgtagagttgttctgggtatatgacttgcctcaaatcattaactgttaaatggtaggaaccgaggcttcttatcccaaatcttgtgctccctttgctattctgctactttttaatccccttaagacttctgaatctatgttgcctgctgccctcttagggatacaagagaaggaaataaatatctatagaatgactcctttggaccaggcattttgctatatgatggggtctcatttaattttagacatcttcaggaaggtgctattttatagatcaggaaatatagtcccaaatgagttatataaaaagttatggcaatcaagatttgagctaagcttctgggtgtttttttcactactttataccacagatattttaactagtatcaaatttaagtgtttgagaacttatagattcaaataatccagaaaagtaccaaatggcacaacatgtgaattagaacagtactgtaaatacttcaaactgtacaagtcaagcaaatttattttacaacaattgccagaggttgtcatagcagaattgaaaagcaaaatttattaagacaatgacattcaataatcataaaatcaaaccattaaggttttatatatctaatgtttattcattcaaagatatatgatctctgaagataattttatttgaaaaatcatatcttgaaaacttgagaaagcatatgatggcaaatctgagacataagaagaaatgtgacttactttttgaaaactataatttattcaaattttatcaatgcaaatttttaattatcacagttttctgtgatgatatgccacacttaaacatacaaaatcaacttttaggattaaaaaaagatgaactatacaatttatctttgaaccctcctccagtttcattttaggaatccatttactgaatgacagcctctgccactagtcaatttcacttatgtgattcatatatacttgagaacaaaaaaaaaaagaaaaaaaaaaaaggaatggccagctgccaaaaacatttgacaactattcagtaagtgtttagaggttaaaaactcccccaaaccggatgtcatacttaaaacatttctactgtcagtaaatcttttttctagccaaatccaatacagccactaccttcaacttgaaaagtgagtcttcaacctacattttcttaaaagctgtgttattctaaaataatcccgcagattccttgcttcctcagtcattttaaagaacattgagggtattatcctctcatatgttaaagagaaaggtgcatttatctataacctttccaaaccctcttttcattcctgaacataatgccattttttccttcttcatcaagagttcttaatattttaaattcatattttttatttgttaacgccacagagtccaaacttccttctttcctctcaaaaatgtttttataaaacatcaaagcttttagttaattcaatttaagaagaaatatctgctggacttgttgattgacttcaagtaaccaaacaactagttgaatgattggatcttgttttttgtttgtttggtggagcatatctgccggggtcttttgaaagtcataagaaagagtaacttaatgactacattgcagattataaagaattactacaaagagtgtgtataccagctgtttttcatctctgctgtgaacagaattatagttgatgcttaaattgcagaggattttgagaataaagctcagaataagaaatagactcttgtaccaacctataactacttttaagctgtttataaatgaaagttgaatttaaattatcctagccctatcctttaaaaatattagcataattttgtttttcatggttataaagatgtcagcttttcaaagtttcaccagtcacatgaagttcatacacattaaactatgtcaatttatgttctttcttatatcaaaacaatctaagatgtactatccaagatgcatatacagttggtaattgaaaaagggaagacaccttagaatccatatgattttgagtcaaaaaacattgctgaatttagtatggcatctggcactctgcttccggtctgacaacttttcaaatcatgggtttgcttctgatggtaaataaatgcctaacccattactgcactgatgcagactctggagaaagagagaaattagatatcactcaagtgtcccattggtttgaggatggtgctgcagatgcttgaaagaggctttctaccagtataatctacttggaaacaactccattataactgggagatactaacttaagtactataaatacatccagatgacataaggagatagaaaactaactgatgtcatagcaccaattcctaaatttcatttaagattaatatggttatttcatatattagtctaggcaaaaatttatcccctttttgataaaaacatgaattcttagctattttattgggagtatatctcctctaagtattaggacgatctatcatggagccgagggggcaaggtttagtttttatgatgttgtggtcaaatacctggcagataactgcagttgtttggtgtcattgagacctctgcatgcctatatcctgttctagaacagagtttattgaagtgtggtccctcaatcagcagcagcatctcttgagagtttgctataaatataaattctaggaacctactcttcacctactgaatgagaaactctagaggtggggctcagccctccaaatgatggtcattcatgctcaagtctgaaaaccactttcctagaggcatttacacagatcctaaggccttttttttttttttctttttttttgagacagagtctcgctctgtcacccaggctggagtgcagtggtgcagtctcggctcactgcaagctccgcctcccgggttcacgccattctcctgcctcagcctcccgagtagctgggactacaggcgcccgcaaccacgcctggctaaatttttttgtatttttagtagagacgaggtttcaccgtgttagccaggatggtctcgatctcctgaccttgtgatctgcctgcctcggcctcccaaagtcctgggattacaggcgtgagccaccacacctggccaaccctaatgtcttttcatgaatcacagtaagaagctacagttcaagagtattccaaaggagccttgctaaactctgaaccacagctcctagtaattccttgagaagtcagagcagcatggagtctacatctccaaagcagtctctcctgagaaatgatccgagtcttgagaaaaatctcaaaattagctatcgggtgtgagtcatgtgataccaaaatgaaaggccattcgttcatttcatcaactgataaacttgagcatctactaagccccagtcacatacctgagctaaggatctcatagtctaagagagaagataagatataagcaaaatcatataatacatgggaaaaatcatcacttccaactgagggaaatcaggctaaccttcaaggaaaacaagctaaaaatgcagctgctgattatttagacaataagtagccacagatattttttaagccaccataacacatgatcagtggtaaggtctgggaaggtaaatttggtgactctcttctccagaaggagaaggaaatggaaagggaagaccactcaaatataattataacagctgagatatgagtagggcctaacctagaatggaaatagaatccaatagatttgtaccaatgaatggcgatgagattattagtaaagataagggataggtggaacgcgcatctgaagttttgacattaaagaaatgagatttttatgttactaaaattaaaatgaaataaaagatgaagaacacagcttgagatgggaagcttgttacgttgtgagcatgtgaagtgtgaggtgcatgatgaagatgcaaattaaagtgttcaggttacaggtaggagtgggggactgtcataattcaggagaaatagaacaggatcatgcatccaaattgaggaggcatctacacagaagtgatgttatggaagttgatgttatggaaggaaaggatatttttaagggaaagtgggctgaaagaaaaatgaagtggaccgcagaaaacatcttgcagaaagacggtatttatgggttggaagagaggtttccatgaaagaagcaggggaatcagagacataatgttatataagcaaaggcgatatttatctgaaatttaccagtatgggtggaccagttgtttacatctcgtctgatttctgaatgctccgttcttactggtgttcatatgttgatatggctttaaaataatcttaagcctagagaagatatgaggcaatgaatgaggatctaattattacacaaccccagttgaggggagtttcaacactttgcactactttgtggcaaactggaaaagaacagattaccagaaagaaaatagcatatgcccaaaataatactacaatccacaatctggcctgaggagtccttccattattagcctgtgactcctgaactacccttagtaatacatttatctcttaggaatgtactatttatttgtctgcatctcctgctaggctagaaactaatgaccaatattgtaaagaaagtttaatatctcataggtaatgcatgtgaatagttaatgaatattttaattaattattaaccgatattatgtactgactttattgtgtgctttcatgatttcttactcaactaaagtgtttacatcaatgagtggtacaattatagattgtactggcctatgggcatatagcttttctatagcaaatataataattatttttggagaaaactagattttgttttttaaaatgtacaactatatgctggctaaagaataaaggaaatgccaaaatatgacacatttggtatgattgtttttcttaaacttttttgccctaaaagctgctgtttaaaaaactcttctatagctgaagtttttattccaagtatcctatagtgaagttgttagtgccttatatacctgtgttaactttacatgtagcaaacacttttctgagtttgccctgaaaagttataatcatagaatgatttctagatggctcaaaattatcagactactagaattaacacacatgtatatatctcaggaagtgaattttagtgtccttgaagtcaaaaggattgtcccaaagccacccagaacaatggtgaagaatgtccctctatcgttgatgtttcatagcccaaatattttaagttctatgcttaatgcagagttcattttattctgaaatttatgagtgtttcaatttaacttgatctaatcatcaagtaatacactgcctatcatcagggaagtgcaatagagagctaaagacattgatattggtagactcagcatatcaacagtatttaaaatttaagtgaactatgaatcttgatatcttagtcgaaaaaggaaattgaccaaagaaagactatccggaagataaatgatttcttattcttagaaacaacaagtgagaaatctgagatggtatattagaaaaattaagataaagataacaaatgattgatagtagtcctcaaatatttaaaattttctcatgtaaaaagggggaagagtaaggagagaaatgagattttagaactaagtttcttttacttacattctacttcttgattcttatgaacaaactgattagcatgatgaaaaataacttggcaatattttatgtgtaagatgagtggagaccagaaaaataatgtctttctataatcattcattttaataatattctccatcccaatatgcaagaactgactcctagtaaaaaattaattctcacaagtttggttttattttctccccaacagaaaatcaacacagcacacataatctaaaaaatcattcattcacaattaagtcagttgccgttttctctctcttttttcaactgggtaaaatggccaagggtagaatcagttgaacgtaagagcatactgatatccaaacatatggcttttacaagcagtcaagattctctgtgatctgtgcatcaaaaatggtgaaattctgctgggtgcggtggctcacgcctgtaatcccagcactttgggaggctgaggagggtggatcgcctgaggtcaggagctcaagaccagcctggccaacatggtgaaaccccatctctactaaaaatacaaaaattagctgggtgtggtgacgtgcacctataatcccagctactcgggaggttgaggcaggagaatggcttgagcctgggaggtggaggttgcagtgagccaagatcacgccactgcactccagcctggacaactgagcaagactgtgtcccaaaaaaaaaaaaaaaaaaaaaaaaaaaaggaagtctgcatttcattactcttttcattgatttttctcctacttttttcacaacaacaaatcaaaattcaaccctttgtacctccaaactagttttagaatcattgaactcaatgaaacttaatgaaggcttcatttttcggtctttcagaaatgggacatttggagacgtttatgaaaaaaagtgcatgttttcatgtcctattgttatctttgtagagtagtgacttcgacttttctttggaattttttgacagacaataaagattatgatgcatacttatcatacaccaaagtggatcctgaccagtggaatcaagagactggggaagaagaacgttttgcccttgaaatcctacctgatatgcttgaaaagcattatggatataagttgtttataccagatagagatttaatcccaactggaagtaagttaatgttttcatttgagagtgtgcatattcatgtgagtgtctgtgtagtcatcactttttcatggaattttaatgtttggttctttacttcaaaatttgtatctgttagtttccctagaaagaaacgtctttgtgtgttcacatgaaatttaatttttgctagctcagagaaaagatactccattactgtataaagcatctcattttgtgagccttgacattgaaagaaaccaaatgagagatttgtaccgggaaaaaaaaatattgctgacattaggagaagcaagtcccaaactctattcagtgaactagtttcatttaatttctgaaagagaatctactaggactttctggaccaaattttccattcactcattttgatgcactcttttatcttttgtagcatacattgaagatgtggcaagatgtgtagatcaaagcaagcggctgattattgtcatgaccccaaattacgtagttagaaggggctggagcatctttgagctggaaaccagacttcgaaatatgcttgtgactggagaaattaaagtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagccactgcccatccagatctccgttctacctttcacaacacgtaccattcacaaatgcgtcagaaacactactaccgaagctatgagtacgacgtacctcctaccggcaccctgcctcttacctccataggcaatcagcatacctactgtaacatccctatgacactcatcaacgggcagcggccacagacaaaatcgagcagggagcagaatccagatgaggcccacacaaacagtgccatcctgccgctgttgccaagggagaccagtatatccagtgtgatatggtgacagaaaagcaagggacatcccgtccctgggaggttgagtggaatctgcagtccagtgcctggaactaaatcctcgactgctgctgttaaaaaacatgcattagaatctctagaacacgaggaaaaacagggtcttgtacatatgttttttggaatttctttgtagcatcagtgtcctcctgttttaccatgtcttttaccattacattttttgactttgttttatatgtcgttggaatttgtaaatttacattttttttaaagaagagactgatgtgtagatagaaaaccctttttttgcttcattagtttagttttagaatgggtttttattttatttccttttttaaaattttactttgcttttaacatttccttggggtgcttggacaaatctatccgatgggacaaggagcaccggattctttctcgggttctgcctagcatcaactgggccacgtcggccttcagagaacagtgcaacaaatgccagcattgccattcgggggaaaaaaaaaaaaaaaaaaaaaagatgagaagaacacttgttcataggagggccccaccagtcagagccctgaatctcttccttgtcccacctcattccccacctctacctttctaatggcggcatgatgtgtaaactctgtgcaggggtgggggcgggtctaactgtcttaacattcaagtcactgctcttcagaatacactctagacccaaaggtgtgctaatcacttcacagtgaccactacagagtactaagaagagaagatcaagggcatgaaattggggaagagtgttatttccgttttttaaatgagttgatgtacccttatatatatatacatatatatataaatataaatatatataaaaacaacaaaacaaaacaaaaaaagaaaaaaaaacaaaaaacaaaaacaaaaaaaaaaaaaaatcaagccctatatttgatcacttcctggaaaggcatgaatgtgtttgtggctgtttttgtttaatcttctacttcctcttttccctctataatttctctgcaaatgagattctgtgcaaatgccaggcaagttaattcaaaagagtgaatcaacgcaagtcaaaatgaaatttacactgaaggcttccaaaccaaagggaaggacaggatgtgtcatcaaatatgttttgtcaccttgtattatacaaaatgttattttctaaagagtcagagaaaaatctgtgaaacttattgtgcggcccccttgtaattaaatgttaactcccttgtatttaattttcaacactacattaagaattaagtggtttcagtttgtggacataagcaacacttattaatatcaaggtgtttaagaactcaggaggtcaaacatatgaataccaacagagatcagtattttcaaaataaacattatttatacaaaatagtttttaaattagatcagaaagtatttaaaataattaattttactgtataaagaatttgctttattttagctatgtaattctatctttcagaaaacagaaagctgatgctcccaagaagttcatcccttaccatttagctttatgtttgaaatcaatgacataagcagctaattcatattcatgtgaaggttgatgcaaaatcaatcacaaaggaatctgcagagggcagagttgttaaaaggaaatattacctatgtagcttttagtttttaaaaaaaatcaatgtgataaaaacactgataatagaacttatacattaatttagtgattcattgtaggaactcccatcccagtcatcatctgtgggcctgtgtagtgactatcgtacgtttggtttattcctaccaccatttagtgagaaaacaattctacacttttggtcacaatagtaaggtggccacacacacacacacacacacacacacacgtgtaaactgcaatagggttcattggggagggtgaggttaatttgcaaatatatgaagaagaagtgtaagcatttgtaacaatgaaaaggtctcagtatctgtgtgacaaggtaaaggagccttgggatgtgcattgattattatttgcttaaaaattgtttatttccctgacaactcgcctgtgtccttctctataatctgttctttattcccgtgctctccccttggatctgtgtcacattttcacaaaccagaactgaagctgcaaggacacataaaactttaaggtcagctttgcacattgggttattttcagaatctgagaaggccattgtttactttgtactatggacagctgtcagggactggtggcagtgtacctcactggactggattccaaactcccccagtgctcagaaaactgtaaacgtggcaatggcctgatttatctctttgttttttaatttttcttttcagtgcacgatggaagtgtggaataaatgtagaggaagtaatcagaccacagtcatattttaggcatccataggtgttaatttagctgcattgggagtgcattttttgttctatttttagtgtagatttaagcactttgaatagcatgattcagggattgatgggtaatatttgatattctcacaacttatgaaacttctttttcctctaatgctttgtcatatttaaaaaatgaaataaatgcaaaagaagctatctatagctttagaaacattcctcccaagtattcctctatcagctccatgtgagaagaaatgaaggaaactgtcatgtgttcacgtgctctatgtttaacaaaagttctgttagaactcacaataaaaagagaaaaaaatcaatgtcccctagtgcttaggtttcatccttcgcttttttcagtgggggctgtgggggataagaatattctagttgtaaaaacacagttgaaagtgtgaatatgttagccaagctgggggag

SEQ ID NO: 14186 - DNA, 125536 bp, Human
ccaggaagctgtcatcacctctcttcattatactaattgctctgaagatgaaataaggtttgtttctcccttcttatcctactcacagacctagctctgctacttcagaatagcatctgctatgggtcaagggaggcattttcccccctcattatacagagactaaaacaggaccatagcacgtgaataactcaccctggtccacagccagtgagaggtagcccaatgtcccagcaactgtcctcattcgtcagggtgccccagtggctgcctttatttcagccaggcatgcctcactctctcccatacaagcagttctcactccaacctttgtataattttttttttcacaatttcttcccatcctagaacagcctcttcctcccaatacccaccatactatctgagcatagttaggcctctatgcccactccagcctagtctctctcccctttactctcactgccctggacctcaccagagattagcatcagtgtcctgttttatgacctaattatgtcatgtgcattgccttgcctgctgcaatacatgccagcctgctcgggcaggccaaatcttctatcataatactacggggatattcccatagcaatgtagttctgaggccataggagagatggatacatagtttgtggctgaagtctgtgtaatctactaggcttaaagcatctcttttctgcatgttttcaagcaaggatgctgaattctacatgtaatgatatgttataaactctacacacattggaacctctcacatcctctcaacccacctcttattccagccccctctgcagcctgtttcccccggctgtcccccaccccccaaccctctgagaaacaacctgacagcgcctcaccttttgccatgctatgcacccagggcttctaagagacaaggtatgggaccatgactgaaactcaccactgctgtagaacagtgcagaggagttaataaccctaggatctcccttaccaacagggaaggataaagtccatggataaacgcttgccccttttgtcctcgacagacagttctgaggctctctgaggttcctgcaggactgagcaccttttgttaaggccatggccaaggcaaccactttcccttcttccccatttggctctgaccttcaatcttgctccctgctaggcatttccttccaggctctgctttctgcccctcccctccccctctcttatgttttaatgactaatgtcaaggtcccgctgaggaaaggtcttatatgagcctgttctcagaatattaaacgcttccagtgttctgctggttatttgaaggaggacagttagaacgactacattctagccagggctgtcctacttgctagagagtaacttttgctggattaggaagtaacctagagcaaagcacttcgactttctgggcagggtttctcagctgtaaaaatgggataatagggaccccggctactttgcggggcttgggggatcaaaggagttggaaagaggaggttatttcaaaaccgaaggagctgaatagaagaatctccgggttactctggggcaaggaaggtggagaccacggcgtggcccctcaggtgtctccagtgctccacaagtcaaaggagtccaggaccctcccaaagcgcctgcgtcgcggagcagctgggttcactctaggctgcccgctgcaaatccgcggtgtttaccagaatccaggtggtttgcaaacccggatgtcaggctccttgtcccggagattctcaaatcgctcacccacaactcctcttcggcctcccccagaaaggagagagcagggctgcaagctagaggagcggagagtgtgacccgagcagcctcactccgcctgtccccaccccaaaggcaggaatttctgggatgggcagatggcccacccctcctcctcctccttccccaagccgcagtgggtggggcgaggaaaacctccgcgactttcccgcatcccagcccagagccccgagtgtcggttcactgtggagacagcggtggcggagtgggtctccagggctctgggctggcaaggcccccggaggggtggggcgcggaggaggctacggatccgcttccgcgcggcggggccgggtgcttgggacgcggctctgggctcccgggataaggggctcccgggacaaggggctcccggagagcccagtggttagcgatgctgctgtcgccgtcgctgctgctgctgctgctgctgggggcgccgcggggctgcgccgagggtgtggcggcggcgcttacccccgagcggctcctggagtggcagggtgagtctcccagggtcggggactggatcggtacgttggggaggggggtcggggtggtcgaaggagaggaagaaggggcgaagctaggggccaagctggcgggcaagggcggccgcgtttgtaggggttcgtgtgtcagcagtcctgagcatggggggagcgggtggtgtcctgcagcctcttgtctaggcccagcaccccacttgcgcggcccggcaccctcctggctcctgcgggggtcgggcggcgggggcgggggggcttggtctcgcaggtaactcctctcggctctggcgcccggagccagcccgggataggagtgtcggagaagtttcaaaacggaaactttctgagagctgcttatttgggacggataaatgatagcaaaaagatggctcagttcgtccccttgcaaagcaagcgctcagggtctgcgtcgccacctaggagtgacccccaagccaggcctccccagtccatcccttccttaaggaaaactttttttgtttgtttgttttttgagacagggtcttgctctgtcgcccaggctgtagtgtaatggcgggatctcggctcactgcagcctccgcctcccggggtcaagcgatcctcccacctcagcctcccgagtagctgggaccacaggtgtgcgcccgcacgcccagcaaaatttttgtatttttggtggagacggagtttcaccatgttgcccaggctggtctccaactcctgggcccaagtgatccgcccacctcgtcctcccaaagttctgggattacaggcctgacccaccgcaccccgcctgaaaacatcaggccaggtgagggagagaagccccagtggctccatgaactgcgtgatctgaagcctttatgccttagtctctctcagtggaaaaacggggttcaattcagcaaacacttattgagcacctactacacatgagactcagaaggttgtgtaaagagagggaggagagatttctggcctgcaggggcccgcatttgagaatgggccacctcaggcagagaagcctgcgcctaagtgcagaagtccatatatgcaagtaggagggggacaggagggagttaaatatgccaggaggagcctccagacagcctccatcctctctgcctttggagataagtttggagagaaggggtaacacaagatgtgatcaatatctgcgttcacattttttcctccacagtagaatatgtctacatttttgaggtagtcttttctagactgtgtttcctaagctccctggaggcttaatcaggggcaggtagaacaagaccattcttattctaaagtgaccaaagtcagagatgctcttaccttcttggtcaattcagaaaattgctcctgtggatgcacatctgatcctgtagtatgtatgattccttcccactaagtttaccatgcagtggttattcctttgcattttaaaatgtgggttttgcctgggcactaggtggtagaacagggcagcagcccacaggacagaagttggactgggccacacagagagtatgtgctggtgatcctccgagtgaagggctaatcccttctatatgtagcagaaccaaatactggcctgagacaaattctcatcagtgccttctttttagtagtcaagggcactctgaaattagagccatctgctagcccttgtacctactaggtgcaatttgcacatctgaaaaggttgacatagttggcatagagattcttcagatatgaaaatgctgctgctgattttccaaggagcacggaggttatgtaccattcctcgcacaggcacaggctctctccctgactccagtcacctgcatgagtagaatttcaagtgtaagctggacaggtttgaagtcaagtttttactgtcaatacaaaatggaaaaacaaaatcttaacattgaaaagaacctgagacattgtctactctagccctctattcttcagatgtggaagttgaggtatggctaccatgtagttagccatgctttggggtgcctcagtttaccgctgtgttcactgtaccacattgactcactttagccacgattgacatccacagagcaactgagagaaaaatgcacactcattttcatttccaatccactaataatggctatgtaataatgcacagcagattatacatacagcattttttatctgaattgtttgatatgtattatttgtagatctgatatgtattacaagcatgccagccttgggaggcagatgatggattgtactgtgatgattttccaatgatttatcaataattcttgatatggtttggctatgcccccacccaaatctcaacttgaattgtatctcccagaattcccacgtgttgtgggagggacccagggggaggtaattgaattatgggagccaatctttcccatgctattctcgtgatagtgaataagtctcacaacctctgatgggtttattaggggtttctgcttttgcttcttccttatctttctcttgccgctgccacgtaagaagtgcctttcgcctcccaccatgattctgaggactccccagccatgttgaactgtgagtccaactaaacctctttttcttcccagtcttgggtatgtctttttcagcagtgtgaaaatggagtaatacaattctgtattcaaaagtcagtagatacagtattatatagtagttaagttctcgggcttcagagctagacgatctgagttcaaatcctgactatgccatttaccatccgtgtgaccctggacaggtattttgccagtcagtagctcagtttcctcatctgtaaaatggagctagtaatagtacacatctaagtgttgtccttttgctgctctctcaccatggcaccctcttcctctggccaatccagacattttgacaggttgacagccccataacaattacttactacggtgcacagcactgtacttggcaggtctgaaactcatctcctcctacctctagctcaggcatccccaacctccaggccacctaccagtttgtggcctgttaggaactgggccacacaacagaaggtgagcaacagtgaacaaaagaggcttcatctgtatttacagctgctccccttccctcacattactgtctgagctccacctcctgtcagaccagtggtggcattagattctcaaaggagcataaaccctattgtgaactgtgcatgtgagagatctaggttgcgagctccttatgataatctaatgcctgatgatctgtcactgtctcccgtcaccccagatgggaccgtctagttgcaggaaaacagactcagggctcccactgattctacattatggtgagctgtataattacttcattatatattacaatgtaataataatagaagtaaagtgcacaataaatgtaatgcacttgagtcatcccaaaaccatcccccaccccaccaccccattggcctgtggaaaatttgtcttctgtgaaaccagtgcctggggcagaaaaggtgggggacctttgctctagctggttattccaaggagcctgattttagtttgttttccctgatcagaatctgagcccttcttctagcaagtgctaagacacactaacttcactcactcaagtactccagatacaaagtggacagcggggagaaagaagaaggggatggagcatcctggtgaaaactgggcatagtcattgctaaaggaaatgatcagggggcaagtaaaagggttttgaagctttgttgagggttgaaaaatgataaatgtgaaatggtcccccactaatatatcgtaggagagtttccttctgtagtgctcagcttcccagagcaggagtggaaagaacctaagtctgtgtcagtgcctggggacactcaggggaggctcttctaaatgaccagtgatcaaaggaggtgagggtgcagatgagtgtgtggtcagtgtgcttgccatcaggtcctatctggggagaagaaagtgaaacagggttgggtgtacggggtgtctctcgacatgctgcgccgacggaaagaggggtaggggctgatggcctcagttgttcattatctgtcaggcaatatgtgctttatctacctgttttagttgggttcatccaaaagcaattcctgagacatgttttccttagggtgcaagtagtttttttttttggaggtgattctagaaagcatggtaagggagtgaggacatgagaccagagagggaagaaagccaccacagaccactggggctcagtttcacaaaggaccctttgaggaactgtatagaactcagtggacccaccaacgggcaggaagctgaagtatttatccaccaactcccgcctcttattgactaaggtcactcctggggcattcaccccctggtgctcctggtctctcccaggcagagagccacagaaagtcagtgggagtgcacgaggactgtctgcaggtgagtgagctccaggttagagggtgtgagaaggaaaccaacagaatctgctacccacctccagattggggaggtaaaaacatgagtaggatatgacactggccccaagaggctgagagtccagggacagatacagaaacataaacaattacaaaacagtgagagaggtcttatgataaccagggatgagcaaagtgctgaaggcatgcagaggaggcactggcctggggagctggaggctcataaaaagacatttgttttcctaaaggataagtaggcagttaccatataggaaaaaggagactgagcattcctgggaacatgtatttcatgtgcaaaggcccaggatcacgtgtcaggcaacagtaaaagttcagtgagctgaaagttcccttctgagctcttttggattcaaggaaagaggcccactgaaggtcactcaggcaaacgtggagttggttgtaatggtcccaggatctcaagggggacccaggacaggttcttcagggcagccaggcctcctgggaaacaggcactggccactgacatgaagcattactttatctgtttctctctgtctctggggctctatggtggttcctgcttggttgttctttctgttgactgtttctttggctttgactagcaggactttcctctgtagctcccttagcttcctgggaagagtcccttaatttcctaggagaggggtctggttacattcttcacagcatgctagccagttcctgtgctctgccctcaagtcgaaggccttcccctggctaattggccatggtagaggcaggaggtggacacagggatggatgctgcttcatccagggctgtggatggtatagaccaccagagtagggtcccaggcaaaacaagaagcagtgacatgtctatagttggaagcatgagagagatgaggaagagtttggttggaggcaccctgcttctggaaaaagtctggctgagtgaattgggtactgctgagaagggccctgtgggtttgcacaaaggggaaccagattgcatgtttaagtttagaagtgccatgttcagtctgggacttgaagagggtctcctatcaccttgaagagggtaattctggaaggcagcaaagaaaccgtctggatagttaaagctgagctaagtcagtcccaataggaagattgaggagcagaaagtttgggttcaagaaacagggtttaaaaagaggaaaatatatatttaaaaacaacaacaaaagaaaacagttagtgaaagttagatgagggaagattgcagaataggagaggtagtggttatagagtgcaaaatccaagttttggagatggacctattcttggtagtgaccagatccaagctgtgtttgtgggagtggtcaccaaagtgaagaagaggcaaaagaaggtcctcacagcagaggaggtcagggagcccaatgtccagagcaaagctaaagtcgagtagagtttgggactcttttgtcagcaaaccacaataagaaatacattttacatcacaacccacagcatataggtctacatatgtataactgaaacaatgtttcattttttaaaaaatacccttacctaatatgacatgctgctacatttccccctgttccattctgtttcgttttgtctcgctggtcataacacattcagttgatttcaagaccataaatgggccacaacctgcagtggggaaagcatcgagtcagagtgttgggtcatctgtatggaagctaaagtggctttggggtgtggagaatagcggggagtctgctggtatcaaagccatggtgaatggggggaagaatggttcagggcagagggccccagtggcgaggaaggggggtagctgccaccttctgaaagagggcgatgagagccactacctggaggcggcagtggggagaagctgtagccctgagatttcctgcatagcttctgtttctaatacaaaggtaaaaatgcccctctactgcttctagtattttctaacagctggggagtcgttactctttgttgttttatttacatcgacacattgtctcctcaccaaaacaggtaggcaacattaatacatacccttcttttacagatgaagaagggttaagtaacttgtgcccacaggagcttgcagcatggggattcgaaccaagcactctgcactaatgcaaaggatccctgaatagccttgtgaccccatggtgtggttcattctgtatcctgctgcatgacagaagcatgcgatttggtttcacagcaggaagaataggaggccagcctcttgttctctgcaactcctccttttccaaacccctccttccacatgtgggagtgatattttcctaaagcagaaatgtgcaaagctactgatttatgtattgttctaggcaattctgatgtccctaggcaatgagccattctactaatctggaaacggaatttcagtaaaagcgtgatcggatagtggtttagctgcccttcctggccctgaatcatgccagccttcttgactccgtttctcccatttctgtttgtcatccctcgcatttcttccccttcatacttttctcatcctaccttctctgcctggctcctttcctggcaagcctttgtgagtcagcatagatgtccagtttttctggtcctatttactctttcttgttaagcctctaactcttttcctattgttggttgtcacagtaactgatgccacacaatgcaggttccaagcccatcacaggaaagatggggccacacagatagcttagttgtccctgcagctccccttctttgacctaacaatctgcttatttatatcaagttttctgaagaaacggtccccttgtgttgcctcttctgaactcaatcctaatgctgcaaatcctcatgtaatctatcaaagtaattgatttaagacatttataaacccttccctccatttttttttagaaattatccttgagagccttttggagatgttccaacacatagctaggagcataaattatattttgaattgatcaaagcaaaaagaaatattattgttcataaaataaacaaaagaacaccatataaacactatattaagtcatttagggaaaaacattttataaagccactcaagaaaattagaaaattatgattagaatatctgtaacttgggttctgtgacacagagctaaacaagacagaaaagtcatagccacttggctttttaatttatgatactttttagacaactacagttccaaagaaatatggaaataaaatagtgttaccacttctagcttttggtattctgctcttgagaacttttcaatcatgaaaatataaacaggaaactcaaagtaattatttaactatacacattttttcattttgctgctctttggcaccattcatattcaaagttaagattggcttttatttttattaatatttataaagtgatcatcatgactgagataatccctatcaaggccttgtgaggccagcactattatttttttctttttattataaaatttaaactttttgtaaagaaggggtcttgctatgttgctcaggctggtctcaaactcctggtctcaagctgtcctccagccccggcctcccaaagtgctgggattacaggtgtgaactacacacccagccccagcattactattaaacccattgtgcagatgggaaaaccaaggcagatactcttctggttttaagcagttctgccctgaaagaagtgctcggtagtttgccaaggtcttttttacataatgttaatcttgttcaaatgcaaacaaggagagcttcatggggatgtaaccagtgcagttgcacagggccctatactcagaagggccttccttccacttagggtttaaagctccatggtttggggtcttgggattcataatcatttctatctttgaatttgtgtgctgcgcatgatgtccaatggaacaatggaacttgagccagaggtttggagcctctgttcaattctgcctggtgtcccctgtctacctcccgggacgggttctcagctgcctcctcccaactcctgccctacaattgatgctgcctgctgcacacagtggcaaccaggttgcattgaagttgggggactggaggcctgggccctgggagtggatgccttgtagcatttcggggcagtgcaaggcagtatttgtcaccactgtactgatatcacttctgtgggttctgcgagggctgagtgggaacctctcacatatcctcaatccaggtactgtattctaagcacgttatagctcagaggttgcaatctcctgtgggcctgagggaaagggacattgacttgacttccccatgtccagccaaaaccacgtattttcattgcaccctggaccctgcaaatgatgtagacagcctgaataagaatgatagggatggttatgatctgaattgttcccccccccccaccaaattcgtataaaaatgagactttacttggagatagggtcttcacagaggtaaacaagttaaaatgaggcagttagggtagccctagtctattatgactggtatactcataagaaggggaaacttggacacagaaatatgcatagagagatgatgtgaagagacacagggagaagatggtcctctaggggccaaggagagaatccaggaatccatccttccctcatagcccttggaaggaaccatccctgccacactgtaatctcacgcttccagcctccagaattatgagaaaagaaatttctgtcattgaagccactcagtttgtggtattttgttatggcaaccctagtagcaaaccgatacagggactaacactctatctaccactaaaagttgtttgtttgtttgtttttttgtttgttttttaacatttctaccttgcactttagtaaatgatttttcttttaatgggcatactcccaaggcggctaagatggatagctcattgtaagcacttttgttttcagtaatgccatatcatttccggagttgttttggttgatgatggagttgttttctggttttgttggtttttgtgacccagtctttgaatcatttccccctgggctttaatatgcaggcatttgtgagggcatcttaacagtgttctgtctttttgtccttgccctaacttgcactttgtaatgaggcacccttttgactgagatggtatattttcaacagagtcaataagataatcacagagctgttgtgaataatgatttttataccagcaatgtttgttaagtactttccagttaaataaaggcaaaacaatgggagaatagactaaaagctaaaaggaagaaaaatgttttcaactcagtttaaaaattcattggtaagatacagaggtctagcaaagaatcacggaagagagattttctgccagggtcagcaactgctaaatgaggacagagcaggaggacagaggagggaacgggaatggccagggagtggcaaggacagtctgaaagggttaacccctcctggcacaggggttggtaacagacaatttgaagcctcacagaactgcagtccggtggcactgattatgctgggtttcatttttccctcatgtgagaaagactattgtgtgcctcatgaaacttggagaggcaattaggtgagattagagagaaaatggaagagaacatgtaaaaagatttagcaagagcggtccacggccctgtggagatggtgattatctaggttcagaagctgtaggagaataaagaaggctaagagttaaggacaatgctaggacagggaaagagaagaaagttctgagacaggacaaagaggttttttaaaaaatgtacttgggtaactttttagttgattaatagaaggcaactgacaggaactcaaaagtttcagaataagagacacatgaaaactcagatgatttcagataaaatgcacatttccatgcagagagagaggtaggaagggctggcccacttttcactttcttccgtggatctcttctttgaagaaccatgcacatgctgcttgctgcaagcatgagaaattcctcacttattggtttgaaaggtcatattaagaatacagattttctgcatcactcggccatgaataggacttgattcagcagcttacagtattccttcctgctacagagtaatcttaggaacgtaatcagctctgaatccattgttcactagatggaacagataaagacaaacccaaatttgtgaagctggaaaaggtcagtacatctcaagagagaagctgctcacctccagattggttacagaggagagatgccctccccatttccttctggactgcatccctgctgaaacctaataatgtcagaacagcaaggaaatggacagagtcaagacaggctgccgggcaggaagggcttgagcccagcactagctctgtgggtagatggagtagaagcaatttcaaacctatggactggggtaggagattgaaattgggttgcagcctgcatgctgtggctttctaatagcttgtcttaagcattgcacttgatgtgaaccatgcactggaacttttccttccagttcccttaatggagcagcacagagactgactttatgtgtatagttggattaggtgaacaccttcatggtgtaatttattgaataccagaaagtcctttgtttgcctaaaatgccaccattaaaattgttgttttattgtttctttaaagtgttttttgttaaaaatgcggaaacttcacaaaggcttaacagtacaaatcttatcttactcactttaacacttcaaaccttcactcagctagttctaagagaagagctgtctaaagctaaagggaacactaaaggcaagtagaggtgatcagaaggggtgcagatggtcaagtgcagaggcctcaggagaaacttcctctaggtacctccagtctgctgttcacacagacagatcaaactgtaataatggccccaggctttagactccaacctcatggcacccccttttgcttatatctcctatgtcaaaatatattttggcattagggtataatttctttctgtgcatttcagggattcccagggagaatgtgacttccttgcaggcaaacactatgacatatatatccttctgtctgcagggttcctaaaccatgccacatcaagcagttgatagatctttgttgtctgaaatttcaagtcacctacttcaaaatgtttggcaacaatctatagcagtttattttcttctaagttataaatgaatgcatgtaaataaagctacacctggactgaatatagtagatagatataaaacttctaagacaaaaatggatttggaaaaaaaaaagtgaaagagtggttcagttaaataatctttacagttccatccagctctgaagttcacggttcagggtttatgggtgaagtgagtctcctctgccacacccgtcttccttccagcactgccctgctttgtcctccctagaaagtgggcaagtacatgtgtgtgcacactccccgctcagagtctggtgacactgaggggtcttgtccacctcacatgtgacatcagttgaagagccagttcagggtcttaaatttgggtttattttctttctcttatttgttatcacttggttttttaaatcttttaaaataattgtttattttattttgttttaagttctgggatgcacgtgcaggatgtgcaggtttgttgcatagggaaatgtgtgccatggtggtttcctgcacctgtcatcccatcatctaggtattaagcccacatgcattagctctttatcctgatgctttcccttcccctgcccctgccacaggcctcagtgtgtgttgtttccctccctgtgtccatgtgctctcattgttcatctcccacttgtaagtgttatcacttgtttttaagaacttattttatttatttgttgttttttgtttgtttgttttgagacacaatctcgctctgtcccccaggctggagtgcagtggcatgatcttggctcactgcagcctccacctcctgggttcaagtgattcttgtgcctcagcttcccgagtagctgggaatacaggcacgcaccaccacgcccagctaatttttgtatccttagtagagacctcaagtgattcgcctgccttagcctcccaaagtgctgggattacaggtgtgagccaccacgccccaccattaagggcttattttaaatgcaattataatgttttctttggaactgatggaactcccttcttttcattagctaggcaaattcccatgattccagaacaaatatatacagtttcaaagaacagatatttaggcaaataatttctctctatctctagcatcttacccagtgtctatgaagtagctggcatccaatgaaagctagttgaatgaatgaatgttccatatgcagtcataaaggtaataacctaaacttcggtttaaaagttgatcaatgaaacattctcctcccgctccttagaagagtacacgttatcttatggggccaaagagtggatctgaaatggtctcctcctaaaggaactcagaagtagaaagtagaaccactgtcttccatggattttatttaaaaaaaaaaggatagaaattagcttataagtttcttctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactctgtctcaaaaaaaaaaaaaaaaaaaatgtttcttctaataaatgaatcctttttctcctcctaaacttataattatgaagggaagtataataacattttcctgcaaagagatttagtaattctggcagtacttcattaatcacttaatcagtgttcaagcagaactgatgtccttgacatgtataatcaatcttgattcctcccacatttgattttcatcttttaaaaaatccaacaactatgcacactaaggattggtggcttattttcacattatagttttgttagagacattatgtgcatataataacaatcagaatattgatacctatattaagtctcctcacagtctatttgaaagtaattcttttcagtgaatttatggagattaacagtgctaggatcatattctattataacttaatggaaaaatgggctcaagtcattttttaacttagtatatttggaggcagcatgttgattattattggtgaaccagagctacttgcctatggcacattctgaagaacttttctaaagctatttcctaaaggcagctggtgtggaaatataagtagcaccccaaaattaagcagcaatggattaggtgtgtctaatatgttctgctttggaaaggtatttttatgattgctggtgtgactacagaagttccaatttctgccactctttttctcttaacatttattaatttggaagtttaaaagcattattggccaggcatggtggctcacacctgtagtcccagcactttgggaggccaaggtgggaggattgcttgagcccaggagtttgagaccatcctgggcaatatattgagatcctgtctctaccaaaaacaaacaaacaaacaattagccaggcatggtggtacacacctgtaatcccagctactcaggaggctgagatgggaggatcagttgagcctgggaggccgaggcctcagtgagccatgacagtgccactgcactccagcctgggtgacagagcaagaccttgtttcaaactcaccgccccacagaatatttattcaccccaaatgttaggtttgtaattttcatgtctatttattcacagaccagccattcccgcatctacacactgcttgtcaacaccatgtatttttctctttcgtattaaaaaacctacagtgtagactttacaggtgggtaatgcagaaaatcaacagatgaaggctcttaattcatcattgcacacatatttgaacaaaggaggcaaatattttgttatctggttgtttggagagtatttttcctccataaaagatgatagcgtggtgtctcaggattgtttaaaactaaaatgtctgcacccactgtgtgctgcagaaactgcagtaaaaataagcttttgtgctaacagtgtaagaagagaagcctttgagggatgatgagattagcactctgtaggttcaaccaggtctgcagctggatctatagaccaagaatcaggaagtcagaggaataaagtaataatgatagctcccatttcctaaggcttttcatggtagtatgtggtgtgcttttcatgggttactcaatggaatatccttaacatccctaagaggtcagtaccatacatattcccagttcaaggaggaaagatgaggctcactgagatggagcaatctgcccaaagttacacagcaggtctgtgacagctccacgtgactccagagctctcaaccactagccaggtcgtctacacacctatctgaggtgtataaactgaggcacagtcagtacgttgcagagcttataatacatttgaacatatatattaggtagaagctgaactacaaaaccattatagtaaaataattatcctttaatgaaaaattaatgaactctaggttagctagaaagtgattagtaggttacaacagaaattaaggtaaacattctacccaggcatgaaaaagtgaaaaggagagttggacagaaggttaattatcggactccatatcacattgacgagaggtggatttgattttgaatcactattactaataaccatgcagacaaggccctcattaggaaaacaaatttcctgatctaaatgaaatctccctaaaaccattcattttccccaccccaccccctctcttttgctcttatgtatggtgatcaaagcaattctctgacaactaattcaactcctcaaatctatggctataggtaaggtcatcaactattagatgaggtataccatttattaatacattgacaatctttttgaaacagtatcttaagtgattttggttactgtaaatcagttctcctcaggctgattaactttggagaaaccaaaagaacgtttaccagaatgaagcattgttccctcgtggatccatgaggaggcccgtcctgcactgtcccaaacctctccaaagcctctgcctgtacctgttctgccctccattacatgacccgccctaaaccccagacattggagggaaccctatcttgtcccttcagagttttgaagaatagacaggaagtaaaatagaagaggggaacctagctactgggagaacaaaagagcgcctgggcctcaccagacatgaactgaggtgacttaagcagccaaaggctgaagcagcagcagccggtgtgtttcatcaacagcaagcactgactgaatttccaccatgtgcccagcacactccatacttagaccaaagaaatgagactttgtttccatcttcaaaaagcctgtgagaaaacaagttcataactgttgagtactaggtgccttccaggcccgcaacttgggttaagtcaggtagcaggctggcagctaacatgtattccccagctgggtcccacagcttttccacgggaaactcacccaaatcccttcttccagctccggggaggagagcttaggggcatatcacaaaacacctgctttctccgcctgtccatgtggcctctggtttctgccaccgtaatggtggtccgtcacctctcgtgtttcaaggtgtggtgccatagctagtggcctgggcatctacctgcttctgcctgccccacccagcaagccatctcctactaagagtctatccccatatagcaagaggtccccacctccacccttgtactcctgagaaacattgtattctgaccagtattgaatcccgtatcagatcacaaagcagcatttcactgatagcctttcggttttctataggaacttgatggtagagagtttcattcagtggctcttgattcagcagctgtgttcctaacattcaggcacttgtctgagaaagacagtgttgtcatatccattggcacccagtgtccctccccgggagccctgagtattattaccaatccctctctctaaccaattgtgtgagcacaccttctctgtcagtaacagacctgagtggattggcaggtaacccttgttcccatatggccaattaggtcttagatcagagctctcccattagctccagtaagaccttttatgcttcccaagaaactcctctgttttatgcaaatacagcccttcaggtggaccctgcccaacaactccagatctgtgggaaatggctggcaactgtcgcatatcgcacttagatatgcacactgagatcctcatgacgctagttaattatatatgaaaatttcatgccacatctttgatttttgtttcagataaaggaatatttgttatccaaagtgagagtctcaagaaatgcattcaagcaggtaaatcggttctgaccctggagaactgcaagcaagcaaacaagcacatgctgtggaaatgggtttcaaaccatggcctctttaacataggaggcagtggttgcctgggcctgaatttctccgccccagagcagccattaagcttatatgaatgtgactccaccctcgtttccttacggtggcgctgtaacaggaagatgatcacaggcccgctgcagtactctgtccaggtggcgcatgacaacacagtggtggcctcacggaagtatattcataagtggatttcttatgggtcaggtggtggagacatttgtgaatatctacacaaaggtaaaaataatttaaagaagcactcagggaatggtgtttttttaaggtttgcctataagtaaagatttgtaaagcattacgtgaaagaagtacacgaagcctggaccctcaagggacttctgctaaatacattttagttgcttccttgcttatggtaaaagggttatgagagtctcagaatggacatactacattctgctaaagaagcagaacttctcagaatttaaaggtattgggaggaaaaacatttaactgactctgggaatcaatggaagggagcagaaagaataagcagacaggagggagagagaaaaggacggtggaaggaaaagatctttgaagacttttgtcatgacaaatataataatctctcctcccctgccgccatttctcttattgtaaaaactcatccccacctatggaggtatgtgtccaggacacctccaatgcctcctgatgctggctggcattcatgtgattaatcatgttacaagtcacttgaagagaaatgacagactattgtcgggggttatttggtgtgtgccaagcatggttggtggggaagcatggtttagaggggaatttcattttctatggttatttttgtcatttctaaacagaaaaaaaaaagaaagttacatagttaaattcaaatctcaaacctgtccctcagcgttttgtttggtagctcactctatccatccatccatctatctatccatccatccatccatccattcatcccgcatttttgtatagcactgctaacaaatccaccccacattcatcaggcactggactaggcacctggtttacaaaggtccacaggacaggtggagcccctaccctcgtgctgctctgtagaattatgctttcacaagagcatatgctcctaagaattctgtacggtcctgggaagcagagcaaggaactcctaaagaagaaatgattaaaaagagacagagccaagggccaggcattttcaggactcactaaaataaagcaagtgctgcaaaccagcactctgaataatctacagttctgaagaggaacttgatattttgctttatgttaactttttagccacatacccacactcatggtgcatgcaggggaagattctggggaacatatgctttggagtagaaggaaggggactgaaagaaaagggcatgtcctgaaatacctacggttcctaaatagccctaactgctaaggctggtgactggtgacatgtcatgagctcaggtcagcccctgccaattgtgggaaagaggtggggctctccactgctggtccttttgccccaggacataccattggcagccccagttgagtcatgaaaagtttttgttgattcctgattaaggccaagaatggccgagtattgcaataccctgagaaggcagccagcaggccacgtctgcatggtcgacttgctctagaccactgagaagccacccagccagctgtctcgcttcaccctctccctatgtcagctgtttgcccctttgcaaacagggcatcagtggttctttaaaaatgtaaatctgatcctgtcactttcccattcaaaacccgcaagagacttgcccccaccctcagggtagaggccaaagcccgcagtatggcggggagacagctctatgtgcactgacactctagtacgtccctggctccctacccagagggcctccttcctcttcttcattcaccccctcacttgttcttgtctcaggttctttttacttgctgttccttctgctggatcacctcttttctaaagacctgcactctcaggtcacccagttcctattcagagaggtctttcactgcccatcctgtccaaagtagtgccctgtgcccctccaccccatctctccctctctctcactttctctctctctctctctctccctctgtctcacacatacacacacacacacacacacacacacacgcacacacacaccccactctgtcttctcatcctatttatttttcatcatggcaccgctacctgcaatgatactgtatgtttacttgtatatttgctttctctttctctctccttgatagaagttccacataaaggaacttttgctggtttgttcactgttgtatccccagtactgagtacattaaatgttcaataaatatttattgaatgaataaattaataaatgcctatgaatctattgagctttagatgctaatggctgatgtgtttggcgactggaaggtattatgaagttaaatctccattaaagtttctttctcatccatccacaaatatgaatgttactgtgacagctcaccatagtaagtaaacaagtagataaatgcataagcaaaccatgtatcagcacttcctctgagcccagcactcagtctcacacctctactgacaggagacagtgaggacctgagggctcactctgctgtagtgagtatctgccccaagagggtttcagtccataaaaaatgctttcgatatatagcagtttccaaagataaagctgacatcatacttatctgactttgtacatttctttctcctagatttgcatacaatcaaagggaacacccacgggatgccgtgtatgtttcccttccagtataaccatcagtggcatcatgaatgtacccgtgaaggtcgggaagatgacttactgtggtgtgccacgacaagccgttatgaaagagatgaaaagtggggattttgccctgatcccagtaagaataaattttgtcttctctatatgtcatgaatgaatcaaagatgattagaaagttatctgtatctaaacaaaagcactgggattgatatattgaagtctgaataagaaccctgatgctattaacacagattttgatttggggtttgtttttgccttgaaaagacaattctaatatatattctttttgccgtacattcaagagatgttaattagccattcttcattaagctcagtgcataatgatgttttaaccagaatcaaattataaatactctgcgatctcattgatcccagcttcttggctggatacttcaaaacaaacctgattgcatataaagcccagttagcctttcaatccactatctcttatgagctgctttaatttctccacatccaggctgctgcttgtctcgcccattgtcaagcccaggcaccagctggccccttgatgatctttctaaaatcgcaattgccctcattatttcttgacagtggattctcgtcttgactccctttcctactatttaccttctggctataacctcattttttttcttttcttaacttgattttcaaagttcaatggcagtggcaatgttctaacttctttttttcagttagtgccttattatttcattttatttttatttagctaaaaagtttccaattgttaccaagtattagagaatgtttatatatgcctcctactttctatattcaatttcctttcccttggtttctgtgagtcagagtacagcttttacagtcttcatctcccatgcctgcctcccctccacatatataaaatgcaacaaataaatttgaagcaaaagcaagttgaagagattaaccccaaagaatctgacttataaagtatctgtagaattgttttctaatccaagagctagtatggcttagcaaataagaaagagtataagctttgaaataatcacacaggccaagattggagtcctgcttcctcccaacaatgaaattttgggaagctctctccatctatctgagtctcagtttcctcagacataaaatgtaggtaatagcagtacctattaggattattgtgcaattcaattagatgaggcattcaaggcacttttcataatatctggcacacagtaagtactcacaagggttaaccattgcagccagaagcagcagcaacaatagcagcagcagcatcaaacccaatttatattttcagcatacacttctgaatccatgatttctcctctctgctgtaagtcaacaagcactaagctatgcatagtggtgaatgccaagagttttaggacttaggatcctccctttaaggaacttggcatctagagagaagacaggtttgctgtatgccagaaaatgcaggctgtatttgacacaatgccctagaatcacctgggagatagtttaaatgcatatcctggcccatcttccagagatgcagtgggtgcagtatgtaaaactcaaccatctgcatttttgaaaagtgccccaggtgaccccggtgcagataattcatcatcaagcaataatatggagataattctatgcaatatacatctatatacagggataatatcaacacatttaacagccaatatggtatgggctattggtcaatcgcaatggagaccttagtgtgggggttgggaattccagaggctctctgctgatattaaccccttagctgctacaatgtgggggtggggtgcagggaagcctgggtagtgggggtaatagagaagctcagaacagtggctattcaccaaccagaatgaaagcattttattattttataactgtcagatcaccagccttctctatttgaatctaaatgtatgcatgtaggtgtgtatgcatgtgatctctacaccccttgactcctgaaacagatgtcatattatttttattattgtcatattatttgcatcatctcttctttttccttttccatccccaatagaggtcattattaaaaccaaataaatgaaccaatactaataaagttaacacgtacttcacatggctctaatactagggacttcaaaaaaaaaaactacaatattcttcttaaggttctgaaaccttaagaagtttccactgggaaacttccaatgacagtttcccagtggaagcctgggttcagtggtgctccaggcttttcattccccagaccatctatttgttcagccttgtacagctcagaagcttcctctgcttgacagcctgccagattccagccctcctgccctttaccacaaccagcagagagcatgtttatttgttcagtgccagttttcttcctttcttgttacttttggctcccggtagccaatataactcaaaatgacgtgtcggagattgaaacctgagcaagctgatagctctttccatggggtcaacaagtggataggacagagaagagtgagtggaataaagtaaaggtctgtactgctgtatctcatccttcttatgtgggaaatttttttaaatatctcaatgtaaaatgatgctacatttaaaaaaaaagttgattgtaaatgagcaaaatttaaatgtagtattcataaacacatatacaaatatactagcggtgaaggatgtaataaaacatcttcagcaaaaaggatgacacacaggaatctctctgggtttgtttagaggcaattatgggccattctggactctcttggttgtgtgccttacagagctgcagaatcacacttagttaatttgagatatttttacgataccaacctgtgaaatgatatgattgcccttgaaccttatttttatataattctgatcagttgctcgagtgatataataaagcagatttaggctgggcacagtggctcacacctgtaatcccagcactttgggaggctgaagcgggcagatcacttgaggtcaggagtttgagatcagcatggccaacatggtgaaatcccatctctactaaaaatacaaaattagctgggtgtggtggtaggcacctgtaatcccagctacttaggaggctaaggcagaagaatcgcttgaacccaggagatggaggttgcagtgagccaagatcgcgccactgcactacagcctggtgacagagcaagactctgtcgccgcccgcctgcccccgctcccgccctccacaaaaaagacaaacaagcagattgatacaacaaaggtatggctgctctctcctgagccctcaacatggctcagcaatgctatatgtttctgtcatgcagttctcacaccccacaatgaccctgccaacctctctattctcctctaacttctaaccctaccttccaatctcctttctgattctcattatttgacctcagttcctacctcataatggcaaaaagatccatcagacagacagtttggcaacttcctgctctctcacctttaagcctacctgcatctgtgcccatctttatttcctcccttctatgcgcgaggatgatgttcctcctcctacatgggccaagtctccccacctgggctctggagcgccccatccaaccttctccaacctgtatctcagttgttctcaatgtgtggtccccgttccagcagcgttggaattccctgggagcttgctagaaacgcaaagtagcagtcacaccctagaccatcatatcagaaattctagaagtgcagcccagcaatctgtgttttaacaaacttctaggtgattccagtgcacacccctgggtgcttctttgctgggcccttttccttagcagttagacctgtgcgagtcttgaaataacatcttaaaaatactgcaattctttcatccctatttctgcctcctgaaaacacctctctctctcatcctctaaatagagagaattcgcaaaagaattgtctataccttcttcagggcactgtctcctcttgacttctacaacaatgcatgcctgaccttgacctccatttccacagaccattcatccatttattcatttaacaaatatgtattgaacacctactatgtgccagggacttctctggctcctggggttataaccgtgaatgtgaaatgtgaaagtcatagtgcctgccctgatgaaattcacattcaagtataatacccaaattaatacataattacagtttgtcataagttctaccttaagaaaatacagtattacaagtgagaaaccgaagttaaaattgggagtcatggaaggttttcctgaggaagttgtatttgaactgtagcccaagagatgagtagaagttgtcaaaatggaaagtggggaaatgagatattcacacggagatgcatgatacagacatgtgcaaaggaaggggagagggagtggtcagcatgggatgcaggcaataaagagggtatatggtttaaatagaactaaaaaataataataaaaccaagtaaaagacagcatgcttttgagtcaccaggcacatgctctaaccattccaaacaatgtcagtgataaaatacgcccacctgtccaggctgactgctcctccacccccagccctcagcatgtcactggccagatatctgaaggttttgaggggggaaagaggttattgccatctaagaaagacaatgtggcaagagtacagtgaatgaagaagagagaaacaagacactctgaaagggcagacagagtccatgagtgtcataaaggtaaggacttacctaattctaagtgcaaaagaaagctatcaaaagagttttaagcaggggagtgatgattttaaaaatatatatttaaggattactctggctctattatactgaatggcttggaagggagcaataggcaaatcctggagaccaggtagaaggctagagcaatagtctgggccaggagtagtggtggcttcagttaggtggcagcaaggggattggaaaaatgtggatttattgaagatctaacttgtagataaactgaacaggacctggttgtcaggagcttagctgggctggagacagcagagctgtcaggtgttggagtagctgattaaagcaacaagccaaaaatgaaggtgttaagctgttgatcactcactacaatggtataacaaagagactaaaagaagaattcgccacctcccccgttccatttttccccagggaacagcacagccatcgagggtcagtggatcagcacagatgtggagttcagctcagctcactattgagagaacactaaacaacaacaaaggcttttcagttgtatagattctgggttggggtaaggtgaggggaagagctaggagttgaaaagtactgagcactgagtcagggtggggaaaaagtgtcttcaagattcccctccttcccactccatcccagcctcagcagaggcacctgaagaggaccttggcccaaggcctcacatagaaagagacctaggaatggaaggcacctgcaccagaaatgcaaataacacagagcacgatgggcttgaggggcctgaaccgttaactatgactctctttagaaactgcagtgtgccagctcagcaccaagtctggggtaggggcagctttcccccatgaggcctaccaggtaaagcctttgtaactgcctgtggtcagacctcaagaatcacatataggtttttaaccaggagtaggacttctcactcctaagaacttggaggctaggagaaaaagtgagacattaattcagactccatgtttctgacatgcatagctaagtttatggagatatacatttggaaaagaaaattaaatactattcaggtttgcacatgttacatgtgagtcagttatgtagagatgtggactaggtaggtagatgtaatggtctctatgtatttggaagttataggaaatggacccatgagaacaggttagatagccatgtgtagaaagaatgtatagaatagaaaggaagggggctcagggccaagtcttaaggcctccaacatttaatttgagtagagaagaataaatcagcaagggagactgaaagggggcagccagggaggaataagggtagccaggcatgggaagtcaagaaaagagagtaaatcagcacggagagggaactcagcctgccaagtgctgatgaaggggcttgtttgataaagtctcaaactaacagttgctgaatttggcaacacaggggtcattgatggccttaaacaaggtatacattaatggctagattcagtggatgagactaagtgggaaattagaagaggatgaaacacttcccaagtcattctacgtatgcacttcacttcattaaaaaggaggtgtagtttaggaaggaaaaatcacctatttataacaccatgaaaaagattctggtaatctctcatcacataataggagactcaaagttatatatgacacaattgcttccctggagcccataatttagcaatagaagagatgatataaacacaatcaaagatgtaaagaatataacaataggattttagcccttagattagaatttttcaagaataataaacatacctgagacaccagcctttgattttcagagttctcaagctggggtgacccttcagagttgccccttgttgggatacaggggctaagtataccactacattgaccagtcatggtgtcagctgcccttgggaagggagagtgaaagggcaaagagactcttctgccaaagcagtccttagagagcagcacatcacagtgtctatgacaacattttcattccatttgttacttaaaacttacaaatgagattcctggagggacatgcagcctatcctagagaagcagagaaaggacttgtgtctgccagtacagaagtacaaattcttatacaggctgagtatcgcttatccaaaattcttgggcccaaaagtgttttagatttctgattttaggatatttgcatatacataataaggtttcttgggcacaggacccaagtgtaaacacagacttcatttatgtttcatatatacattatacccatagcctgaaggtaattttatacaatatttaaaataattttgtgcatgaaacaaagtattgaccaaaacccatcacgaggtcaggtgtcgaattttctacttgtggcgtcatgtcagcactaaaaaaattttcaccatgttgcccaggctggtcttgaactcctgggctcaagcaatccacccgcctcagcttcccaaagggctgggattacaggcatgagacaccatacccggcatctttctttctctttttgtagtgatagggtcttgctttgttgaccaggctggtctcgaactcctgacttcaagtgatcctcccgcttcagcctcccaaagtgctagaattacaggcatgagccactgtgactgtcctaaatgattcttatgcatgccaaaactatgaacacacccccgctcccccatcatggtctcagctgtcatggtggatgagtatggctgaactagtgtctcgtaacacgtagtagtatattgtccttctcagggaaggcctaggattttaactgaaaacaatctttaaggattccatctcaatggggaaatttcagccacctgggcaaaatggttactgaaaatttcccttctctttttcctttctttcttttccttcccttcagtgttacttggtgatagccttgtcttctgccttcctttaatcttggatccttctataaacacatgtatcagtcaggaaactctatagacaaccttagatttatatgtgatttaaaacctctggaatgtgtgttgcaaccagacatgaaaataaactttccacatttcccaaggggaccatctaactgttatgagggaggaaaaaaaaccaaacaaaaaagattttattgtcaaataagtttgaagtacactaaattaacagtaagcatgtttctttactacagaacttctcagagccttgaatatgctaatgttcattgtgaatttcccagagaacgctatgtatgcattgtgtccagattttcttggggagcctcttaaagttgtcttactttgggaatcacactttgggaaaggccatcctagacttcagctggttgcctgtcagtcattttcagtcatgctgcagtatggctcacattctctgtattctgacattctctgtctgagtttggtttccggtcattattgtggctacttagttcaccttggagtttgattttaaatgttagcaaaagcacccaaactcagtcttaattttctgttatttcaaaaaaaacttcagacttcagctccacatttcatactttattacatttccttttgagcacactatgcaatcttcggccagtgtcttacaagtggatcttgcttctattcctcttggctgaaagaactttcttaaactatatgtcagtgttcctgtgcttgatgtttatttgaaaacttgtgtttactattgactcatattcctactgtatccttttattttagcattttgtatttagggagaaatgcctttgaaataacatttgtatctactaaaatgaacatttaaagttacaagttttcaatataaagttctaaatgacaaaagaacttagatcttattttcacaaatacttcgcttctacttccttctcttaaaactggttcctattattactctggaaaggatcatagcttcttcattggtgatttcttatatttctttaggtaaatcatgaaagagtttaaccatatcttagcaatggaataacaatgcagattttatcataaagacctaatcaagaatagataaggccctgaagttttagagattgcaagatggaataattccattcagacttaccttagaaatatgttgctgtatagataaaataagacctggttgtttttaatggccattgtttccagcctctgcagaagtaggttgtgatactatttgggagaaggacctcaattcacacatttgctaccagttcaacctgctttcatctctctcttggagtgaggcacattcttcatgccagatgcaaggaggtacgctgttaagtattacagatgaaactgaagaaaatttcataaggggtaagtaggtggatgacgcacattgatattgatacaataaaagatggttgttaactgttttcacatatacaaaaatatattctgacaaaaagttcttaaaaaatatttttctttccataatatggcccaaaactctcacccaaaatttttccatgaaccttgagtgattccatttggcatccagtgatgtctttcttattttctcctccttggagaagagaatttgaggccacagcaagggacccaggagagttgcagttctaacaagtggatcaggaagatttctaaatttaagggctatttgcttgctcttctggagatcttagccattccatttccattaataaatcattaagcattttattaattaaacaaaatcttacatatcattcaccatgtgcaggtacatcataggccttctggtgggtcccaaaaacaaaaccttaaaatttagtgggaaaagcaaaagcacatatatgttaactaacagtatagacaataatatgttaaaagaattgtgccgataaactaagacttatgtttcgcttattgcctaaactctcctcttacttcttctttatagattaaatgtatttgtatgtgtgtacattcacctctttaaaaacttgtggaaacattagaaaatatcacaaaattagtcactttcattaacagtttttgatgccaatgtttttcaaattttattgcatatgtagtccatgtttattttagaataatttgtaaaattcaggtatatagaaagaaaaaccaataaaaaggttcccatagttctgtaatccagagacaactgtgtttctctgcaaaaacatataaatgcatgtgtacatacacagtatatataaaaaatggtattatataaaaacgtggcagcagccaggtgcagtggctcacgccagtaatcccagcactttgggaggccaaggcaggtggatcagttgaggccaagagttcaagaccagcctggccaacatggcgaaatcctctctctactaaaaatacaaaaatttgccggacgtggtggcatgcacccgtagtcccagctactaaggagactgaggcaggagaatcacttgaacctgggaggtggaggatgcggtgagccaagatcatgccattgcactccagcctgggtggcagaacgagccttcatatcaaaatacataaatacataaataaaaaataaaaataaataaaaacatggcagctattgcacagtgatacaagcaagtgatttaaccacctgctcaggttaggagcagggagccacctgcctgggtttgaatcctgcctctaccacttaagtagcagggttactcaagcaagtgatttaaccgctctgtgcctcaatttccccttctaccaagtggaaataataacaatgcaaattcctggtgtggcttacatattttaatacaggtgaaatcatagaaaagtgcctggcacacataacaaacactcagtgtgtgttaaccatttaacaacaactacgtacacagtttggtaatctggttattttatttacctgcatttaatgaacatttgcccgtatctgtaaatatagatctacatcataatttttaatggttacatagtagtataagttagtggtaatatattagagatattgataaaactatttgttttgttatgtatttattagttggtattataaaccatccctgcacaaacctttgtgcatacatccccaattatttctctataagtttgcagaagtgggttcactggatggaaaagtaagcacactttaaagcttttgtaagttgttaatatcttccagaaggattgtaagaaatgaatgagcaatgtgtgcccaccctaaaagtcagaaattattattgaatttgatttgagtaagtcatagtgcaggaaaacatcaattttcaaaatcattttaagcctgaaatggtttttatataaaagtttacatgccatttatgaattacaattatctatcttaactgccaggatttctcatgagaaggtctggacttattcatcaaatttgaataaccatttaaaaaaataagacatgtcagggactttgatttaactacctcagttctataattagtctttgggaattgtttggaaaaacagaagtctgttcataaagacagaaacctgttccaaccaaggtattttttaatgatgaaaatagtctaatgtttcttgctaattctggtgaacatatactatggtacaaggaattatctaagctgtcatgaatgccgagaaatatccaaaggaatttaaattcgagtttcttattacagtatcgtgggccagcttagtcctaaaggtaaatagatggttttttgtgccttcagacacaggttataaattgcacaattattttttatctgcattattaaaacaattgcacaatgggtattcaaaaaaattctaagataagaataattaacgttttaatattttaactagattttaaaatatcacttggcacttgcctggatgtgaaacgtgaaaatttctccctgccctgtcaatccatttcacttcttatcatcataagacctgctaaacgattcaatcgaatggtgctattgaaaggaataatcaaatagacattagaaagagattccatatgaatgccacagaaacttggaagggtgaaacccgtgtatagtatgctgtttctgtttattgatttctgggagtctcaaaattataaagcacctttttctcttttcttaaatgggttagtttctttgagtttttcacaattgtattgaaatatctagtcactgaggatgctgcagccttgttatatgactacaatgaccttcacaacctgggtaatcatacagtctatcatccaaactgagattcttttgatagtaaaagggactgtgattaataattattctggaaataccagcatgaaccatgagttttccaggaaaatgggggcatacggtcaccctgtttataacccttatccgtcagggtcttaatcttaggcaggacccctgcgtctgactaaaaataaattgggctctgaatcaggtgaattgtaagcgaacaatgctctcctttatagattaaacgagtaaatggcaacatttcaaagcatcacaaaattgccactttcattatgtttctgacactaggttttggtttttttccccccgaaattttgctgcataagtagtacctatttattctggaataatgtttaaaatttaggtgcacaaaaagaaaaactgaggaaaaattcccataattctttaattttgataactatgtctttctgcatgtcaatgcatgtttttattcatagtatctataacaaaaatggtattgcattaaactgcaagttgtagtggactggttaagaggaggggccacagagccagcctgccattaaacttctcccacctcaagctgtggaagcagcctccagtttgcactgcacacagccttaggtcccaacctgctagggatcccccgagacactctggtccctcctgttgagcagacatctcctggtggctgtcacactgtacacccctccctgatctacttcagcacaccgttttacctttgaagatgtgcctctgttcactttctgggactgaccctgcacacctcttcctccaccctattaaacctttaagttcatgagctcactcaagtaagatggcctcaagtatgcaaccatgcacccttgtctagattgacaaccctgaaaggcaacctttctgggtacttgcatgaagcattcacagttgaaaaacagctgtcagtgagcctgctctgtttctcaagatggtgggagcctgctttatcactcagaagcaccacgtgcattctgtgcacctttcccgtcattgactggaattagtttctgactccatgatccaggaataggagaacaagaaagatgtgtaacactggattttttttttgaagctccataattttcatttcagagcacatgagcagtaaaacagtggaggtgtggatgggcctcaatcagctggatgaacacgctggctggcagtggtctgatggaacgccgctcaactatctgaattggagcccaggtacccgcagtgttttctttgccttcgtcacgtggcatcatcttgcacccttacacagcagcatttcccatgcacataggacatgcttttttgagagtagtgtataaacattttttagcctgactgaattcctttaaggcaagcttttccaaacaagaaaatagggaccaggaagataagctttttagccaaagttgcaggaggatttgggtgtaagccaagattccagtctgctgttttaaaaatagctacaaattgcaaaatatctctctactttaagataataaaagtgggtcttttggaatctttgggaaatcatttaattgacatgcctggactgtaactgcaaaatcatagataacatcttataggatttactatatatgacaaatagaaacgctgtcccccgatgctgaaaaccacatttcaatatatattaaactaactgcttttgcttctaatattaaagacactcattgtattttcagaggtaaattttgagccatttgttgaagatcactgtggaacatttagttcatttatgccaagtgcctggaggagtcgggattgtgagtccaccttgccatatatatgtaaaaaatatctaaaccacattgatcatgaaatagttggtaagcgtttttattttaagttgttcttaggtgttgttgacttgtcctctcaatatatgtaaatttctctattttttgctaataattcataatgtaaacttagctaaatctagtttatatttatatgaaaagatgtgtaactagacaatatctgttatgtcaaagggactgtgattttaacaaatgcatttaggtttatactaaaaactgaaataatctgagcatagcaaacattttcttctcttttaaaaaatttgcactgttagtcattctgtattagagaaataagatacatttctttttctattctagttttgagtttattgttcccctagaaattaaacataatttagaaaacaattttatataattatttacttcattgattttctgccacactctgaatctcttattagtaacacaccttcctccctgaaattacatgcagaacttttagatggagttaatacttaaataatatctaatcacagtctagtaccagaagtccaattatttctgtttttcaggtctataacctctttttagtttctctgagaattaatgtcttagctccaaatgtagagataaaagtataaccattttttaaagaatcattacaaaaataattagaaaaaactctagatttaaaataataagctgaattgtcatttttaaatattgtctcttagaattgggttttaactttcattttcctttaaatagctaagcctagaagttttgtagaatatggggtacaagctggggaaagaagaagcaacttgtcatttttttatgtagagatttttccattatttcaggaatttgctgaaattgctaccacctgttattgtccttttccctccctctcttccttctttcatattcctttctccgttccttctcttttcattttttctttctttccttcttatgccatcttgcattccctcctgccacccttctttccttctgttatatttatccttctatctgctaattgaggtcagaagaccagaaatgggagtagttaagttagcttgtttggattatttgctttgcttcaagttcaacacattcttctgtggattgattgaagtcttgcttttgtggcccaggctggagtgcaatggcacgatcttggctcactgcaacctccgcctcctgggttcaagcaattctgcctcagcctctcgagtagctgggattacaggcacctgccaccacgcccggctaatttttgtatttttatagagacggggtttcaccatgttggccaggctggtctcgaactcctgacctgaggcagtccgcccacctcagcctcccaaagtgctgggattacggcgtgagccaccacgcgcagcctaaaattccaagttcaaaaaggatttcatgagtgcttttttaggctgaaaaccattggggtcaatgatatacaaagttctaacactctttggccatgattctaattgctgccagagtcctagaaacaattttaaaagaatgttttgtttcccaaatagcagtgaaatcatatttagtttaactaaattcgttcttaatggaggcacctcgttgtggttaataaaataaggtaaaaatgccatcatcagattggggacagtctcgtgagaaaggaaagccaaaataagcatgtgcatcaccactgccctccaatgtccaaaacatcatggcactgtgttcctgaaagccccacctggagtccatatcagcccagagcaacatcgtggacactcaagacttattttcaaagtgaaacctatttgtcatccccattttaaaggaagtcatcagagttttaggctcttttcagctggggataaatatctaccttacccacatactatgtataaaatccttggaataccatttaaattgtattccataatacttcttttaaatataaaaaggtttcaaaaatgagcagctctgttaaattttatatctagccccaacactctgctttcattgtatgtcctctgtcaagtctctttacttctttggttttgttgttgttgttttacttttttactattttttaaaataaaattgactgtgtatgttcaaagtattcaacatgatgtcataggatacatatatagatagtaaaatggttatcttagtgaaacaaattaacacatccatcatctcacttagttacccatttcccccactgtgacaagagcaactatagtctactcatttatcaaaaatcctgaatacactacattaactatagtcctcatgctgtacagtagaccttcagacttgttcatcctacatatctgctacttgtatcctttttcctacctctgctcattttctctcgttgactcctataacattttatccattcagccattctgtgttttgattagataatttaatccatttgcattcagagtaattattccgataggtaaagacttactactgccatttttttcattgttttctgcttgttttatagattctttgtttcttccttcctctcttattgtttacctttgtgatttggtgatttgtgtgtgtgtgtggtgctaaatttcaattcctttctctttatcagttgtgtatctgctatagttttttttttttttttttttttgctttatggttaccatgtggcttacataaaacatagttataatggactgttttatactgataactgcttaactttagttgcatacaatcactctagatttttaccctacccccaatagttaaaattttgatgtcgctatttacatcttttaatatcgtgcatttcttaatttattgtagctatagttatgttttaccatcttggttatttatttatttacttatttatttatgctttagagacggtgtcttgctctgttgcccaggctggaatatggtggcatgatcatagcttgacctcctgggttcaagtcatcctcccacctcagcctcccaaagtgctgggattacagccatgagccactgtgcccaatctatttttgacaattttgactttaatcttcatagtagagatataaatgatttacagaccaccattacggtatttgaacattctgaatttgactatatatttacctccaaggaagaaggggtactctggaggtttggctccagggaacagggcacggctgtaacttgggaagcagaaccagtatggcacagtggcaactcaagctctaggggatgaagcaccaggcagtggtgactccggaccctggggtggtgggacacagcagtatctcaggctctgtgaggtcaggttcagtagcagcaaggacccaggaatggtggcatatacctgtggtttgtttcctgggggtcaaggagcagcaaaatgatgactcctctccctgggaaggtggggtgcctcagcagttcaggctttgtgggactagtccagttccaggaaggcaaggtgctacagctgtttgtgttggagggcaggatgtcccagccttgccaatgctgtttcccttggatgcagggtaccacatcagccaagccctacaaggcacagctgctctgctcagctcagccaaggcacccattcccccatgagatggggctgcttcagcttaggtgctggggggtatgactgctttgggcagctaaagcactgtttcccctggatttgagagccacttcagctcaggtgcctggggtgtgactgttttgggcagccagggtagggattccctgggaggcagggtgccacttcagcacacacactggggaacatgactactctgggaggccaaggcaccatttctttggaggcagggtgataagccagctcaggctctgaggggcacagcacagcaacaaccaggaagggtagatggagcagctcgtggcaacttggccacaccaggtagagtgagagccccacagcagcttggcatggggatggtgggccacgaggtagaagtggtgcagtggttacaaagcctcaaggatggaggggtgctgtggctactcactactggagcagaacatgacattctagcagtggttcttttttcaacattgtgcagcgcaatagacccatagtccacagagagacagggtgcagcatcagaactttctctgaggcaagcatagtcctgtagactccaggcagctccctcaaatgggcttagtgcctgtgggggctgcaggggtcctcagtggcaagaactgtaggtgaccctggtggtgttggaggctgctagggtccccttgctcttcctttccttacagagagaagtctctcctggctctgagctgcttataacgggggttgggggagatggtgggggtgggggcagcaagggtttctgtgctccgtgttgtttctgctactcccttgatgtgctccagcactctccttcagctgccttcgtgaaaatgtagtcatttattcattgctttggctgttcctgtggcagggatgagatcccaggtgttaccagaaaggggtcctgatccaaaccccaagaaagaattggaggcgaatccataaaaggaaagcaagtttattaggaaagtaaaggaataaagaatggctactccataggcagagcagcagcttgggctgctcagctgattacacttacagttctttctcgattatatgctaaacaaggggtagattattcatgagttttctgggaacggggtatacaattttcggaactgagggttcctcccccttttagaccatgtagggtaacttcctgatgttgccacggcttgtaaactgtcatggcactggtgggagtgtcttttagcatgctaatacattataattagcatataatgagcagcgagggtgaccagaggtcaccttcctcaccgtcttggttttgatgggttttggccagcttctttactgcagcttgttttattagcaagctttcttgatgagactttctgtctcatcctgtaacttagaatgcctgacctcctggaaatgcagctcagtaggtctcagccttattttacccagctcctaaacaagatggagttgctgttgttcaaaggcctctgacacaggtgtctctatcggccatcttgctgccatccctcctctccttacttctttgtaccttcactagctcatccggaaaatgaaatactgaggttcatttgatcctagatctaaatctagatcatagattagacccttctcaactctgaagatctagaattccatgatatatgtcattttgtatatttctgtttttcacatttttaaagtaatcatattaatggcaatttacataagctgtaataagtaatgttaaaataattgtggaaaatgacattgttttttgttggtttaaaaagaaaaagatgcgtggaaatattatgctacccactgtgagcctggctggaatccctacaatcgtaattgctacaaacttcagaaagaagaaaagacctggcatgaggctctgcgttcttgtcaggctgataacagtgcattaatagacataacctcattagcagaggtggagtttcttgtaaccctccttggagatggtgagtcccagctgcctttggtttaaaaggcataaaatataatgtagtaactacttttattagtggagttgaaaagaaatttaagctatttaaaagtggttattcattgcacatatatttaaagtttctaaatgttattcaggagttcaaatttattggatttttacaaaatacatgttcagaaactttgtaacatcttcatatatgccacatatattagatgatttttaaatttttggaaagtaggaaagttcatttcctaaaacttctaacgaaaaacctaaacctgtaatttagctttatggccactagatagcagtagtgtgttgttaacatgtaatccacataataaagggaaccccttaggcaaataattagatgtaaacaattttcgccagtgaacatgggtaatttatttggtgaggtgatgttcagactgttccccatgtataggaattttaggctcctggcttccgcacagcctgagtccctcagagttggcctgctcttcactgtgtcatgtatttgacatagacttatgctgaaaaatactgaaattatttatttcatttttcagttttttaaaaatacaaaaaaatgtccaggatctcctttgatgaccttttcaattgttacattttagtttggagtaaaaacatgcatccttctctgttatttttcctaatcatttgcatttgggattaaagaaccctgtgggctgcttatctcaacaagggcacttacacatctctttcagccacatagggtcctttcctacctaggctgtcaagttttaattacttttgcagcaactccatttcaatgcctttaagaggttttgctccttttttcctatggcagaaaaaagaaaaaggaaaaaaatactttaaaaaataggtttaagaggtacaagtgagtatttcttacatgcatatattgcagtggtgaagtctggcctcttagtggccccatcacctagatggtgaacattgtacccaacaggtgatttttcaaccctcagcctcacctctgctaccttttggaatctccagtgttttttatcctgctctgtatctccatgtgtccccattgtttagctcccacttataagtaagaacacgcagtatttgacattctgagttatttcacttagcagaatcgcctcaagtgctacctgtgtgcgaaagatatgatttcattcttttctatggctgagtagtattccatggtatgtgtatgtgtatatatatattccatattttctttatccaaccctcctctgatggatacttacatgattccatctttgctattgtgaataatgctgtgataaacatatgagtacaggtgtctttttgatataatgatttttttccctttgggtatatacccagtagtgggattgctggattgaaaggtagttctatttttagttctttgagtaatcccagtactgttttccataaatgttgtactaatttacattcccaccaatagtgtataagtgttcctttttttgcatcctcaccaacatctgttggggaaaaaaaaactcctatctttaagctagactatcattaaaagtttgtttgtttcatgcccttttcataatccagtgggccttcctatttttcctttctctaggcagaagcaaaaccagatttttcagatctacttaacatacatacatggttctagcagaaaccagagccccaggaatccaacttgcttaggctttgttgttgcattggctttagctcacattctgcctcacttataaggcctatatcaagcagatctggatattatggggatgtcttagtccattttctattgattatagtagaatacaaagaaactgagtaatttataaataaaagaaatttatttcctacagttatggaggctgggaagttcaaggtcaaagggccacatctggagagggtctccttgctggtggggattctctgcagagtcccatggtggcacagggcatcacatggagagggggctgagtgtgctatctcaggtctctcttcctcctcttataaagccaccagtaccattcccatgagaactagttaatccattaacccattaatccattcatcagggcagagccttcatgacccattcaccccttagaggcctccttctcaatactaccacactggggattaagtttcaacctgaattttggaggggacaaacattcaaaccatagcagggaagggaaaatgtttaaacagacattttataccaagacttaaacagatttcatcatgcaaagaaataaagaagaaatcacatgtgaagtggtatattttagtaataactccagggtgttacctcctttgcaaataataggatcccataagtaatttacatttatctcttacagaaaatgcatcagaaacatggattggtttgagcagcaataaaattccagtttcctttgaatggtctaatgactcttcagtcatctttactaattggcacacacttgagccccacatttttccaaatagaagccagctgtgtgtctcagcagagcagtctgtaagttgattcatttgttcagtgctcactttgctggtcttgtactgaaggccacctgtgttggagctttgggctgtggcagagaccaagacaggtgcagtccctgttcctcatgggccttccatgttagagagcaaacaagtacacacagaaaaaacatggtaattatagttgtaatgattgctccaaggaactatgtgacatgatagtgaaaagcttgggttggggcaggacaggacagccacagaaagcatttctgaaaagttaatatttaagcttggacttaaaaaaaaactctcagagagaagggggaagaatattctaagcagaacatgcagagggtagcaagtgcaaaggcccaaaggcagaccaagacttgccatgttgaatgatcaaaaaggagaccagtagtgaggaggtcgtaagagatgggcagtaggaattctaaaatgccaggtttctagattgtggtataggaaccaataaagtacttcaaggaaacaaagggcatgacctgatttacattttacaattaactgtggctgctacacagagaatggttaggagaggaataaaatggaagcagaaaagccagtttggaggctacaccagagttgacttagggtagtgactgtgaagagaagtggacagatccaagtgtgctttggagaacagaaggtgttgctaagttagatgtgggggtgagagagaggtcggcttttggcttgagcaaccatggttttggtgtatggtggtgccattgactgctgtgatgaagatgaggggaagaactgagggatggaagattactctggagagtgatggtttttaagctccattatgttattcacataaaaggatttaaacagtatgtgtaacctctttgaaaattgtggatcagtggcaaatcttgctttttttcctcatgtggatggagtggtccccgtagcctgaacatcacattcatccctatgttctagtctctcatttatctaaagcatctgattatacagaattagcttaatcccaagccatttgaacagtttattatgcctaaaacagacttaatctctttgatcaagatagctgctgaatacactggctgagttttagggggttgttgggatttggtagatgtccatgttcttctaaccaccaggatactctgtcaggttctccgaagaggcagtttattaaatgttactgatgtggcttgacaaagtaattatgccagcaaaacaggaagcatttctaagcacttaacttttgtgacatgtttcatggttccatcttttaatgctagcacagacaattacaattgtacagtgcagtaacaattatacatgctaaggcagtgtctctcagccccatataaaggagaaacaatacctctaaatgtctgtcctgggtctagctctgctgaaatccaccacaatgtttgtttgtttgtttgtttgtttgtttgtttgtttttgagacagagtctcactctgtcacccaggctggagtgcagtggtgcaatctcagcttactgcaacctctgcctcctggattcaagagattctcatgcctcagcctcccaagtagctgggattacaggcttgcaccagcatgcctggctaatttttgtatttttagtagacatggggtttcatgttgcccatgctggtctcagactcctggactttaccatccttggcctcccaaagtgttgtgattactggcatgggcaaccgcgcctggcccaccacagtttattctacagtatctgctgatttattggttcattagttttgatataatttaggtgatcatttcttattgacaggcatgggtatgttgctctgcaagtttacagaacaggagccaatatttggacagagatttttttttaagagattgatgataggtattaatagtattggatatgtcaggacaatgctgccgtaagtgtaatattttatggccccttttctggaagctcagaagctccttaaatagtagatgtgtaaaaattaacatttatttccatggagtagaacttagtatgaatataattattataattaacaagttccccaatcacagttgacacaaatttgaatatgagagcctaggaaacaattcatttgttcttccattcatctaacagttcttaactatagtatgcctgacactatcctgtaactggattgtttgctggaagactccatgggggagcgatgcagggctcctcttacagatgaaggtatcagccctggacgttgtatttttctaagggtcatggaagggctccacattcccctaaaattctagatgtgtgaaataccacctggaatttgaattgtgtaactttagcctaaggttctgatttgtgttattaaaaaatcctatgggaggataaaattttaatatgttagcagttattatatcattattaatgaaagatctgagagtagccttcaataggattagagaaagacatgaaggtatctgcctagcatataaagaggagatggggtggtgctgttcgaattcctgatggagggatcattgaagggtgaacatgagtttcagctatgccaatattacctagggtgtttcatggtagcttccaggaatttccccagcatcaggtagagacatgaaagcagcaaagcatttaatgtaacacttagaagtggttgaagagaggcgtcagcactctcacttggtcaggaggatggcttcatcccagtggttctcacagtgtgacccccagaccatcagcattaacatcacctgaaaacttgttaggaatgccaattctcaagtcccaccagacctaccaaatgagacactggtcatgcagcccaatcatctaggtttcagttagccctccaggtgcttctggagcacactcgagattgagaaccatggctctatcccatcttttcatagaaaaattgagaacagcttaatggaaagccaggctgaccttggtatcaatcctagctccaatttttactgactctaggaccatgtaaaatgctaactctaacctttaaaatgggaattataatccctacctcactggaacattgagataatatatgaaaatcgccctgcattaagcctagcacatggcagctatcaagaagcaccagttgttaatagttgctccctctctcctgcccacccagttacagattgcacaccttggaactcatgctggagagaggggcctttccctagacaaagtgtcaaccctttccgtgacaaagcagagtgccgcctgaaacattatcccacgcgggagcacattattcatcatatttttttttataagaattgctattgcccatcggtatcagcacagagtgtattcattctcttgtaacatttttctccgtaggagggacactggaaagtcaaaaattgtgaagaaagacttttttacatttgtaaaaaagcaggccatgtcctctctgatgctgaatcaggatgtcaagaggtaagtgctgttaacattgcaatttaggtacagggacttcatagctagaatatcaattccaccatcaatttgaagtgaatttctctttctcctctctctctctcctctctttcatctctctctctctcctcgcaccccccccttctttcctttcctcttttttttcctgtcctgagaaatgttgtcttgctatcttctacacaggattacttttcttttgagattaaaaatgtaaatggtcctgatacagcatctgtacagtgactatcctgtgatgtgtgatgccctgtctcacacttggttttcctagtctttctttcttttctttttctttttcttttttttttttttgagacagagtcttgctttgtcacccaggctggagtgcagtggcacagtctcagctcactgcaacctccacctcccaggctcaagcaattcgcatgcctcagcctcccgagtagctgggattacaggcgtgcgccactacgcctggctaatttttgtatttttagtagagacgggattttgccatgttggccagacttgtctcgaactcctgacctcaagtgatctactgcctcggcctcccaaagtatcgggattacaggcttcagccactgtgcctgacctatggttttcctagttttcaagtgagatgtcataaaacaattgtgttcctctgagtcagagtgaactatgctttatcagtctcaacagttttccagacctggtctttatgcaactatgctttaattattttctcttctaatccagttatttgtattgcaattgaacaatgacccatccccttagaatcttcattttattcattaatcaatgtgtaaacaagtgaacttcatactctagttggatagtagatatgccgtagctgacatgtcaccattttatctaatgattataatctctgaattagttatagctgatctctgattaatctctacctgatatgaaatattgaagacggggcaggggtgagggtggggggatttgtcttactgtggctttctgggaaactcaacgtgttttatttttgttgaaaggacaattaactttttacactgcaaatacagaactgatgttctattcaaacttttgttcatggcttcccttttccagccagcattaccagtatttaaagttcctgagttcatagccaattctctagctttgtgaagaaatttccagtaattttattatgcatcagtctatgaatatggttttgaaagttttctcttttttagaaagttgcttcaatgcaattctctaaacagtctgcacttgaaaaatcaatttgtaaaatcaatcttgataatttcaaagcaaaagaagtgatttgtttttccttctgagtcacttttttgggattggacaatatgagcaattccttcagttttgtcaccaccatcctttcatttaaaaatgaaatggcacctagtgtacaaagggttaactgatataatcagttatccttcccgtattcattgtgtggacaaagtcttgaagtaacaagtcggtgtttctgattattctatgccagatctttttttccctcccttttcttgagctggttcagttattggatttttttgtttgtttgttttgctaagcagcctatgatctaaaaactgctaatgaagaagaatacattatcggaaaggtcaaattgccagcctccctctccctgtccttccaagtacaggagcagtctaatatccctgctcctaccctggagggatgcatgaaggagctgtatggagctgtcagttactcacagagagaagattgggaatagaagtgaaggggagtgagttcagagcagatcctagatggctggatgtgggagctcctgtgcttcctacctcagttaatgatatgtttgaactaacacagctgatctctaaattaaggttttctttaatttactgcaagaccaacatcttttccaagaaatttatgagaaatcattttataactgatcaaaagctggcaagaattggcatagcataaaatgaagagtgttttaaaactggtgaataaattaaaatagataaaaatgatgtgatttaataatattggggaaaaaagaactaaaatagctcagtttaaatatagaggactaatgaatgtatgtcttaccatactgtgtgatttcagatgagatcgggcacattcagggtggtgtggccatagactgtactgcatgatttcaaaggaagagccacccttcgttgttcccagggctaaaacatagacctacatgtttgtcatttttgtctgagtgccaaagcttactttcttcccctccaaaaggccagccagttaatttaggaataatctttacaaaaaaaaaaaaaaagaaagaaaaagaaaaaatacatatattggccattctctatttggaagcattatgctccaaacaagaccatcctggactgttccagaattgggtttcaggcccaactgatccactagtttgactttatccaagtccctaatctcaatgaatctcagagggataacatgaaataatcaatatgaaagttgaaaaaaatctctaatattatctagatacatatattctctttgttcatgttctctttcccctctgttcaattctaaaatctctatctgtattgtccttctctgattctcagaacaaccccataaatactattattatcctcatcgtatagatgaaaaaactatgatattaaacaaggttgcacagtagtggagccagaattcaaacccatgcatcctgaccctagagccaacacttaatttctaccctcctgtcggggccatttatatgaaattctgtaagtcagagagagagagacacacacacacacacacacacacacacacacacacacacacacacacacacagagagagagagagagagagagagagagaaagagagaggtagagatcttgaatgaatgccctttattttcatttacttttaaggttttacgttttaagttaattaaaaattttaggttttaagataataaattaaataaatgtagaagtgggtgtagttaatggcattactggatagaataaatataaaaatatcaagacaaaaattcaaggagttttaaaggagtaagagaagaaagttatgtaggtggtaaaagagtatgcaaaaatatctcttggtatttaactaaatgagattgtgtccttaatttcccttttattctttttaagggatgggagagacatggtggattctgttacaaaattgacacagtccttcgaagctttgaccaagcttccagcggttattactgtcctcctgcacttgtaaccattacaaacaggtaaattaaactttttttaacagaaacaagacggctttcacatgaggactcttggaatgataaaatctagctacaatcataactgttcaaaatctaaattgtgctatacatcaaagtactaaattatttaagttatttattgagatgaatttaaattatactatgttattccagaattgatttttgagtaataaataataaaatttaaggtgacctttactatctgtaaagatttattaattatccagcttttctaatatattcagatgtttttagattttatcttctaactgcttatatgggaaatgaaacccattatttattttttattttattttttttcatttttttgagacagaatcttgctctgttgcccaggctggagcgcagtggtgcagtctcagctcactgcaacctccacctcccaggttcaagcaattatcttgcctcagccccatgagtagctgggattacaggcacctgccaccacgccctggtaatttttgtatttttagtagagacggggtttcaccatgttggccaggctggtctgaactcctgacctcaagtgatccacctgcctcagcctcccaaagtgccgggattacaggtatgagccaccgcgcccagccaaaacacattatttaacaagtatttttttgatgtaatgtatgtgaattgtatgggggtgtttttagcagaaaagctataaaatgtggaggatattcaaatccttcaccatcacttcttccatctattttatttagattgagacttctctgtgcacatatgccttcctgatgctggcacagagactgtgccctttttacactccatacaatctgccccatggtaccgatgcataatacctgtaggggataaaaataccaagagtaaaggtgacctcatatcagtatcgatgccaggaggacagtgggggctggaacacctgggagacccactcctcctggggaagacagaagcggggtagaactccagtggtgccacaggaaactacacctgcaaagcaagtcacttgcatatttacctgggccattgcctttaaaaatattcactgaataccagcaaataggacaactggttttacctagagacccttcccatataagcctaatttgtagaggaattcctgtatgatttctctgctcctcccacattggaagtcaacatccaaagctgccagtatgtccttcctcctcttaccctctttcttgccttcttacccagcttctgttccaaacaatgcacaggaatgcatacacacacacacaaacagacacacgcacacacacacacactcaaatggattgatagcatttggcagactaagtcacctggtgaaacattttactttcaggagatcctcccgttgaaatatagcactacctttgatgtatctcagcattgtttttagttctacctttctcctcccaggtttggctaacaggcagaagaaagcctttatcaatttgttaactcacccaaaaggttccaagaacaccttgggttggaagtcccccagtcagtgagtcaatactggacttcacaggaggctgaccaatgaagctatacgctcttttgttaattacaatttaattatgttttttaccaaagaaaataagtccaattgtttcacctgttttttatgtcttattctttatttttttgtttaatgttcattgagtgcctgtcacatacctggcactgtgttaattatttttcatatgttatctgaccacacaaaaaattaatagccaagagtttattagaaaattttttttgaatacctgttttgtgagagtccccatattaaacactgacatgctatccacaagaaataaaaggcatgctattattgtccagtgctttctgaaacccagcagctgaagagatcgaacatagacacaagaaataagtgaagaaggtagaatagcacaataaatggataaactcacagtgacattacagataacccatagtgccacagtgacccaagctaaggcagaaatctgttagaacaaatgcttcatattccatgaaccctttggggacctcatacaaatgacagaaagtatctgggaaaaaaatctgtttcattttccccaaaactggatacaagactatgttgtgaatactttaaatgttttctctggtaaactgtattcagtagcaagcgctcatgcctggtccatctgtaaagcagaactatggcatagagaagtttgtttttatcccagtcttggcctcctacgcctgtccagattgccctgtgctggtgtgctgcctggtcacccgccaagccctgagggagtacagatgagcaggatgtgtcatctgtccaagtcagttaacatatacttatgctacccccaaaacatgtctacattcaaagcagcaactccaacacaggactcatgagttgaagaaagaaagggccaatgctcttggtttttaatcattcagagtccatcagggaagaaacaagggtccacactgtactgcttttgattcaccatacacgttggaatttttgcaaacagcatcttttgtctgagaaggttgggcagtagatggaaagtgtctcagatccaggagtgtccactagtggccatggtaatcattttcttccattactgatttcctgtttaagacactcctgtcactcttcagtacccaagcttgtagttgctaattgattttccactcttctgcacaatggaatgacaggtttgatgggcacaattagaaccacctgctacaaattacttatttcttttgtgatcaggcaactgctcctggtctaagacttttaacactttgtggaatagagaggggaagaaaaacagatccttattgttgagtaacaaatttttgtttgcttgctgattgttacaaaattttttcaggcctggccactttgcttccagacaaagcatgaatgcaaaagttgagttccaaaattataatggataattggctaaatccatgtatgtctaaattttgaatcaatcagccatagaatattggtacaaaataatccaaatggcattcaattttgtgaattttgccaaaagtgagaaattctgcaatatctcattttctcctaagtttattttactttcatttatttttgagacagtgtcttactctgttgcccaggctggagtgtagtggtgccttcatgactcactgcagctttgacctcctgggctcaagtaatcctcctgcctcagccccccaagtagttgggactacaggcatgtaccaccatgcctggctaattttttaaaattttttacagagacaggttcttgccatgttgccatggctggtcttgaactcctgggctcaagcaatcctcctgcctcggcctctcaaagtgctgggattataggtgtgagccactatacccctcctaagcttaaatgtgcattattttaaagcatttttacagctctaccgttttcctgcaactgtcatatctccccaaaacacttttgcagttaatattttttttattgtggtaaaatatacttaaaacacacataaacataaaattcaccatgttagtcatttttcagtgtgcagttcagtgtcattaactgcattcagattgttgttcacccactaccatcatccatctccagaacttttttcatcttcccaaactgaaactctgtacccattaaacaatagctgcctattctcccctcctcccagaccctggcaactactattctattttctgtctctgtgagtttaactactctacatgtctcatataagtggaattatgtttttctgtgtctggtttatttcatttagcatgttgtagtgtcagaatttcgtttctggaaattctgttttaaggctaattcatattccattgtatgtatatacacatattgtttatccattcatccattaatggacatttgggttgctcccaccatttggctattgtgactaatgctaccatgaacatgaatgtacaaatacccttcgagtccctgctttcaattctttggcatgtatgcctataagtgaaattgctggatcatatgataatttgattttaaattttttaaggaaccactgtactcttttccataatggctacaccattttccattcccaccagtagtgcataaaggttccagtttctccacatcctagccaatgcttactattatctggttgttttgttttgataatagccatcctattgggtgtgcagtggtatttcactgtggttttgatctgcattccactggtgattgatgatgttgaacatcttttcacgtgcttattggctatctgtgtatcttctttggagaaatgtctattcaagtcctttgtccattttttaattgggatgtttgtcttttctattgtttagttataggaatttttaatatattctggatattaatcccttatctgatgtacaacttgcaaatactttctcccattttgtgggttgccttttcattctgttgatagtgtcctttgatgtgcaaagtttttaatttttataaagtccaatttattaatttcttattccgttgcctgtgcttttggtatcatatacaagaaatcattgccaaatacaatgttatgaagtctttttcctgtgtttccttgtaagagttttatagttttagctctcatgtttaggtctttaatctactttgagttcatttttgtgcatagtataaggtaagggtctaacttcattctgttgcaagtggttgtctagttttccctgcacagtttattgagaagactgtcctttctgcactgaacagtcttggcaccattcttgataatcatttgacatatatgcaagggtttattcctagtctattccactggcctatgcgttagtgtttatgctagtaccacactggttttttgttttgtttttgttgtttttgagacagggtctcactctatcacccaggctggagtacagtggttcagtcatagctcactgcagccttgacctcctgggctcaagccatcctcccgcctcgacctcccgagtagctgggactacaggcatctaacaccaccacccacagcaaatgttttttatgttttgtagtgacaggatctcactatgtttcccaggctggtgttgagctcctgggctcaagcaggctgcctgcctcagtctcccaaagtgctgagattacaggcatgagccaatatgcccagcccacactgtcttgattactgtagctttgtagtaagtttggaaatcaaaaagtgtcagacctctaacttggtttcttttcacgattatattggctattcagggttccttgaatttccatatggattttaggatgaacttttctatttttgaaaaagatatcattgggattttgatagggattgcattgaatgtatacatcactttaggtagtatgagcatcttaacaatattaagtcttccaaggcatgaacacgggatttatttccatttctctgtggcttctttaatttccttcagcaccattttgcagttttcagtatacaagtctttcacctttcagtatacaagttttcagtatacaagtctttgtgtagtttattcccatgtattttgggggcactattgtaagtggagttattttcttaactttcttctggccaaactccacatcgttcttcctgtcgacggcctgccggcatctgccagtgcctgtcggtgtgctcttccaccggtgtgttcctctggatgtccagccgcttgtctgtcttccagctaaggcctcgggggattttacaagcacaggatgggggtgtggcaagccagggtggtcttgggaaatgcaacatttgggcatgaaaacagaaatgcttgtcctcacctaggtctgggggcagaggctgggggtggagccctaaccagggaccccgcccttctcctcccagcacttccctgacccggtattactactctgcctcagaggagatagagaaaagcagatcgtatattattgagagcatgaaccaacagaagtgtaaggaaaattacaacagcatgtaggcaatatttagtcttctatatgttccttttgaagcacatttatataaggttctgccagtatgatctggattaaaaaaagaacttttcttgtttcaaatgtgtgctatttaggttattaatagagtatctgcagaaaatatttactaaagtatgacgaaaatccatatcccctgcaaagatgagtaccataaatacctaagatctctaaatgttgctaataatatctgtaaggcacttaaaatttttacttctttttattcttttctctttttatctcctatttcctttgagactcttctattcataaatgacctcattgcttttgcttcccttagcaagttaaggatgcacagtaacgaaaaaagccaccaaaattgaatgaaaagatctaatttgctttctccttaggtttcctgggtaatggcttcagcctttccttttccattgactcagcaggtctgcccagaagtcgccactgtttcaaatgtgcttcttctaactttgtatgttctaaaaatagctttctcaagatagtttcaacttagctgaaaggttcaatgctagttaaattttaatagtcatgtttttcttagtaggtgtgcatgtggaagcatgtatgtgagtcttctatattctgcttttgatgcattcatactggaaagggggcactgccaccaatcattgaacagtaattcattcagctgtttgggaagtatattagtggatgtacggccttagattagttcctaggctttcacatttttcttcagtgaacatgcagatttaaacacatttgaataagctgagacctacctctgcctatgaacacactgatttgggagacataaaattgctactttaatttctgtttctttctcaccaggcaagtgaggtaggtgggtgtgtgtgaactctgtattagtaaatgctcattcagaaaagcataatatctttcctcctccctcctgcccacctttaccccgtgcatattgtggcatggtgtgtgtggtgtgtggcctaattacaaaataggccacatcgtactccaagaaatgcattgctggccatgtgaactttaccacctatgctttgaaactggagctggactctctattctgtgcaagaattaagccccatatgcaagagtcagattctgctcactcatatagttctgggaattgcactgacattcggcatttattagtaatgttcagggtctttgggtgttttcctgttccatgttctaaagaattgatgagaaatgcttactctggggccattctgtgcacttcattatgctttaatgacatttttttattgcccagaaacttaatgtaaccacttcttttttccccttttaaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgtgagtagagtgtgctgcatcaccaaccctccctgttttctttactccaaattccttccaccccttggcccacctcctttgattctttcttaatgttttcttaatgcctaaatcaattacaaggatcaacacaggttaacagggggtgacatatggctgatctttgtttttatttattttatttatttgtttgtttgtttgtttgtttgtttgttttgagacgaggtctcgctctgtcacccagcctggagtgcagtggtgcaatctcggttcactgcagccttgacctcctgggctcaagtgattctcccacctcagcctccccagtagctgggaccacaggcatgcgccaccacacccagctaatttttgtattttctgtagagacagactgatattgaactcctgggctcaagcaatcctcccaccttggcctcccaaagtgctgggattatagacatgagccaaattgcctggcccaatggtcatttttaaaagtataatccgtatgagtcatttgacatgttaaaggtataaattcatcgctcaggaccaccactgcctttattagcagcaagtccagcttctccctcctaatgtctttctccccacctgcaccccccactgtctaagaatctcaagtgcttactcagttcagaatggtcagttaaacttcaaagtacggtggatgggcacatatgggtacatccaatcagttcacagtcactgcctggggtaccttagccaggattccagcgttaacagctctactagttcatcctcaggtgttcagctctgaatcccaaggcatgaaactgtgccaggttggtcagtaccagagaagctgatgtcttccgccacagcctacactagaaccagtctctgtggaacaagcttcaggcccttgtattaagctgaggttgacagcctagacccaacagcccctctacttcagggtgagttcttgcttgcctgtatctccatcagggctgtgccagagacaacagcaaagagttactaagtttgtatctagaggaaatggcttaggggccccaggctcttccctccttgaaggcccggagctctttatacaaattggtctattccatcctcagagctctatataccaaggtaaggaaagtgtttgctaagccacagggggaggtatatctcccctttagtgtggcctcacactaaaatataaaagtggccacacaagccttgtttctcataattacaaaagtccagtccaaggtggtttgctaatcccaactctagacagtggttggcaaagctccaccgatttttaaaattcaacgatgaaatcatgaatatattcttactatagataatgtgaccatatacctcatttgcccagaacggttctaatttatgtctggtgtcccagagcaattaacagcaggtatttttactccaaatttttctggcttggatggtaaattatgtagatgctctaattatagagaagtgtgctaagtaaaatgtggaagtactccgttacatctttctcttcaccttcccaacatcaatacatttcccttttcagaaacaaccactgttaactgtttggtatgatcctgctggtgtttgtctgtgcattgcatttaaatacatttatgcatatgtactttttaaatggatataaggatttcatgtttctgttatttgatttttttcacttagcaatctgtcttagagaactttccacatcaatatttattagtcgacatttgaaacagctacatagaatttcgtagtatgtaggactcataatttgctttgccatgaccctgttgaaggacattgggtgaaattcattttcatttctgctacaaaagtgttacaacaaatatctctatgttgatgtcgctgtgcataactatgagcatgttggcctaaaagtgtacatcttactgaggcattatcagtttacaagttcatctaacaaaatttgagagtggcagctttcccacatttttgtcaatactgaatgtaacaaccttttacatttttgccaatttgatagaataaaaaaagttttactattcttttaatgtctaccttttcatttagttatttgagcaatttttcatatttgttctatacattttgttttgtttttcaactacatggtcacataatttgatcactttctatttttattttggacactttctattttctcattacttagtggaaatttcattatattctaaatataaactctacatgtttgctatttgccttttaatttttctatggtatgttttgtcacacataaatgttaaactttttgtagtaaaaaagtttatatttttcattttagctttgtagatttttatattttctaaaggctttgctcaaccaaagattataaaaatataaccttatatttttatagtttggctttttaaatgtataattttgattgatctgagattttaaaagtatgttctaggagatagctcattttaatttttctaaatagtaaccaatttcaacactatatagtaagttcaccctttcgtctactgattcgaaataccataataaacataacctacattctcattttctgtttccctgccaatatggcactaacataattcaagcagtgtggtattgaaaaagaaatagaaaaaatagaatcaatgtagctgaaaagagagcagtaatacaagaatataatttctattattcttagttttcttggagctcttttttaaaattattaacagattttaaattttactcaacactctgaatctactaagacaatcctaaggttttctcctttactctcttaatatgacaaattgctttacagtagtaaaccagctttgtactgttgggtaaacttaacttagtgatatgtattttaatacatctctgggtttagtttgctaatacaaagcttcacctactataatgtacataagaatatcctgtagattttgatgaagttaaaattctgattcagtagatctggggtaaagtccaagaatccgcattttttaaaaagctcctaggtgctgcctatgttgcaggtacacaaactaacctttgagtggtaggtttatgattttagcaaccttttttcatagggaaaactagtccacatttcttcatttgtatacagctttggtttcatgattatgctaagtttcatagaatgaattggagagtgttcacttttattctctacagaactatatatacagtaaacatttattagaatttgccttatgttttatataggaaatttaaaaaccactaattcaatttctgtaatgcttataagactactgaggcttcctacttccttccaagtgctgcttgagttgtatttcacaagatttagtagagttttataatttttcaatttagaatacattccaatttccaatatgaatatgatttcaacccataaattatttagaagattttttttaatttcccaaaatgcaggtgtttctagttccttttgttgtcaataccttatttaattgcactgtggtcaagaaatacggtttgtttggtgcctgtcctttcaaatacaaagttggtattatggccttgcatgtgttctttttatatatatatatcccatatgtacttgaaaagattgtatattctgcttttgctacctgaaatgcttcatctatgtcaacagattatgttaaatgtgttgttcagatcatctatagcctcaatattttttgcccacgtgatcaatcaattattgagagtgtttgatacctcccactatgatggtagatgtgtaaacttctccctgtagttctgtcgaatttttgtattacatactttttaggctgttttattaggaacatacaagtttagaattgtgatatcccacctgtggtgtcaaaatcggtatagtagtatcccaagtgatcctcttgttctttcaaaattattttctccttagagttaatttgtccatgaatgtagctacagtaactttttaaaaattagtattggcctagtacattttttaaatttttttctaactttgaatgtttttgtgttcttagagttaatgtatcacttataaacagcatataactaaatttttaaaactctattcacacattctttgtccttaactgtatagtttggtttacttatattttttgtgattatgtatagaattggatttatttcttccattttattatgtcctttccatttatcctgcattttttagtcatgttttctcttctttcttgccatcttttgaatgtatctttttcttcttttctcatttcattctttcccctttacttatctgaaaattgtattatctaaatctatttttttatttgttacactagctattcaacatgcattcttaacaaaatcaacaatatcaaagttattcatctttaaaaggattataatttgctgttgctgtctagttttgaaaattctgaactgcttcatttctgttagccatgattttgttgttgttatctttgcaatgaatatttgtttagatgtattcatatactagtgtaccattccttctgtgatctggaacaccttcagtttcgtatccttttcattagactcccgcaacctgaagatggttggttttacacaactctggaaatttttcaagcattatctcttcaaatattgcctctccccattcattctaatatttccttttatcattccaattactcagcctctcctccatgtttgttaatatttttaaaatattttctacctctgtgtctctcaaggatgcattttaaataaagtcatgaattatttcaattcattgattctctcttcagccagatctaattaaattttattttttagttttcagtgttagatactatatttatttcatttctagaaagtctatttctgttttaaatttggtttgtggttctttgtagtcacttgtttcctactcatattttaaagattctctttcatttccttaaatgtatccgagttattttgtatttggtttctaataatctcatacctgaagttgtatgggtctgtttctggatctcatctctttcattttgtgggttttgcctagaactactgatttttctttgtactttatttatgggagttctctcacccccagggtgaagttgggctcctccagtgaaaattagcatttgtttccaccactcagtttgaggcactaccaactaaggactgctttaaaagctctgactgaggttttcttgaacacataggtagcatgaattcgatgactaacgactaacctgcatgaagtttgggttgtggttataaattctttagaaagttatttcttttcttattattcactcccaagattgacagagacaagtttccttacaaacagctgagtgaatatattctcatgtacgcttaccaaaagtggccatttgggattctattttatgcaggtttcttctgttagacttttcattttgtatatctcttaggcttcatctcctttcccttaaaatctccatgcaactatcaaagcagatgctcaaggtctccagaattggaaagaaacctttagggtaaatcccactaggaaggtagtttggctaccatggttcatacttttacttcatttgcaagctctatagatttgtttattttatgccagctcagccatacatttataaagatgttttcaaaatgttttatccagcatttcaactagtttgaccaaaagaatctttcagggtacctaatctgctggttatttctcatagcaccatttattttaacacatgagattttaggatagagaagagataagcacatgtattcagtctactgctcaatctttgagatgtctctctctgtgtttttaaaaattttttctttctataaccctattgcataattaaagccattcatttaatgaacttttacaaggcatttgtatgacaagggacatttaaaaattacgtaatgtgcatgccttcatgttgctataatctgggagtggtgacagcaaatacaataaataactcatatacagattcttagtcattcctgttactataacaaaatatcacatattgggtaatttataaataacagaaatttatttctcacagttctagaggctgggaagtccaagattaagttgctagcagattcagtgtctgctgaaggccttcttgcagcgccctcacatggtggaaaggcaaaagagcaaaacaagactaggacactccctcagcctcttttataaaagcaccaatcccattcatgaggatggagcactcatgactttattacttcccagaaggccctgcctcttaatactatcacatatgcgttttggagggatatattacattcaaaccatggcaacaggaaaatgtgtggtgagtgttgtaagaagtataaaataaagaactctaacagttaaatgaagggaggattaattcccattgaagttatcataaaagttcaagaggaagtggcctttcacctgggattgaaaatgtctgaaatatagtaggatttagtggttaaagaagtaaaaagaattttctcagcaggaggaaatatatggggcaactttgagaaattttaggagcactgtgtaattagagattaagatacatgcaaaagagttgtaaaagataaggccagagtaggacattgaaactacagcttaatattacaagctaaagagttttcacttcttctctaggtataggaagtcactagaggttttggatcgaaaaatattaggatcggaagtgttcttcattgaggttattatgtagggtgatacaaacagatataagagactgcactgcaggataacatatgcataaagagtacctacccactactgagttgaactaaagttcaaattccagctctatgatctcagggaagttatttaatctcttcatatctcagttttctcttctttaaaataaggacagtaattgtatctacctcacaggattgttgtgaggattaaaagaaatattacatagttgctactgcattgtaaatacttaataaatattagactttcttattgcagagaaataatttgcaggattttacctaaagctacagatagtgacattgctaacctattagggttcctcacccatacattctaagatgcaggacctattctgtgctggaccagccaccaatgtgagcaccctgggaaaccacagagttttaaaggaaggtatgattgtggcctatacacatacatttccccaacacttaggagctagtgttaaatgtttttaaaaaaaattcctttagacctcctgatattagaaaaagaaaaaagagagagatcaaagaaagtcagtttacattctctctgttaaatacatggtttaaaaccctgtacttttgaagacttccagttcccagacgagcatataagaagtttagaagttacaccatcctaatgagtaaagagctgaacaaactgaaaaatcaacaactcttcttagatccatcgcaaggcaaaccactgctgccccaaactggagaaataaaaagatacagagaatcacagcttcctggatcagaaacccatgagcagaaatctccagaggaaccagtgctgggagaggaacatctgaactgtcattgataaaactgctggaggctcaacacagacaactctaagggttaaaaactgtaggggactcagtcataagggacccccacacttttgtgagttctagctccaggtgatctatcaggttatcacagtgaaatatcagagaaaaattgcctaatgcttccagcagagggagaggaaaaataaccattttgaaatatagcaaagcattctgttcttaacaaggccccacctcaggaaaggctattttaccagagactgctactggagttttatcagagcctaatttatctggaggaagggaaatctgcaactccagccagctctatcctttcacgtgatggaaaggaaataccccgctccagctctctagccatcctgtcccaccaagcagggaaaaataactgagaagcattcactggtcaagggtgcagtccaggaacacaggctcaccaaaaggctgagacctaatggtaaaattgtagaacgcttcccctcctctcacaccttaccattccatcacaaaggcctgtttactgcagtttcttttacccaatatattacatccacttttcaacaaaaatattacaagacatgctaaaaggcaagaaacacagtttgaagagacagaacaagcatcagagccagtcagctatgacaggaatgttgaaattaccagacaagcaattcttttaaactatgattaatatgctaagggctttaatggaaaaagtagacaacatgcaagaacagctggatcctgtaagcaaagaggtggagagtctaagaaaaaaaacaaaaagaaatgctacagatcaaaaacaccataacagaaatgaagaatgcttttgctgaccttatagtagactgggcacagatgagaaaagaatctctgagcttgagtatatgatgatacaaacttccaaaactgaaaaacaaagaggaaaaagactgaaacagaacagaatattcaagaactgtgggacaacttcaaactgtgtaatgggaatatcagaaggaaaagaaagaaataaaagaaaagaagcaatatttgaagcaataataactgagaatttcccccaagttaatatcagacaccaaaccacagatccaggaaactctgagaacaccaaccaagatgaacgcacgaaaaactacacgtagacatattgtatccgaacttcagaaaataaaagataaagacaaaatcttgaaagaagccagaggggaaaaacaccttatctttagaggagcaaagattagaattatatctgactgctcttcagaagtcatccaagcaagaagaaagtagcatgaaatatttaaagtgttaagagaaaaaagccctccaacctaggattctatactctgtgaaagtatcctttaaaaatgaaggagaatttttatcagattttatctgatttttatcaaacaaaaattcaggaaatttgttgctagtagacctaccttgcaagaaatattcaaagaagttcttcagagagaaggaaaatgatatagaagctcagatctatataaagaaagaaggagcatcagagaataaatgaaggtaaaataaaaacttctatttttcttagtcttaattgatccaacaaataacagtatgtttaaaataatagcagcaatatattcagacataggtgagatagatagatagatgacagatagatgatagatttgcttttatacaagtgaaatgagtgacagggatgatgcaagggataagagggactttgggtgactgtgatgtgtccttgtaggttcatcagtggtaataaatgtaccactgtggtgtaggatgtctatagtgaaggagattggagggcagtggtgttagaggggaactctctgtattttgcgctcaattttgctgtcaacctaaaactctctgttactaaattttaaaattatacttttgaaagatgcatgcaaagtgaaatgaagacaaattagatttttttgtatataaacatcagcttaggaaatttgtatggaaactggtgactttccatagctccaaacaagtaacatcacaatttgctcaacagaacgaccttgttctacaaatctatgaatattattaaaataaagagagtaataaacttccatgtcacactatactgcaaaaaaataaaagtttaggtatcatttctatatactttggaattttgttaggaatgtctataactgtcaaaataaattaatacattttgagtagagaaaatctttggtttttaatattaagtttcttggggcatatttagatgtcgaaaatctggaattgaagcagagttccttgtcattcataagtttctgctgtaatttatttgagtgacactgctctttttctcttttccctaaagcaaaaataatgccatgatgttcagtttggctgctcaagctgattgacgctgagtaaattgtctctgaataagatgaaaatgtaaatctttttgaagaaaatagcaatataaaagctcctgtgtttccctttttcttttaaattgcagcttgcagagacactacctaaatcacatttctttcctgcctgtcacaaaagaatccattagcttggtccccacatcagaatcttaatccagcaaagactaactacatgaattgaccactgaacaggaagcctacagctttttataaactcagccaggactctgtcttcatgtcataccagcaaaatattcacccaccccacatcccacaccacagtcgtacatttgctacaattgacgaacctacatgaacactcagaaccacccaaagtccctctcatccctcctatcattcctgtcacgcatttcactagcataaaagcaaatcagaagggaatcacctttccgccatttttttttcaacttagtattaagtttatcaaatagtattaccaccagatggtatctaccagtagtagaaccactgtggtacatcaccaagcatcagcaattatcatttcatgaccaatcttctttcatctgtatcctcacccctttcccatattttttcataacaaatcctcaacatcatattgtttcatccataaacatttcagcattatttccaaaaaataaagactcctttttaaaagacataataatacaattatcaccccttaaagtaattaactataattgcctatcattataaatcttcagttaatgctcaaatttctaaatggctcataaatattacataatgtattttacagttagtttgaatcaagatccaaagaaggttcacacattgtaattggttgatagatctcctaaagtctgttttcatctctgtgtttcctgcccctccccaatttccacccctgcctttatttgttaatgcaaatgtgttttgtcttataaattttcctacagtctgggctttgttgattgtattcacatcacattgtttaatgtgttactctattttctttttcataaaatacgcatttttatttttaaaaagaatgaaaggattgatcaaattcagattttatttttttttttgaaagatcacttcctaggtagttgtgtgctctgtctagaggcacataatgtcccatttttttttctctttttgtgacattagcagcctttgatggtcaattcttagatccattgactcattaggggtttcttcacttatagctgggatagtcctataaaaagctaattccttttaatcaatttttgttaccccgtggtacaatttttataggaaacacagaacaaatgcttagttctttccctttactagctttcaaaatgattatttttgcattagcatccttcatctgtgacccattagaggtgtttttctttttttagcattactatggagtaagggttttaaacatatttgatatgttttagtccattgcaattatcctttttaatgctcaaattgccccatccttgtgatgggaatctcttcaaggaatatcttctgaatccttctgatgtgatcctagtagtctttgatagtgtccttgctatctggtatgacaagatataaatttctgctgcagacctagaagcatccattgcatcaaggaaccctggtttcttctgatgggaaatgatattatttcagcatcacagtctgggcttaagggtgctcgtcgtttgtggtttgttattgtttctaggccatttcaatggacagatctaggaagtgtgtgtgtgtgtgtgtgtgtgtgtgtaaattaaacactttttgagttcaaattcatatttacaatttgaattcaggactacaaggttaattaacctatattttaactggatttcctttctttcatgccaaatttcccattctcaaaacaccagaaaatcctgttatttttagtaaaaagcaacaacaaagggactctctgacacttggtatttcaagagaaatgaaatattcaggtgaaacaggaaaaatggttttcatccatactaattattgccactgattaaatggaaagatgataaattagcttctcattcaaggagaagctaatgcttagaaactaaaatgtactttgtacccctagattaaagattcaatataagtggaggttgctctatggtgaaagagaatagatgagtctatacttgttaagacattcgaaaacacttttccaagttatattagaggctcataggtgtctgtattgagaaaaataaacactttcaatcactcctttgcagccctccataactcaggctctgtgaaaaatgttttgtttctagacctagatacccctggcgtgtttcattcatatgggatgactccggggcatgttcaacccaattgttccaaacccatggaaatctgcaagtgacaaagaaaataagatcccagtagagtaagtcaggtttattttcttgaaagtgccctgtagtatagtttgaagtcaggtagtgtgatgcctccagctttgttcttttggcttaggattgacttggcgatgcgggctcttttttggttccatatgaacttcaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctctttgatttccttgagcagtggtttgtagttctccttgaagaggtccttcacatcccttgtaagttggattcctaggtattttattctgtttgaagcaattgtgaatgggagttcactcatgatttggctctctgtttgtctgttgttggtgtataagaatgcttgtgatttttgtacattgattttgtatcctgagactttgctgaagttgcttagtgggtgaaggacatgaacagacacttctcaaaagaagacatttatgcagccaaaaaacacatgaaaaaatgctcatcatcactggccatcagagaaatgcaaatcaaaaccacaatgagatacccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatgtagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattcttagtaaactatcgcaagaacaaaaaaccaaacaccgaatattctcactcataggtgggaattgaacagtgagatcacatggacacaggaaggggaacatcacactctggggactgttgtggggtggggggaggggggagggatagcattgggagatatatctaatgctggatgacaagttagtgggtgcagcgcaccagcatggcacatgtatacatatgtaactaacctgtacaatgtgcacaggtaccctaaaacttaaagtataataataaaagaaagaaaaacttaaaaaaaaaaaaaaaagaaagaaagtgccctgcactttcagcctgtcccatcagtagacactagagaggccaatccattttaaggctcatcagagctctgaaatgagccaccatataaataaggataaacccagtctcatttctgagagcccttagaacatttccatatctcctcataatcatataagtaactgtcatgcaaagtgaaaatgtgacagtagatcttcaaggaaatgctgtggccacacacaggagagaaacaggatcagagggatgcaagagagctccatgggacaggagcataattttaggggaactcattcattcagttattcaactgcttattgaatgcccacccactcactctgtaccttgatactgtctcacagacccaaatacatctggtttcaaatcctggagcaagcctactacgtttgtggcctttggcaagttactaagcctctgtgccctaatttttccatctgcacaatcaggcactaatgcctgtctcaaagagtttctgaagttaaatagggaaaagaccatataaattgcctagcacagtgcctgtctcacagtagacccaaataaatctggtttcaaatcctggagcaagcccactacgtttgtggcctttggcaagttactaagcctctgtgccctaatttttccaactgcataatcaggcactaatgcctgtctcgaagagtttctggagttaaatagggaaaagaccatataaattgcctagcacagtgcctggcagatacacagcattgcaggaaacttgccttgcctacccaaagagcttcacttttctctgttagaggagagaagaaggagagagagagggaaggtgagagggtagaggacttgagagatgaggatgtaaagggttgttgcagggaaccagaaaataagcaggcagactcaagtgaaataattgtctagaggcactgaaaagccagcacaaaaagttttggtcaatgggtttgtttttaggtatttgaacagggaggtggacagtggaggttttcccagctcacttaattttgcatagataacttggtgaatcagaatttcttaattgacagaaagtctccccattcgtgtttgcaggagagagtgagtggggtgggggtaaggcaggtaaggagaatctgttaaaatgtgagattcacctctgagaataatcatttttcttctccagtgggaagtgagttatcaaatttaagaacaacttctctgaaagaaaattcgcctctgctctttcccacacccttacccttattatttggctttgcaagcatccccacgatataggcttataaatttagtttatctctcccttagcctggtctccctttattataccactttactgcttctttggggctgagactcttaaaatttgggtcaaatgttccattaagttaaccactttagaataccaataacacttctgcagcacttttcatcttcatagtggttcacaaacatctccttcttcactaatgaagatgagtcgaatatcttatagcatctaaaaccaaagctatttaatcattgtctggtgtgggaaagtgagacaaaatgcaagaccaacaaaaaagtatattacatttcaaacttgctgattcaaacttttgaaaaattctttgaatatgcaggcagaacttatgccacaaaaccctagtttttgtaatgaaaatggccataagcataatagcaacattgcaggggtatttttagctcttcatattttatagagtgcttttcagttcattatttcatttgatcttcatgaaaacccatgagaagaaaaggaattattattcacatattttagacaaggcctattgtggttaattcacatcctcaagtttccagttactaaagatttgtgctgagactagaaccccaaacttcacgctccaagtccgaagttctttccatgaggtttcctgcctgtgctgtgcagtaactggagtttccactggggcccctcaaaggacgggggaatggagcaggatgtgtgcgttcccttctctttcaactagagcagctccacaagtatattgcatttggggcttccacatggatttctccagttcagttttattgcacagagcatgcagcatctcttgtactgttcatgatccagctggactgtgagctgcattctgaaattattcaacaggcctgcaaagctccattaatggcaggggcagttgcatactataatttctcccccttgcctgcccacaaccttgcatctttaacaccagctagctgttctgggccagtagagccatccgatggcctttggatgcaccaactcttccttgactttcttttcttctatgtgagggatagcgtgtttcctcttttaccactggacatttttacctttgagggtctctgattcatcacagaggcccagggggttcttccagatcagaaccatcttgccatggcgatgctggtgcctaacacacttgtgcagccagcgctgttgaagacacaaacactcatacactcattctttagcaaattattccattcctaaagagatgctctatgtcttcctttgtcttctttcttctcctttgcactcttcattttccctctcttgtgtctttccatgagcataaaacaatcagaacatagatgacaagcacaatgccaggtactcagtatctgaaaaaattgaagccattacttctgaagggaaattaagcaagataaatatcaagtagcaagtgacgacattttttaaagagccttcaggtacagaatcatcgcaagtcgtcagtcatctataatcactctctttttacaagcatgccttgaaaactcatttctccttttcatccttcaaaattcagctcaaatgtcacttcctgcaaatgttttactgacatctctggacaggctccatcaccccttctgatgtctcctccagaactttgaacacaccttttactgtagcactttacacattatatttattagaattgcttatttatgtgtctgtgtcttacactaaactaagaattggtttttggtttgctttgcttcatcctttttttcaagcagttaatatacagcctagctgagcacattgcggatgtacaattttttattgttgttgatgaatgtgaatttagttaactaaatgatcacccaggattcaagaaaaaacaagctcattcttactcattttaattctatttttggaatagaattgctttctactgttcttcactgaaatttgaagtgtatttttttttttttttgctgtcatatgagttgtatagattttgctgacaatcttaagaatcttaatttataaattgtttctgtggaaaaatacattttaccttctaaaatgttcaagcatacacaaagaaaaaagtggagttttgtccataactagtatatcacattttccaatatctcacatatactatgaaggtgggagggaaaatctcagtactttgcttttcatataaaagcccctctctctctctaattctgtcttccttttccctgatgtctgccttgtccctgcccccggatctttacctcatttagagaattcatctcattctcttcattcttccaaggtttacagtttggttttctgttgtatactttgtggtctaccttgaatctgttattcacctattttcccctgttgaatccagttgttagaggatgagcactatgcacctttcattgttgatttttcacaatggaattttgaagtacaatattgaaatatgggggatattttggttccagataggaatagctcctagttcctcatcatttgccatctgagcacaaagcagacaaggtccaaatttcagccttcacactctcttttctctctttcccatcttgcattcttttctccagagatgaagagaaatgacataatcaggtcaataagacattcgttttcatcttgattgctcttgtctgggtgcttaattatgagatgtcaattattcaacactctaaagagcagtcttctgagcacaaaacgttttagtcgtctggtattaaaaatgcttgttttctgcttttaggctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtgataccaaggttacatggacattcttaacaggaccaacactattttaatttgatccatgtatcccaaattcctttattccggggccctttttttttccagaacagtgcctgacagacagcaggtgcttaatcaacatttgttgcctgtctctatcctttcaatcatattccaaataatttttaagtaaaaaaaattgacacatcctggtgatattgaaggcttcctcatgaagattgatatctgttaagcagaaataccaggcacagggccaggcacagtgactcacgcctgtaatcccagcactttgggaggccgaggcaggcggctcacttgaagtcaggagttccagaccagcctggccaacatggtgaaatcccatctctactaaaaatacaaaaagtagccaggcatggtggcatgcacctgtagtcccagctacttaggaggctgagacaggagaatggctcgaacccgggaggcagaggttgcagtgagccgagactgcgccatagcactccatcctgggtgacacagcgagtctctatatcaaaaaaaaaaaaaaaggaaagaaaagaaatagcatgcgctaatattaatacctggaaggagggcaccatgctgtggttatcactcctgggggaggactctaaacacctaaccagtttctgcgtaagttcctagctctgacaggaggttttgcacaaacttggctgccagagtatgaatctggtgagacagaattcccacacaacaagatgggcaaagtaactttattacaggttgagtactccttttctgaaatgcttggaaccagaagtgctttagatttcagatttgttttttttaatatttgcatcgcacttaccagttgagcatcccaaatctgaaaattcaaactccaaaatgctctaatgagcatttcctttgagcatcttgtcaccgctcaaaaagttttgcattttggagcattttggagtttggatttttggatttgggatgctcaacttgtattcacagataggcagcaagaagcaaccgaagtctaggatccatggtgagccattcccccaaggctcaggaaagcacccccaggaagatggaatcttgtctgcacatgccccactttgcatgacagctgagggctccccaaagcgcttctctcggggttttatatcccaggtgccacctgaatcactgagcaaaagtattacaagacatcctattctaggagggataaggacagttcctccttatctcaggacgttgcactcttggtacactctgcctgagaattgccaagaaaaagaggaagagctgggtcagcaagggtcatctggggacctgtcctcctgcaatattgaggccccagtcaatattgttcatacactaagtgaaggaggtagacactcagagggtgttaaatggtataatttcatattgtttgtaaaccaacaaataaagtttttattattgaatgatacaatattactaataaggatagcttttgcagcttgccagacatgtgaagatcaaacaaattgatgcatacggttgatttgtatgtgtatatatgtgtgtgtgtatgtatgtgtgtgtatatataagtgaagacatttctatttttaaaatcagctttagatcctacatttaaattagttcctacaatcttgtcagaaacacattttttgaaatatgatttttaaaaatgtttggtggttttgtcttggtttattttacaaataggggttcactaaatcttggggaaaagttccccagcatctctgcacaggcagagcagaatgaagacagactctatctctggaactgttgtagcttgtagatggcatgaagcagctgtgaatgtgctcgatttaaattgtacacatgtataatcctacattacattcatagaataataggcccaaaagtggcctcgcccattaataagttaaaccttagagatgagtaaactggggcctgtgaaatgtagtgatttgcccaagatcacgattatttattgacagagttggaataaatgcctggtttaggacttctggtctggtgccttttctactatatatcaccctgatatgtcaacaaatgcatggtgtgtgtgataggcatggtggtaggatttatgagcttatagtgattcgggaagaggttcccagaggaggcaagttttgacatataatttaaaagatggaaaggttgtgctgtggtccacaggacttggaaagctattcattctggtctcagcaagtaagagcctggtgagggctggccacagggtgtacctgtctggcatcagaggctcaggcttagtgccaggcagttaaaaataagaagggtaagaggactgggattgcaagctctgggtcttcagtccctttccccaatcttaaataaagccaacagaagaccttccattcatctggcttcttcctgccaccatgaagacagctgagaagcagcagagattttaggcacagctgaaccactgcactgccagttcaactaagattcaaagactctagaaatagagctaccctaggtcccaggtctaatttctcatttcttgccctgggtcagccagagtaatgatcaatctgctaattctaatctgtcagaaggcaatctggtgggatggaagtttatggactctggaagcaaggtattgtaggtctaattctagctctgccagtttatagctgtgtgacctaaaattcttaacctctcttggcctgactttatttatctcttgacaaatatttactgagggacaagtacatgccagtcacagaagatttagggtgaaaaaaaattcctcaaaaagctcatttataaaactgagtttattatattctcctcagaaatttgttatgaggataaaaggaactaatagttttatgatgactaggcacattctaattcagtaaatattacttcctcccactagatcaagctctttataaataataatgatgattatgttaatattactgttactttcttgaacagagtttaacaacctgactttatctataacaatgttaatttattttcttttactatacaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggtaaatacttgttaattatgaaaaattacagtcaaatattctatctcccagtaatggcttctgagggtgagtatcccaagtagttgtttaaaattcccatatttgtattatgcccaaagccaagaaaaataaatatacatatagttttatgtttatcttgtaccaggttctcatttcataaaacaaagaacaaagtgacaattgtttagatatttgaaatcttttctttgtgcctcaagtcagaactgtagagctttcctgccaaactcaggaattatctaccccaatggttttcaaagtgttgtggaaggatcccaagaatcctggaaccccaggagtatgagagggccacgtaggcagagctcctagttccttccacgcctcaccagagcggctctgaccagctccaccgctaattattttgtatataattggagcctatgtaagattttgtttggaaaaaaaaaaaaaaagagtcccagtaattttttttttaattccaacccaacctcctaagttttcatttgaggaaacaagctttcccttatctgtatccatcttgcaagtttacagaaccttgaattcagtggagttagaaactcaagcttaaattgtaagaactctaaaccgtcttgtgctacctcccaccacataccgtggtcatctgctgtctgcataattccttccagtttcagaatgcttcttatttgggagaaagcccattccattgcagaagcctggtttcaaagagtagttttctaataagccagaaatctgcctcccctcagtttgagctagagcaaatacagatcaaatctactctattttcaaatatttgaagacagtcatcttgtctccttcctgtgagccccccacccccgagtttggcctctcactttggaatgttcttgtcagtcagcctgcattgtgagagtatcttctgtggaaggggcacagttacatgcatagctggttggataattcaatagacatgacaaacaagatcctgcctctgaggatgttgtgatcatcacacctccatgactctgtatatttatttaatgaaaacaaccataataataggtactctgcttcaagctctggaaatctagagtctcaatgaaacactggcctgaatcccagagaaaaatcctgtactattttttcaggaaaattctggcctttcccacaagtttccttgtaggacattcccataaaaagattaacatgcaacatctatcagattattcatcttccacatctacagcaatgaccttaaagctgggagtttttgacatctctccatgtgagtcttgtgcagcattctgcaggggaggaaggagattttatggtcaaatatgtttgcaaaacaatgtacaatcttggagatttgccatgtacattagcatcgtaaagggttctagaaggaagcactttctttgaccacaattcccttttttaagaacacttattgacatcccacagaactgctagtccctacgggaaatgctgacatgaggccatgactcaggaacctggctgctcatcacacttggtcgggacaccttttaatacagagctttctggcctcacaccagagctgctgagtcagactctctgagtctgaagaaaagtttaagaagctttctggctaattggattatcagccaggtgtgaggccgcaaatccaagggataggtgatagtctccattgttcaaagttacattttgcttcattactttagcttcctttaaaacatatttgcatattctgtccttgcattttagtgaggtttgccatatgacaaccacacacacactgcttcccagtttgctttaagatcaaatgtcactgtcatttctgtttatgtaagttctcatgcttgaaatgtctagcagaatttagtcccaagctaaatcatggatcttcaatatctgatcacaaaagtcatataatatgagccaggcacagtgggtcacagcactttgggacaccaaggtgggaggaacacttaaggccaggaattcaagatcagcctaggcagcgtagtgagactcagtttctacaaaaaaatttttcaaaattagctgggtgtggtggccacacctgtagtcccagcaaaacctagttcaaagttacagtgaggtatgattgtgccactgcactccagcctgggcaacagagcgagaaccgtctttaaataaaatatttaaaaattcttgactgggtgcagtgacccacacctgtaatcccagcactttgagaggccaaggcagattgcttgagcccaggagttagagaacagcctgggcaacatggtgaaaccccatctctaccaaaaagtacaaaaaaattagccaggtgtagtggcacacatctgtagtcccagctactcaggagactgaggtgggagtatcaattgagcctgggaagaggaggttgcagtgagccaagattgtgtgctactatactccaacctgggcgacagtgtgaccctgtctcaaaaaaaaaattatcaataactgtgtatgtttcagtttattcccagactaccagagaattcagtcaaatctgatgcttaattatagcaaacataccagatctcatagttagcaggtatagcaggtatgctgcttttccttcctatggcactgcttttctatttctattttattaatcagacacacacacacacacacacacacacacgtatgcacatacatgtgtgtttattaaatattgtacaatttcaggaaactgatgaagagaaagtaaataccatttcatcttccaggagccagtatatagcaggaaagacatagaactctgaattcagtgaggaaagaaaaaggtcacaacaccaggagagtgacatggattttcagcctatgccatcgagattaatgtgcttggcttaaactgaaggtggccattctcaccttctcccagccttaaatgaaagttagtatcatcatgacaatgtccaaccgggcatcagtgatctcttggatttctaagctgaatttgaatttaatttgtgtcatccaggcagagtagctgacatatctgagaaggaattccttgcttctctgcacaaaggaaaataaagtatctgtcctgacatctgaatattttaaatctttgattcttcaaaattattctcagaaaattatcttagtgagatggttcattgcacaggtaggctttattactcgatttattgagtattctgtggacacatttgtactctgcctcatagaagggaaggtgattctctgtggagcttctcaccaagtataaaccaatggtgacaactgaagttaatgaaccatggctcagggtgactggctttagaattatttgtgttgatatctgaaaaaaacccaaaacctactgtgtaccttttattcagtgaagatgatggtggttgactttcagagaatacatgaatgtttaacaaaagaacaacaaatcaaagcatagtaaagtagaataaatagtatagtgaagtagcaaacacacagtaaagtagtgaaaggtcctcttggctagagatgttccaaagtttcttaccaattttcttttcatgtgttcttgtcctgactgaaaggctttgctattcctgatgagaaactcatgttctcaataaaagctgacttttacccacctgtatatcacctgtgagcaaaccacacaaaccaagagtaatagaatgtgaggcttattcttctctcagttcatgtcacagcacagggttttgcacatttaaaatgttcaatgcttgttgacttgatcaatcctgccagtagcatcagctgtttcctgcatacataaatattttaaaatattttttcttttattattattatactttaagttttagggtacatgtgcacaatatgcaggttagttacatgtgtatacatgtgccatgctggtattttttgaacctttcacataatgctgtaaatttgatgggaaaggcaaagcttttgtttcttctctttacaggacagaagaaaggcagttctggattggatttaataaaagaaacccactgaatgccggctcatgggagtggtctgatagaactcctgtaagtcttttcaaactggagaaaagggatggattcaaaacaagtgggcctgggaccacttggtaaaccaaccaagagaacctagaaatgatggccagagctcccatgacaaaactgcaccagaccttagtaccaggagaattatttggcaaggtcctgagaaatctttgctagccatattgttctgaggccattgtacaatttcagcctgaaaaagtatcaaaaacctccaaaaagtccccccaaaccatctcccatatgaagtctctctggcagagaagcagctattctttaaaataacacaagactccctttaccctatacctccctatcctgcatatcacctgattatctgagtatgggaaccttgtccatgtcataatgaaatgaagattattttggagaatgatttttcatttatctcactctgaaaggacagtaatgcaagttttagaaatatcaccttctagagcaagttattccagaaggaaaaaaaaagtcttggttttcattcattcccatacttgcaaacctctatgaaggacacagagaactcactattgtatttttttccagttgcaatgggtaattctcacatttttctcaaaatgacagggaaaaaactgaagtagtatcctagattgaagtgggatccatcctacggcacatgaaaaatcacattattcactttcacctgtgaaatggggagactcctaagagcctgcagtgagaatttaatgcaactgctgtttattgagtccttatactgttccaagcgctgagctgaatgcactcctacatgatctcatttcatccttacaataactcagtgccatgggtattagaatgattaagtggcttgcctaaaatatataggagagccaggatttgcacacaggttgtctgactccaaagtcacaatgttataatatctcatgattagcaaaatatcagtagccaaactttgaagtagtaaagaacaatagagaaagccccgtaccaagatggttttcaaatttatgtcaaggaagaggtttatagaagagagtaggaagagattttaaaggtcattcagccccactaatccatttttctgataaagaaaccaaggctcagaaaacagaaaaggcatagcagggtcaacttactccataaatggcagccactacatgagacagctgggtggttcaagtcaatgtagcactcgaaaaagaaatgtgacacatagaagttgagaacactttcttttgttttagtataacaaactcattagtaataggagaggaacagacaatctgggtcagaataaattagataaggccatgaagcagtggccgagcttctcactaatatctgctggacaaaatgaattcaaatcacaccattttctgaacctgaggctatatatattttagatagatgaattattacgtgacagtgtacatgtttgaggaggaatataaaggattttaaaacatcctttttttccccaaatttttaccccaattttacttgtggtacatccattcttctgtgagatagtcattaaataattgagaaggttgattctttaatacccccgtaatgtgaattatatgagttatgtggtcactcatggaaagtgacctgatagattcctgattaaagctagctatagcttagaatttagttattagagacaaaaaacttagcatatgttcaaagtaatcaaaatcaaagttaataccaagatctggcacacccttgagtccctaagtttacccaggattccaaggctagaaaattttcccagttagaaaaatgtgcaaattcagaccaaagcttgcatttgatttgttccttctggagaaaggaatagcatacctttttttaatttttattttatttatttattttttttgagacggagtcttgctctgtcacccaggctggagtgcagtggtgggatttcggctcactgcaagctctgcttcctgggtccacgccattctcccgagtagctgggactacaggtgcccaccaccacaaccagctaattttttgtttttgtatttttagtagagatggggtttcaccgtgttagccaggatggtctcaatctcctgagcttgtgatctgcccaccttggcctcccaaagtgctgggattacaggcatgagccaccgtgcctggccttttgttttcttgtttttgtttttgttttttaaaaaggcatctttaagaaaaaaatgctaaatattgattagcttgttcttcacaaatgtgaaacaaccttcaactagaatgacatccagacatttctgaagcttcctggagtagcctataatgcttatgtacagggatgccctttttgatcttttgaaactttgtggggggatcatcattaaggaataatgaacttcatctgctgcaggttgtctcttcgtttttagacaacacttattttggagaagatgcaagaaactgtgctgtttataaggcaaacaaaacattgctgcccttacactgtggttccaaacgtgaatggatatgcaaaatcccaagaggtaaaaatagtagtaagatctttgctatatgtttgatttctaataatctctagtactttcccaatttaaacaccccaaaccacaatatcaacaaattgcatgataaaataaattacactactttagcaaaaaatgtttctataggaaatgggaaaaggcgacaccaatgcaggatgccaagttagttcattgggaactaaggtaaccagctaatattgcagaatatttatagtgcaagtatagtcggggaaaaatgtcactttgacattacagagcaaatggaattacttgcacaatgagtaagtggaaacacctgggacagtgtgtggcacacagtggcctcagcaagtgctcatgtccttccttctttaattagaagcctctctggagcttcctcttcaagtgtgagaactcaccatatattccaaacagcacaatgtacctgttttaaagtgatgttttaaaagatgaaggacaaaatagtgtgtttagagctgaagtaattcacagacaatgcacttgagaagcaagatcagtcaaagtgatttgctttcactttgcagatgtgaaacccaagattccgttctggtaccagtacggtaagaacgactctggcagctcttgaatttctaattattaatatataccatataagtgctattatataccattaatgtgttgttacatttctcaaatcgagcctctcttttcttgtgtcaacctagagctaatttgttcaaattaataattaataaatgtagtcatttaatatgattaaggactagtatcatcaatcattttcatgacatgcgattttagaatatgtacctatccccgaccttttaatactagtgaaggtatcttgtaagagatagaccaaagaaaaaaagcaagttatatatctatttatgtgcatatgtgtctgtgtgtgtgtgttcaaattcctgtgtgtgtgtatacaattatttttaatgttgagtgaccaaatctcaaatttggggtcaatcctagcatacctatttatcatttcagcattattttcactgtttctttttcagatgtaccctggctcttttatcaggatgcagaatacctttttcatacctttgcctcagaatggttgaactttgagtttgtctgtagctggctgcacagtgatcttctcacaattcattctgcacatgagcaagaattcatccacagcaaaataaaagcggtacttgaacataactcaccacgaaaaattcagagtttagcaccttcttttgcccttgggagggagggagggatagttttttcgatttgacttcggatatttatttaaacttcagtaaaagccatagatttcagtaaagccatagatttttgagaatttttttcctattatagagattaagagaaaataatggaggtacaggtttactgtattgctcagtcatttcccttctcttcattctttgttagcaacaatggtgagcacgtcgagattgtttcatgaggttcattcgatcatttaatcactggtagaactggggttttaccagtgattaaaaaagacccaaattcctatcttcatggagtttatattctcgtctgggaagaaagaccataatcaattcgagtaaatagaattatataatatattagaaaaaataagtggataaatgccacagaggaaaattaagctcaaatgagggatgaggaatacctgggggggtgcctggcagttttaaactttcaaatcttacaagagtacattatttttaagtttgtaaagactaatatacagaaaatagtaaggagtagttttctatttcaacttaaagtagagaaaggctacttaattccttgcagaactaagctagtaagaaagaaacatgtaagacctattaaataataaactggcaaagaatagtgtactttttcagtgtgttccttcaataagcattcattatcaagtatgtgccaggcactgggatatttgtcaaagatgcaaaaatgtatgagatacagtctctgtttttaaaaaggctagatatatatactttaaaacatcatgttgtatacaataaatacatacaattttatttttcaatttttaaaacataaatttaaaaactaaagctggaagtgatatgatgtagtaaatagaaagggcacagaaagtgcaaattacaatgggggcatgaaggcgggaaatcctcactcccctttcccttggaagctttgaaagcaagaaaaagccattttcttttcctgtaatttaatcatatttcatgatcttcaggaatcctttctaactctatcatctttttatatctctgtaagttgactataaaatgaagccctgtattaaagcatcctaggcttgagaaagaaatgtctttcctcacagttcatggggatttactgtctctatatcttgtctgttgcacatacagcccatgaggtacaagcaggtcaggactcctgctacattctgatgaagaagccgagaaaaagagaagttagatgacaatcacatggtcccacagacactcagttgcagaacaaccactagatgtggaattttccccatcataaatttgtacactattttgtcacccttccactcttacgaatggaacactcaagccaaaaccataatgttcaatatgagcatgttcaattctataccatgatgtcggaaaatacacatttctttagccagacaccatactcctcacctcagagggcaataacaagagaccagatgaatggctgaaaactaatccatacgcatgcaaagtatacaacccaaaaagagctgatatttggctatacttaccataactgtttcaggtactatgataagtactaaaatgtaatcttcccaagaaccccctgtgggaagtctattattagtacatttttacaggtgagtaggctaagacttcaaagaggttaagcaacttggttacacagcagctaagtggtggaatttggaaagaaacccaggccatcttatttatccagtcatttaaaaaccctacacggtgctgcctgtgacagtggaacagcagtgtcagggcatgtaagagcacaacgtcttcattacatcaaaagctagttccaaaatcctccccaaaacatggctgccagcttcgtctcagacatgaacaatgaagggcttctttgatctttccaacagagcttagctctgctgggaacttctgtagatcttctgtcttcacctttcctcttaattcatctcctaatctttggaagttgggaagccaatggggatggcgtagataatgcctcccatggaagggaagggcgaaaccccacaggctgagcagtttgagtcatcatagccactgccatgatctagttgaggattctgacctcaaatcagacaaactttatggtgccttatatggcaaaattgtcacctggcctatgaccacgttgatgtagaatgccccatcagtttcatgggtaaggtgctaactaatctccccactgtgctgcaaaagaaagttatgggaaggtataggatttgaatactgagaacagggccaggggactgtcctagtcttttcaggctgctataaaaaaacactatagactacgcagcttacaaacaacagaaaattattgctcacagtcctggaggctggaaactcaagatctaggcattggcagatttgatgtctggtgaatgcccacttcctggttcatatgtatccttacatagtggaagaggcaaaggagctctccaaggtccccttttaagggcactaatcccattcatgagacacccccaccccccaccctcatgaccttatcatctgccatctgccttgtaatatatcaccttgagagttaggatttcaacaatgtaaattttagggggacacaaacatttagtctgtagtggggtccaaggggaaaggatatcaaattagaaagaagaaagctgttgctttccaaaaaattcttatttctgcataatttgtgcctaccttgggcacttattgttggtggtggtgatagtggtgttcacattttgtaagaaagaaaccccacacctaagaacgtcctgctggaatgggtcaatccagaagttacttcattccaggatgaggagcaagatgtgtagaggtgattccactcacttctgtctcacatttatcttataaatgtaggaagagtacaaataagtaattaaatatttttaaaattacgtatgtgctttgtgtagcttccctaagaagagcagtgattagaattgtgaaaaacaaaaatagcagttagttgcagtgtcaaaaaaattaattatgaacaagcaagctagatacagtttaaaaatctgaagcaaataaaaattttaataaaatgtttccatcttggaaaaagaatgtcaatattttctctcccactctttgagtaacagaagaccataaagcatgattagagtgaatttattttttgagccatcttgataatcacattaatgctgaaaaaacgctgcaagcactttaggagttgtttgacacaaactactagctaattagtctgcttatctgacatttttacactgttatgcagtattgtcattttgaaatggcaatttaccattattattaaatttttatttctaaatgcttctcaaaatacatatcaaatctattagtcctcctccaaaatatcatttgtcatccttgatgggaacattttaaaagatgacaggttgttcttccttatattgctttatggattaatgtagtgactgtcactgtggggttttgtttgtttttggtaaatgctgtttccatatgatgctaactataatggctgtttgtaaataccaaaacatagttgatgttataaaatgcatgttcatatgacattttttaagccctgagcttacttctctatcacatttctttatgcaaacacatgttaataagtcttctattgttgtggccttcttaagctaaaatttcaaacatccattttcacattggatgttccattctgggtatcttctagcatctcctatgaagttcagttctgtgccatatcacaacaggttgtgatgtgccatgtggaggttaccacgccataattgaggtggtaataaatatgccacttaggatgcagcagttataatttctctttagaggtccttaattggggcagtgaacaatccaggccatgatttccagtcccgtggcacatgaaacctctttagattgaatgaaattgttgtggttcccccactgagttaacagccagtctcagtggacccattccaacgtctgacaatgggaatctgaattcagcctgtaagaacatgtccacgaaacaacacctcagggatacaaaattacagttgttccatcttgcattattctcaaattgctgatatgacaaatagccatgctgtttacagaataaaaatacctgtttataaattagattgttagagggctattgggttctgttgtatggagagctgaaattcctatggaaaaataatgtatcttaaaatttcttctgaagtctttacagaagaaacgagagtacaaatttaaatatataatgccttcaaattaacaggattttagcatataaaaattaacttacagttcagcacacaacacacacacacacacccccattaagtatactgatttacaggtcttagaaaaacccttacttcctcttcctcttttatagttaaagagggaatttcaatttcctgggtcataagtcagtacatctgccctaatgtgtgtgtgtgtgtatgtgtgtgtgtgtgcacgcacacacgtgtgcacatgcatgcacatagtgctttaattttatactttattgtacttaggtccaagtgattaatagtggtataaaattagtaaaatgtaaaaggataattttctttttgttgttgttgttcaagtcttctatttccttactaatttttactacctttattctgaacactacaacattactaatacaatcttagattaagtggtttttttattggtgataactatatcactctgttaacatagaatttataatctactaaaattccaattttttgttatacagtttaattttatattaaaaagtacatattttgaaatgtgtccatgttgacacatataaatctggttcctttttttattattatactttaagttctgggatacatgtgcagaacatgcaggtttgttacataggtatacatatgccatggtagtttgctgtacccatcaacctgtcatctacgttaggtatttcccctaatgctatccctcccccagccccccaccccccgacaggccccagtgtgtgatgttcccctccctgtgtccatgtgttctcattgttcagctcccacttatgagtgagaacatgcggtgtttggttttctgttcatgtgttagtttgctgagattgatggtttccagcttcatccatgtccctgcaaaggacatgaactcatcaaaaggataattttctagttgtcaaacactgggcactctgtagtattcttttgtcctatattgtgtctctctatttgaatgggaaggaaagcttatactgcttaaagcttagcaatcagactaatacctaaaatcagtatctttatactaatgatgccttgataccttgaattgtttttcaaatacatgtgacatatgcaatgaattataaatcactgagagggtaaataactgagaggatgagccaataattttttgtcagaaaatgaattcattttctaatattactttttaaaaccttcttagagagttagaaacattacttttcaagttgtatgaaactaaaattattttccatgtttgattccagtttttcttcgtaatggggggaatattttaggataatgaagtttcaggttttctcaagatgctaggccttagtgtattcttccttagataattgggtaaaatactgaagaatagaaagctattagcagcaaccccattactcttaatagtgaaaaaggaaaacaagtagaataaatgctgactttttttctttcaatagctatcaaagtatggtgcaagttggtggattggacttcaagaagaaagagccaatgatgaatttcggtatgaacctagattcatttgcatttaattttgtttgacaggttttatttgcagaatgattagattcaattttagtgatcaatttgttgaatacccttcaaacattaacttataaattttcacttctctaaccaaagacatgagtgttttttaaagaatatgcttatgaaaccatcccgacaatctagccataaacatatccatcacctccaaaagctttctttcctgctctattcatttatttatttattcactaattcattcatttttgtgatgagaactcttaacataaaatctaccctcttagctgggcgcggtggttcacacctgtaatcccagtactttgggaggccaaggagggcggatcgcctgaggtcaggagttcaagaccagcctggccaacatggagaaactctctctctactaaaaatacaaaaattagctgggcgtggtggtgcgcacctgtagacccagctacttgggggggctaaggtaggagaatcacttgaacccgtgaggcagaggctgccgtgagccgagatcgtgccactgtactcagcctgggtgacagagagagactccatctcaaaaaaaatctaccaccttagaaaaattttaagtatatgatacaatattgttaactataggtactatgctacatatgagtatattttttaaatttaatagaatattatatcttcaatccctacctcagaactctaagaatgatgttggagactggacatgcagaatgagagaagaccttaacatttttaatcttcccacagctggagagatggaacaccagtgatataccagaactgggacacaggaagagaaagaactgtgaataatcagagccagagatgtggctttatttcttctataacaggttattttacttacccatttttgggtttataatacaaactgataattttcaggaggcttaaagtcttttccttgcatcatttccatgagaagtttctgtttatttctcttttcagttgacgtgttcagttttgtctgccataaggcttaaggatggccatttttttctgttcaatccatgcattcatgttcttggaaataatttacatctgaataagtccttcctcataaatcaagacagcaccagaaatgggcccaatgaaactttaaagaaatatatgcctgacaaatacttttttctatggtatttcaatggaagcactttttaaaaaaatctattcctatatccaatttataatgggccagaactttaacctctgtgaaatttacttccattttcctatttaataaatgttttgattcaagtcagtattcttttttcttttactacctgtcatcaattgctgcttgctttagaatggcaactgtttgcaagttggatttagaagcacatttaggttgaagattggttttttaaattctcctcatcagtgcagtgtagttaggttgattgtccactcattcctcttctttctaaccaataaaagataatgatacccattactctaacagattcataactaacctgtgccccaggccaggagagggataaacacagaaaataattttgggtgtgagggcctctgcagagagttaggaaaggaaaatccgtgtggttaatcagcctgcttttaccagcaggtgtcacaacagcctacagaaaggactgttttgagcgtctgggagaatagcagctaatctgcattgaaaatagcattccagcccttccttcaaaatgccaacatcttttgggctcatattcctgatctagaaaactgagcctgcccttgcaattggcatgcattctgccctgttctggaatttatgacttggatgccaataaaatgcattctataatccttattctgaaaatatagctcttctaaattaaaaaaaaaaaaaagcagttagtttgtcggaggctaaggatttgaggatatttcttactgaagacatgtctatatgtgagtctggtttacttaaggatcagtattaaatgctgttttcttggaagttcttgagttaatttttctaaattattatattttctaaagaattataaagtagaaattatctactgttttagaatctttttcctctctgtacattgaaattgaacattttaaaatgaaattgttaccctacaaagtattcttttgctacacaagtcaaatattcttaagattttaatcagttctatgattcaaattgcagtatttatttagatttttttaatttgcaaaatttttacattcttaaattaaaattactgagttggccttgcccagttagctgttgtccctagagaaatctaagatcagtagtttagttcagtttctagattttaaaaaataaattatgaaaaaccatagcctcataaaaatagtgatcaatagagaatgccttcaaagaatcgccattgttcctaagccatttctaacccattttctcctccaggactctggggtagtgaagagtgttcagtttctatgcctagtatctgtaagcgaaaaaaggtttggctcatagagaaaaagaaagatacaccaaaacaacatggaacgtgtcccaaaggatggctatattttaactataaggtaagcttgtttttcaaaagttgcctttgtttctcttttgtagacactaattttggaaagtgttcaaaaagtgaaagtggcttttgaaagctgtgagttgtccataggacctggaatttttttgtcacaactttcaagaaatttgagttttccatttagtaacaaatcttttggaacaaaagatttttgtcaaaaacagcctggacactgcccctcgtttctatactcagttttactgttggcatagtcatttattgtgctgtatgaatgtttcattaggtgtaacatatgtatgtatatgtatgtatgcatgtgtgtgtgcatatgcatgtgtgtgtgtgctcatgtgcgtgcgtgtgtgtgcacgtgtatgtatgtgcctgcatgcctgtgtgtctaggttctgctcccaaataagctgtaaatttcagaggacccagactccatctcctactcttgtgttttccctgcctggagccggcatagagctctgcccactagtgaattgagggactaataacttagcttggtcaatgtcatcttaagcctcataaagctggtgcttccatgcagatttgaattaagaaaaaaaaaattgccagtggggatattttaaaccagatttattatttctgatgctgccttcaattaaggcctagtctccctccactcttcatattttataataaaataactttataggccttaggtggaagtaattaaaatgcatcccaaattataattgtttaactcttagaaaattaaaaaacccaaactgtgtcatcatttcatatgctaatatgaaattcctcttcaattgtggacagccaatttttaatctaagtgttcagttatattggcagggctttctctcctttgtgatcttcctcccattgttaatttgagaaatgaggccacttggatttttcacacattcattgagtacccaccagacatttggcactgacttttaaatttttttaatatctggtaaatacacacaatatagaattcaccattctagccatttttgtctactgtttactagtgttaagtatcacatactcacactgtcattcaacaaatctccagaccttttccatcttgcaaaactgaaactgtacccattaaacgactccctgttcttcctactctgaaccccttggcaactgctgttctactttctgtgtctttgaaattgactaatttagatacctcatgtaagtggaatcagacagtatttgcctttttgtgactggcttatttcagttagcataatgtcctcaaggttcacccacactggcatgcgacaggacttccttttgacggttggacaatattccattgtatggatatactacattttgtttatccagtcatccattggtggacatttgagttacgtccccccttagctaattgattgtatgtttatttcttatatcactgaattttaaaaatatatagaattactatcctcattttacatatgagaagacagatgctaacaaaattgtgtgacttttctgaaacttcacagtgaatacgcatcaggccaagacgcactttttgttttctgaccctgagtctggtggtcttgcccctttcctatgcctgccacttcacgttggcacttaaggactgccactccagaaatgcaaattaaaacaacaatgagtgatttgccactgcacagctactagaacggcccaaatccagagcactgacaacactacatgctggcaaggaggccgaacaacaggagctctcattcactcctggtgggaatgcagaatggtacggccactgtgggagacagtttggcagtttcttacaaaactaaacatacttttaccatttgatccagcaatcacactccttggtatttacccaaaggagttgaaaacttatgtatatgtaaaaacctgtccatgaatatttataacatctttattcttaattgccaaaacttggaagcaatcaagatgtccctagtaggtgaataaataaactggtacaaccacacaatggaatattactcagtgctaaaaagaaattagctatcaagcctttaaaacacatggaggaaacttaaattcatattactaagtgaaagaagccaatctgaaaagcctacaatactgtatgattccaactatatgacattctggaaaagacaaaactagagagacagtaaaaagatcagtggttgccaggtgttgcagggagggaaggatgaagttgtggaagattcttagggcagtgaaaattctctgtatgatagcacaatggtggatgcatgtcactagacatttgtacaaactcatagaatgtacaacacaaagagtgaaccctaatgtaaactatggactttgggtggttatgatgtgttaatgcaggttcatcgattgtaacagatgtaccattctggggtgatggggcatgtgataatgcgggaggctgtgtatgtgtggatcaggtgggaaatctctgtaccttcctggttttttttgagatggactctcagtctgtcactcaggctgaagtgcagtgacatgatctcccctcactgcaacctttatctcccaggttcaagtgattctcttgcctcagcctcccaggtagctggggttacaggtgcctgccaccacgcctgactaatttttgtatttttagtagaaacggggtttcatcatgccaggctggtctcaaactcctgacctcaggtgatccgcccgccttggtctcccaaagttgtaccttcctcttaactttgctgtgaacctaaaactgctctttaaaaaatgaagtatttaataatttttttttaaaaaaaagggttgccatgtcagcttagccctatgacacagtgagctcagtggcaccatgagatattttctagaatagtataatttactctaaaactttactatagtaatgaggtacactattttttaatcattgatactttctgtatacttcctattttctcaaactataaaatctttctaccaggtataaattattttcacattttagtatgagaaacttgtagctaatattcaataagacactgagtgttactaagtcttttattaaaacctttggcaattagttttttaaagcatctttatggtcctaaataatgtaacataacatttgccattttaaccattattgagtgtacaattcaatggcattaattacatgcacaatgttatacaaccatcatctctatttccaaaacattctcactatcccaaacagaaactctgtaaccattaagcactaacttcctgttccccatcccctggtaacctctaatctattctctatccctgtgaatgtgcctattctagatatttcatattagcgaactcatacaatatttgtccttgtgtctggcctattcgcatgatgttttcaaggttcatttgtgctttagcatataacaaaattgccttccttcttgtggctgaataatattcctgtgtggcacgggcgtgtgtgtgtgtgtgaatattgcatattttgtttattcattcatctgttgatgcgcacttgggttgttttcaccttttgactattgtgaataatgcttcaatgagcattggtgtgtaagtctctgtttgagtccctgttttcaattcttttgaatgtatacctacgaatagaattgctgggtcatatggtaactcagtagttagctttttgaggaactgacaaatgttcttccacagcgaccaaaccattttacaatcctgctagccgtgtgtgagggtttcaatttctccacatctttgccaactctggctattatatagccatcctagaacacgttaggtgttatttcattgtgatttcgatttgcatttctctattatctgatgaagttgagcatcgtttcatgtgcttgttagccatttgtttatcttctttggaaaaatgtctattaaagtcctttgtccatttttaaattggatcatttgcctttttattgttgagttataggaattccttatatattctaaatattaaaccccatccaatatgtgatttataaatattttcagtcattctgtaggttgtcttttaactttcttgataatgtcctttgatgcacaaaagtttttaattttgatgaaacccagttatctactttttcttccgtcacttgtgcttttggtatcatacttaagaattcactgccaaatccaaggtaatgaagatttgcccctgtgtgttcgtctaagagcttcatggttttagcatttatatttaggttgttgatacattttgaattcactccagtatgtgacaattagtttttcacaactgttagaacaagtttatcctggcatggtctctagggaacaggcataaaggaatgcctagctaatctccaaatcacatttctggtacagatagtgaacaacccaaaagcatgaacacaactgtcctagttactaactcatgcctcctctcatgtgtaaaagaggatttttttatatactttaagttctggggtacatgtgtagaacatgcaattttgttacatagatatacacgtgccatggtggtttgctgcacccatcaacccgtcacctacattaggtattgctcctaatgttatccctcccctaggcccccagtccccaacaggccctggtgtgtgatgttcccctccctatgtccatgtgttctcattgttagctcccacttatgagtgagaacatgtggtgtttggttttctgttcctgtgttagtttgctgagaatgatggtttccagcttcatccatgtccctgcaaaggacatgaactcatccttttttatggctgcatagtattccatggtgtttatgtgccacattttctttatccagtctatcattgatggacatttgggttggttccaagtctttgctattgtgaatagtgctgcaataaacaaacatgtgcatgtgtctttatagcagcatgatttataatcctttgggtatatacccagtaatgggattgctgggtcaaatggtatttctagttctagatccttggggaatcaccacactgtgttccacaatggtttaactaatttacactcccaccaacagtgtaaaagtgttcatatttctccacatactctccagcatctgttgtttcctgactttttaatgatcgccattctaactggcctgatgtggtatctcattgtgggtttgatttgcatttctctaatgacaagtgatgatgagtattttttcatatttctgttgactgcataatgtcttcttttgagaagtgtctgttcatctccttggcccactttttgatggggttgtttgtttttttcttgtaaatttgtttaagttctttgtagattctggatattagacctttgtcagatggatagattgcaaaaattttctcccattctgtaggttgcctgtttattctgatgatagtttcttttgctgtgcagaagctctttaatttaattagatcccatttgtctattttggcttttgttgccattgcttttggtgttttaggcatgaagtctttgctcatgcctatgtcctgaatggtattgcccaggttttcttctaggattaaaagaggatattttaaggaaattaatgacaagtcaaatccttagcatttgataaataattcttagaaacctggaatagttgtttctggttcagccttttgctattatccttcccccaaacttgatttttacccacacagttcacctccatcccatgtgtcctcctgtacacacgtagagagtgtgtatctatgggaatggtggcagtgatggtggagcagacccagggcaaaagagcaagtgaatgcttcccatgaaaggaatagagaggggaataaatatgtgcatgagaatggcggggaggggaggcgccttctgaagctagccctggggcatgattaaaacaccctcatgtagctcagagttataaaaaaaaattattgataactaacagctagatcagtagttttcagccctggtcaaatatttagaatcagcaggtgagctttttaaaaacatcaaagtgcaggagacgtcctgaagattctgatttagctgatctgcatgggatccaggcatccgtatttttttaaagctccctcagttattctaatgtgtggccaatatttacccagcaattcaacagtcatagttccacaactctttcttcaaggcattaggagcatttgattacaaaggatatcatcacagcaggcttcataagtaggtggcaattcacctggcacaatgtcagagtcaccatgcatgtctccccacccacagtgccttctcctgcgcattaatgcctaaaattccaccactggagtttctctcctttgtctcaacactttcctttatttttaaaagggaaatatttttgagattgcctcatctgtcatcaacatcttgaaacaagtaagtttatcagattattagaaaaactgttaataggagagttgatagctgagagcggtgggatggtttttccctattaacaaataaagctacagaaggaaaactgggagataacaatgatggaccttctttacttcacaattctgaaatgagttccaatatattatgtcccattaaactttgcttattgtttgtgaatttcctaggactaatttttattggttatttctaaggaaaaaaatcccactttgttggcaaattaagtgggttttaaaactgagatacacagaaattaagcatcttttctaatgtctcataaatagttttctctgtgtttgacaatgtaacagaggtttgaccaggggtttacccaggaagaatgagtcatctaagatacttgtcccagcagatctgtgggaggaagaaattctaagtgtgtgtgtgtgattaactcttgtgcttctacttacatatttttattcaagacctggattgagtggtaatggctgctttgcactgtctagtttgggattagtcaatatttgattttgtgcataacatagttttttcttaaaaatactctcacctctttttggaatttattcaaattggagcacttcattcattcattcatttactatctcgatgtcgggaattcagtggtgaggaaaaacagacacagccccttctcttttggtgcttacacactagagggagaacaaacattagtaaatcgatcaggaaaatggctgtgtaatttaaaactgtgctgtacgtgatgaaggaaagttatgtggttctagaaaagtgtatagccagaggacctgactgaagtggtcagaaaggcagggaacattaaaaatagggggagctgcatgtgctaaggtcctgcagcaaggtgggagtatgacatttaagaaactaaaggaaacatagagaactagagtggccaaaggtgagacaaaagaagtggaaagggtgataccgtgttggacttctggcctctatcctaagagcagtgggaaacccttgatgggtttaaaactaaagaaggacgtgaccaggaccaaattttaaaaagttactctagatgtagtgccaaggatatatggaagaagggcaagggtgagaaaggtaagagcagttaggaagctattgctgtagtgcaggcaagagactggtaggttgggctaagatagtggtggcagagaccatgaggcagtgggaatggggatgggtgagggggctttttgggaaatgagatgtccaaatggtatggctgttggggagatggagtgggaaggtaaggatgcctctgaggtttcaggcttattgtatgtgtataagtgcatgcagaccgtgccattcattgtgagtaggaacactgggaaaggaccaagtttggagggaactgaatttcatttccaaatattgagctagaaatgattttgagacaaaaaagaattttatattgaaaacccatttagaatacagtaggaccccattaattcacagtaataatcagagatgcattaaacttgatcacattttgcaaattagtaagtaaacaattttaaattaaggatgctgtacttcatcttgctgctttgccttaattattaatgacacaatttcggagtgtgttagtaaatatgttatatttttagaaacaatgaagtcgtggtaattgcaggccacacttccgtagtcaagctagtaaatcctggctgaggcaaacatagaggaagcagaggagatgtttttctggagagatttattgagctaactgaaccaatgaggttcattggtatttatgaatggttcattagtgtaactatctgaacacaaggtgaattcacattaaatgataagacttcccaataattaatatgtgccactctttagaatttgtaattagaggaaagaggcaaaatgaaaggaaatagataaaaggatagttgttataaaattaaactccttgaaagccaattcagtttatttgtgaagcaaacaagacaaaaaggaccagaagaattgaaaatgtattttctctcttagttggcaactcaacctcaagctagttcagtgtttctggtttttatcctaagagtagtggaaaattcctgaagggtttaaactaaagggtgacatgatcaggactgagttttaaaaagaattaccttacactattgacatttggggtcagataattctttcttttgaaagactgacctgacctgtgctttgcaaatggttagcagcatctttgtctctacccattagttgccaatagcaatcccctccccaactgtaacagtgaaaaatatctgcaggcattatcaaaatataccctgaggggcaaaattgtcctgttggagaaccactgagctaaatttagaatgactgacaatgtcatttgacaaccattttagggtctgttgtcttttattttgcttaataaatgtttactaggggccttctctggtgtgatgttcaaagaggagtaagacttagtctctctgcttttaaggggtgtatgatggtggggaaggggtggagaactgaaaaatttggaaattaaagaatgatggggaaagatattgtattagaccagtcttgcatttctataaaggaatacctgagactgggtaactgatgaagaaaataggtttattttgacttacagttctgcaggctgtacaagaagcatggtgccggcacctgctactggtgagggcctcagggagcttacaatcatggcagaagataacagggaaccagcatgtcacatggcaagagcaagcacaagagggtgaggtgagaggaggttccagacttttaaacaatcagatctcgcatgaactgagaactcattgatcacctaggggatggtcctaagccttcaagagggatctgccccatgatccaatcacctcccaccaggcctcaccttcaacactgggaattacatttcaacatgagagttggagggaacagacatccaaactatatcagatatcatttcaaaataaggtaggaaaggatgctttttcaagtgtaggtttccacgctaacctagaattatcctgtagtggcgagatcttaggatctgatctatcaatgactagggttatctgtgttcattgatgagagaattgattatgagagaagaatccccagcaagttccagatgaaacatcctttgcataaagtttctcctgacctctctggaattttgcctgatccattataacctttctcttctatcttttcctctcaccaaactccatctgttcctaccaacattcttaaatttcatcgaactttcagggaaaaacaaacaaacttatcttcaaccctgcctgtcctgccaagtatgtatcattccatttctcatcccataagaaagaaacctctgtggcagggcgcagtggctcacacctgtaatcccaactctttgggaggccaaggcagatggatcacaaggtcaagagatcaagaccatcctggccaacatggtgaaaccccatctctactaaaaatacaaaaattagccaggcatggtggtgcgcacctgtagtcccagttactcaggagactgaggtaggagaatcacttgaacccaggaggcagaggttgcagtgagccgagatctgaccactgcactccagcctgggcaacagagcaagactccatctcaaaaaaaatttaaaaagaaaagaaaagaaacctctgccatgatgcagacatgattctctcttgcataacactcaacttttattgccaaattccacaaccttttctgtgttccctctaacattgatggccaaccttccccttcatttctacttcttcccaggtttctttggtcatacccttgctttctgtcccactgggatcatttatttttcttctctggctcttcccaatagacttagtgaccaaatggctgactcaagtatttagtgaatttaaacacctgatgtgtttgactccccattatttctctctcacttaaagtaaggaagtgtgtttgtaaataaaattgaactaagctgttcattgccacccccagaatgtttttgtttttttttttttagattaaatgtgcccatgtaaactttgcaatcagagtggctcctttttaggaagaatactacttttcattgtgctgaaggcactgttctgacatttcacaagacaaaacgcatccctgcttctgttcctgcctgctgcaaatgcaggcaagtcattaactcaccctaaaagctgctcctctttgttttactgtaacacctttggaggaggtgaaagaaaaatgagttctttctgcccaagaaaattataaagaattttcaaagctgatattcagtgtctttgggaaatttttaattcacttagaaagatacagaaatgaatgttttgttttgacattttttgatagtgccttctgctgaatatccccaaagacccaagcagttggaagaactggacgcatgctcaacatttctgtgctgaagaaggggggaccctggtcgccattgaaagtgaggtggagcaaggtagagtactcaagatccaaccaggccaagataaccatttttattcaagtatttattaaaatatcccccccacctatactaacattcccaaatcaacatttaaaatactgtgttgctgatgatacacgagtttgcagtttgacccataggttttatttcatgatatctgtaaaagttagtgtactgcattgcttataaactgctgggttttggagccttgtctctcaccagtagcagtggaaagaataaggacatattcatggcctatatttcaaaatggctaaaaagtatgatctacatgtaattgcatggtatgatttttagatccctttacatttacctacatgcttttatttgatatttaatcaattatatacttcagtttaaatatagcagataaatcctcttttgtttagaaaggtaattaatgaacactggaaattgttttgttaatgatatgatgaaatctcaggttatccagctaatttctgtcaatttaaactaaaacaaaagtgaaagaaactgcattaccttaacaaggataaagtaacaaattcctataaatgattcataattatgttttgctggcatttaaatataatcatagctataaataggatgcagtgattacccaaatgctttctacagtattaaattagataatgtattcctgtttttcagctttcattactatgaatctttttggccagaccaccagtgtgtggataggtttacaaaatgatgattatgaaacatggctaaatggaaagcctgtggtatattctaactggtctccatttgatataataaatgtaagttttaagatttattttttggagatcactttggcaagatattttattcaagatttgtttactaaagctttttttatttcctatattttgtaggtataaatttatattagttttttattaatatattaatttttaatgtaattttatgtgttccattaatataattactttactcatcacaataattgtttattttgtaggttatgaaatgacttgtgaataagtttattaaatgcgaataaaggaataatggtgtcttaattttaaaaataatgtcttaataaaaattttaatgttataataatgctatatgttatcatacttttgataacgtgtattattttaaagattccaagtcacaataccactgaagttcagaaacacattcctctctgtgccttactctcaagtaatcctaattttcatttcactggaaaatggtattttgaagactgtggaaaggaaggctatgggtttgtttgtgaaaaaatgcaaggtaagaaatatttgggtttttattcctttcatttccaaagtccatccttctctttcatgttggttttacacagctgtgtagctaatgtagctaacagtttcctggctaacagtgtcaggcacttcttctttggctttacataagtttagttatttaatctcctctaccctaggcttatgccctttagtgggattctaaggactgccgaggccacttgagtgatgaccaaatttatgtatctatcttagtcatattaaatggctttactgcttcattctgggattatgtatctgttcaggtgatttttaaaggtcactgagaaaatgttgggaaagaatcaaggaaataaaccaactcatatttgctccttttttggaaccctgaaaatggtctctgtggctaaatgtggcatgcagcaatcttctagatctgatgggcagaacccccaaatggtttctgtgtgaaatgccaaagccacactattacaaatagccaacagggtcaatgaatagtgtgaatgcactataactgaccttgagtactataaataaaaacaacaacagctcatgcttttactgaatgctgggtatccctgtccacaccacccaagaaagccatagttggtgtctagagctgtatggaactctgggcagcctagcatatatttatatatatatatatatatacttatttggaataggaattttacttcttaatgtggcatacgtgtgaagtctctaatgttactatcaactcatcctcaaaaaagcagtgccagagaagctccatttctggttctcagttaccacttaaacattatagtggtcaggaactgaaaaaatgatactagatctgtaacagcaagagtaatatgggaacagcagagccttgtagggaaagaaataatatgagcatgccaggtacttacacacttatgagtacctgaccctgtgccttgagtgtatgcgcggtatgccacaaaatcctcaagacagttctatgaagtaggtaaaagtctcccattttacagatgaggaacttgaggcttaaaaacataagtcatccttgctaggcacggtggctcacgccagtaatcctagcctttgggggaccaaggcgggtggattgactgagctcaggagttcaagaccagcctgagcaacatggtgaaaccccgtctctactaaaatacaaaaaattagccgggcgtggtggcaggtgcctgtagtcctagttactagggaggctgaggcatgagaatcgcttgaacccgggaggcggaggttgcagtgagccgagatcgcaccactgcattccagcctgggctacagagtgagactctgtctccaggaaaacaaaacaaaacaaaacaaaaataacacactcaaggtgtctcagttaaacacaatgattctattccactaccttgatgttgatttattcttggaatgtgccctctgatcactttctctctttggtatttttgggactaacagtgtagattttcctttagagatagtacagaatagtggtgattgagagcataggcaccggagtgcctaccacacatgggttcccacccttctttgtagataagcttcagtcaaggttacttatcttctgtgatcatgatttctgcatctgcaaaatgtggtaatagccatctcacacactttatgtatgtataacacttagcatacttctagcatatatttaacaaacgatatagttttttctattatttccagaaagtattgttcaactacactagttattgtagccaacaataaatattcaagttctgctcctcttctctgtttgtcagatacatatgtgcttacattgggcttgagcccaaagtcttttatctgccaaaaaaattaagaaactgaataagaagagacacaagggcaaagcaagactccccagtttagaacttggtttccaatagatctttctttttcagggcaatgggtggcaaaaccatgctgctcaaaatcacttgttttgaaacttaatggaatcaattacatatggagaaatttatatatgtaaaaatacagacatataactcagtggggaaaaaacagtcaaattggcatttgggtaacatatacaaagaatgtcatttaatgttatgaattgttagcattttaaaatagctactttgatattattttgattttgtatgaataaccattacactgggcacgtaggctgggcacagactaatagcaaagaataaaaatatgataaaagtgtgatccatcacaatttacagaaattaaagagattcattttactttggtttttccatatgtacagctgctgtattgaggtaatggtttcagataaaggtcagtttcccactttgccatttttactggggggagtatgaccggaggaggagagtggagcaagaagcaacattcataggatgctttctgtgtctccatacaatagtgtgtgccttgtgtggatatctcgttcaattccatccacacccctccaagggagaccctcatcatctcttgtagaccataaatttgaggtttagaaaggttaatttgcccaagagctcttagccagttagggccaggaataggattaagtcccagcctcatgacctatccacacctcacatgcttctttccaacaccaaatgtagtaaaaccagtacacagaaattcaagtcactttggatcagaaggtacaaaaactcttaccttgtttttgtcctttaggttttctaaacctttagtctatcctagtacataacatacagaacatatgttctatacatatcctaacatatgttctatacatatcctagtacatatagaacatatgttctatgtaaacagaaaggcaaatgcacatattagagaggaaacacgtgttcataaacacaggcttggttttcacatgatcacagccactcacagactctcaagcaccaatgcttgacaacgtgtgggaaaaccttgccttttaatttataaactttgactctgacaggtgacatattaatagtaactgtttataagaacagtgtgtatttctaagaatttattaactttattttttaaaattccttttagaatttatacatgcaaacattaagcataatagtgactatcagtctcaaaagtgtaatcgagtattttacctgataatatgcacctgtaatattaggtttgcaatgcaatatatgactatgtaacatgtgcctttctgctattaataagcattaagttctgccacagcagtgtggattaagccaagtgtagttagtggagtgaaacccacctaagaagatcaccatcagttccaccaaaaagcagtcaatttgataaaggatggtcaaaactgggaaatcttctagaaatggttcaatctatgtttatgtttttgaaaaacaattcattaaatttcctgagtgttctcattttttcgcatcacttacactttcagatagtgttcttgttttgaaacagtcaattccagaagaaagcactctgatcaacatggatcatagtgacaaggatctatgctaagctttgcctcttcctttgtcatccagatgctgcaaatgacttttgttgctgttcttgttctagatacttctggacacggtgtaaatacatctgatatgtatccaatgcccaataccttagaatatggaaacagaacttacaaaataattaatgcaaatatgacttggtatgcagcaataaaaacctgcctgatgcacaaagcacaactggtcagcatcacagaccagtatcaccagtccttcctcactgttgtcctcaaccggctaggatatgcccactggattggactgttcaccacagatgtaggtatcctaactcccttgagacatccttgaataattaagtttagcatctacctccttcatgatctggccactgaaattagcactgaaaaaaagatcccaaaaataataataaatataacacttaaataattggtttatgcaattacctgaccaaccttatgaacagcctatgactacaaaataagagtgcacacctctttagggtaaacatccacttgcctaatgtctggaaattaataccattcaaaggttctctgaaaatttccaagtaccccgatactgccttgcatgtgcactggaacacagctgaaactcaagcactgcatttgggaatttgcggcatttaatgaatccccaagaaaaaacgaatcatgcttcttgtctagaaatgtgattattaattagtttagtaccccttataattaagcacttgaggttttattttcctctagggatgtggtttagagaatacgttattttcatttttttaaataaaatattgtacactcaaagtagtgaaaagtaaactagtctatcctgacccctagttctactccctaatgttagtaattgtgaacactgtcttgtgtgccatctagaaattttccatgtatacacatacatattcatgtaatggaagaatatgtacattgtttttcaagcacaaatgagatcctattctacatgctgtctttaaacttgctttttaatttaatatatctttaacaacttcacatgtcagcacataaaaatctcatgaattctttagaacgcagcatgtaaggatataccacaacttattaaaccattctcctgtgaatagacatttgggttcttctcagtttttcacagttataaacaatgcacaacaaatatccttgtgccagtaggataattttttagaagtaaaattgctgcgtacacttaaaattttgacaagtactaccaaattgccctccaagagtttgcaccaatttacatgccaacaacagtatgtgataatgtctagttttttcacatccttgtcaacaccaggtattctcaaaattttaatccttgccagtgggagagataaatgaatgatatttcatgattatttattgcatcatgtagtacagaatgttttaacttcatgtagtcagttttgctttatagcctctggattttctatgacttggaaaggttttccccacaccaacagtataaaaaaatttaaccaggttttctttaacatgtttatgttttcaattttatgtttgaataattgatcaatctgaaatgtatttcactgtaaaagacaaggtactggtccaatttcacgccgattgctcactagaaaatcattgtggcagggagccaagaattcctaaaaatcaaaaaagatctcatttgtggcagatattcctgtttgtcaagctgtattcacagatgtcctagcccctctttaaaaaggtgtgcagaaatagcaatcgatgtgggaattgtagcatgctcagataacactgggtgatgctgccagccgtcgtggcaaggaaatgatggctcagttttcctccacagaatggtcttaattttgactggtctgatggcaccaaatcttctttcactttttggaaagatgaggagtcctccctccttggtgactgcgtttttgccgacagcaacggacgctggcatagcacagcctgcgagtcatttctgcaaggtgccatttgtcatgtgccacctggtaggttcaattctattcaactcaaaaatataccttatttaactactgtatgcaagacactgtgctaagcaaaggatatgaagatgagtatagtaagaactctctcttcaagaagcctctggtctggttggtgatgtaaagaataacagaactacaaaatgatataagagaggtagcaaatgttatgggggttatcaagaaaaagaatgcattgtattcatttggagaaaggtagaaaggcttcttgaaggacatggcagtgcagatgggccttgataaataggtgggtgtagatgggtaataatgggacatggaaaggcattctgaggagaaaagctggatgaaaatggggaaggaagacaggacgaggcttacgtaagacaaagccgatgttgggatttgcctgaatgcaggttaggcgtaagggagaggtgggaaattagatgagaaacatgggcttcaagcatgtgtggaggactttgaggattcatgtttaaataaaagattgataggattccagagctacaataatgatgatggtgatattgtttggatatttactagatatctggctctgcactttacataatatctcatttacacttaaagttcacctggcctaacccctttattaaaaatgaaatgtaaactcagagcattaaatagtttcctaagtgtctcacagctgtccatcaccagtaccaagagtagaaatcaagtttcctgcatagaattcactaacacaagctggcctccttttaaatctctcatttagtaaaagtgcatgtatttacttacattctgggtactgtatcaaataacatacaaattatatatttttagatcaaaacaattcaggattaaatgtaaatgatagccacatatatcttggaaaagctaattctacttctaaaactccataaaagctgtccttcccttttctccttttttttttttttttttttgttagcacttgccttttcttggaatcttgtcctttcaataacaatgcatttattgaatgcttaagaagtgtcaggctctaactcattgaaacttctcaacttgtaaggaaggtggctgtgtggctcacaccagtaatcccagcactttgggaggcagaagcaggaggacctcttcaggccaggagtttgagaccagcttggttaacacagtgagactcgttaaaaaaaaaaaaaaattcaattatctgggcttggtggtacgtgcctatagtcctagctacttgggaggctgaggctggaggatcacttgagcccaggagtttgaggctgcagtgagctgtgattgtgccactgcacttcagcctaggtgacagagtgagactttgtcttttaaaaagttttttgtaattaaaaaaaatatttttaaaggttttgttgttagctctcttttatagataaagaaaccaagtgcaaggtaacatgcccatggtcacgcagctagtaagtggtggagccgggatctcagcatggatgtgtctaactctcatgcttgctctctgaaataaagtccctctggagttcccttatttattttatgttatgctatgttatgatactttattgaatgcattattttctttcacaggtttattagtgggtaaggacttttcaaatctgtgatacacagcactgcatgaaatgcatacatttggaaatctcttttaccagcatcagtcagctgccactctctctgggagtcatagcccctgcttgttccaacctttaggatgctaattgtaaacatgaaagagccaccctcacccaggcagcacccaaactaagcctacaaagctgtgccttaacatatcttgttatgtttaggtaaagattatttctgtcagaaatgctataaactggtcctagttttataatcatttacatgaaacccaatctttcagagtattaccatgaaaatcttgttacatatatttatcttgatcttttatagaatgtaatgtaatatttatctcaataaataaacccagtcaccaccctgaaatcataactggcttttcttcacagaaacaagacaatctgaacacccagagttgtgctcagaaacatctattccctggataaaatttaaaagtaattgctacagtttttctacagtcctagacagtatgagttttgaggctgctcatgaattttgcaaaaaggaaggtaattgtttttgtgatggtaaaaatgctttcatgtgctccttcttgccatttcagtaaacaatgtggatttctttattcatcccattatttagtgactttaggagcaacaaaaactaaactattgaaaaaataaatactattgaaattgcttgtttggaggacagctactatatgaaacaatgtccagtgtagaatttggaaacctaagatgatgtctcagcatactgcactttctgaagaaaacgttccttttgcatgcatttgcattatgaattttgaatgttccctaaaattaatattctatgccttaacttctgacgtgcaagcttgtatcttttaaaaaatgtggttttacttttttaatttaaagtctcttctttataatggaaattttcacttttcaaaacctgagctttacaattaatagtataggaaacattttttaaagtatatttatgtgtaaacacaaatattcctttgctacttgtctctcttataggttctaatcttttaacaatcaaggatgaggctgaaaatgcatttctcctagaagagctgtttgcttttggttcttctgtccagatggtttggttgaatgctcaatttgatggtaacagtaagtgatttgggtagaggagaggacataaataaatacatggttgttaaagctgatgataatggcatctgtgagccagaaaactctccttggatacgttttctgagaaaaaatagcatgaagcctaaagccatttcttccaaaaacaacattgcaacccttttctttacccttttgtcttttaaaataatcccagaacaccaaaaataaaaacaaacaataacatgtttatctttacccttagcaggaagatgcttggctggaactttgtgttcacagacttagtcattgcataccaaaaccatatttactggaaaatatcccaggtttctaaatgttataaaagcacaatagagttatggaaatgtttccatgatgaactgtgctgttaggattcttatttgctactcataaaaaccagagtttgtaataaaatggaagcatggtattcttttctttatgtaattgatggttattgaaaggtacttgtgaagaaaattattttaattggtatggagagcttgttacagtggtgtaccaaggttgggggtgagcctaccctttcgaggaggagtattttaatcaccaacattgtttagaatttcaagcagatggtgataataaaaagcagaccaacttttagttagctgtattgttagttttaaattattttcagacaatacactattgcccacacatgggatggactctcctaccgcccctacccccttggtacatggctggcttggtattaaagaaattcactgtaaaatctttttagaaagtgagccattttgtaatgatgaagatgttaggacttcaaaggatttttctttactcgattagttttgtttatcaaatgatttctttaaatcgattatatatatatatggaatatttcaaaattcaaactgtcacattaagaaacatgataacctaaatgacctaaataagaacactgtacctaaaataaagaggcaactttattaatgcctaccttttgatgttgagtacatcactgtatttactgagttgaatgtattagttcaagagtctcattaaattcaggggctgccatcccattactgggtatatacccaaaggactataaatcatgctgctataaagacacatacacacgtatgtttattgcggcactattcacaatagcaaagacttggaaccaacccaaatgtccaacaatgatagactggattaagaaaatgtggcacatatataccatggaatactatgcagccataaaaaaatgatgagttcatgtcctttgtagggacatggataaaattgcaaatcatcattctcagtaattatcgcaagaacaaaaaaccaaacactgcatattctcactcataggtgggaattgaacaatgagaacacatggacacaggaaggggaacatcacactctggggactgttgtggggtggggggaggagggagggatagcattgggagatatacctaatgctggatgacgagttagtgggtgcagcgcaccagcatgtcacatgtatacatatgtaactaacctgcacattgtgcacatgtaccctaaaacttaaagtataataataaaaaaataaaaataaaaataaaaaaataaaaaaattcaggggctgctttttatggttaattccagtcttagtatgtttgataaccatgcacataattcataatgagtcagcaattttctcacagatgaaaccataaagtggtttgatggaactcccacagaccagtcaaactggggcattcggaagccagacacagactacttcaagccccatcattgtgttgccttgaggatccctgaaggattatggcagctatccccgtgtcaagaaaaaaaaggctttatatgtaaaatggaggcaggtaggtaaagtcagagagtaattcttcattttgattctaccttaactaatgttgactgacttctttagcatttaaaggttttaaaatccaagttgagagagtattcagatagattctgacattattgttgtgttctgcaccaaacaagtcagagaatagttcagctccttctttctctgatatgagaaaaaaaatcattataagtcaactcaaagactatgatttttcttgtgtcacccaggttgatcacctaatgggcaaaaaatcattttccctcaagcaaatagaactaggaatgtaaaccagcaaccttcattctggtgactgctactcagaatttttaaggtttatgtttggcctcaggaaatataatctaggcttatgtatatttgctgtagacaagaagatgtgattccctgttgcaagcataatgtgtcataaaagtcacattttaacttaatcatcagtaacatacttagtgtttagtaattaaaaaaaacaataattttagaaatctaagctagaaaattctagtcactgatggtgggaaaatgtctataataattacagcaatttctagatgtcagtattataaaggagggattgctgtggcctgtactgctagagaaggcttcagacatgaggttttaggatcccaaaggatgaagagaattatagaagctggaacagaggaggaaaaggcccagcctgattaaaggcagcaactaagaatgtgtttcaattagagcaaagggctcacgtcagggggtgatgggaataaaattggatggtaatgtaggatcctttcacagagtgccaggctaaagagctgaactttgtggtggaagagacagaccccctatgtgctctgtagacacctgtgatgaagtagaactcatgaggatatgaagagaaacatttgtaatttgagtgattaaactaggaacgaaagaggaggggagaaataggaagagagaatcaccggccctgttgactgatttgagctgggaatgaagaagaaaacactgcaggtgtgggcaccaatgtttgaaacccccacagtgtgagtctcaactctgtgtgagagaaaaaaaaaaaaaaagaaaaacatggctaagcctgataaataatgtgcccaagttatcactagcttttaaatatcaagaacaaatcagaaacacctcatgtcttacaggactttaaagtttcctataatgcagatgacacctgtttcatccttcgcagcagctttccaaggtagtggagcaatttaaatatccccattttacagacgggaaaagtgcctgtgcaaactgaggctacatcaaggactacagagaaaactctaagttttctaagtgctctttccatgccgcccactgcttctatcctgagaacaaacactcttaacagtctttcttaaagatgtatctttatgtttaaagtgatggttatcccaagtacactatacaaattatatgactatattcaattatcacttgtgttctgaaaatttgtgcatctgatatgcatcaatttaaaagaagtgtcttcataaaaacacaataatacatattttcgacagtttaatgcaacgttaaatggcattgtttttatattaaaagaacaagtctgggccgggggtggtggctcacgcctgtaaatcccagcactttgggaggcagaggcagctggatcacttgaggtcaggagttcgagaccagcctggccaacatggcaaaactccatctctactaaaaatacaaaaattagccaggtgtgatggcacacacccgtaatcccagatactaaggaagctgaggcaagagaattgcttgaacccagggcagaggttgcagtgagccgagatcacgccattgtactctggcccgggcaacagagtgagacttcgcctcaaaaaaaaaaaaaaaaagaacaagtctggttttaaaagtatggttttgctattagtaacagtgttgtgatttttttcatgtctatcagagtgaatgagcatcagtaggacatcaaggcagttcttttgctcacaaatccatttcttcatcttcctctggttcattctctatacctttctctggatctttacctagatcaaaaatagaagagttcacattttgatataacatctacttaaaagatgtgtttttacagtagaaagttttaaaacagaaactctctaactttttggatggagaagctgttgctcattccccaagacccatgagatcacaaaggtgagaagatgctgatttaaaaatccttacaaagagtcaggcagattatcattgctggacaaactccatataagatcccaacaaaactgtgagttccttgtatgcagggtttatattttactctatatttattgcagcacagtgctgggactgaatagaaacttcttggcttaaaaaaaacaagcagggtgtatgtttgtgagcactaataacgatgattacaataaatcaaaggtcagcaaactttttctgtaaagggccagctagtaaacattttaggctttgggagccatatggtctctgttacatgccattgtagcaggaaagcagctgtaacaatacatcaatgaatgagtgtggctaagttccagtaaaacattttttataaaaatagggtcatgggccatagtttgctgatccctgagtaagtaatgacatatttttgctgaattaaaagaaaaacctcattttaatttttgtatttgattttagatattcacactgcagaggcgctgccagaaaaaggtacgtttgaaaccatacaaaacattttgatttttcttagaaataataagatagaaagcagctgtatgacagtatctatattacttcatcgccactgaagtttttctttttttaagaaaaatatcttctttcaggaccaagtcacagcatcattcctcttgcggttgtactgacactgatagtcattgtggccatttgcacactttccttctgcatatacaagcataacggtggcttcttcaggagacttgcagggtttcggaatccttactatcctgcaaccaactttagtacagtatatttagaagaaaatattctcatttctgatcttgagaagagtgaccaataataatgaggtcagagaatgccacagacaccagggtaagtaaagaagactaaacaggagtctcatctgtctttccctttacagcacagatgccattagaatgtgaattgggtcactattttaattattcttgaagtgattactggttttgaatcttaaccaaatcagatgggttttgatttattcatttccctaaactgtgatccattcttaaaaggggtaaattatgcattggttatttttcagaaagacaagaactattaaaagaaactccctattgaaaactctgaaatcaatgcgaataatagtttttgcattaatgtatctctactaaaatttgggggaattttaaaactaatctggtatctattcagacatttacctgcactcgtaccattaagaaagacagaaagaagcaaaaaaaaattaatcttgtatatgagaggaaaaggaaagggcttctgagaggattcttagttgtttcttttgaattcacttttaatagcaggatttggaaaatactaatttctgtgcttaagggtcacaggttctgggctctcaactgatatttaaggtgacattcatttttattaggtctaacatctcaagctaaaggagaaagaaaaataccttcttttaaatggcaaagaccttcattagcagcacacttttataaacaaccatatagttaaaatgtggccttaaactttcaattactaaatgatgattaagttggatattttaaaatgtcttatacataagcttaaagtaatatattgaaactttaacagttgtactgttaaaactcatggactttctgaaaaactaaatatataaaataatatgtaacactcttaataactggaagatataaaatgtaacttggatttaaaggagaagagctaaagatctgaattatagtctcattagaaccagacagatgttgttgagaagtactaaataaattagtaatctagatatctttattatgtaaatgagtttaggtgttctatttaataaactattttctgggaacgatctccttttatattagtctagttagtgtagatggtaaataatgattatgatactgtctgtaaataaaaaattacagattttattttcctttattagttccttataaagaaaacagcttcataatcaatatctaaaaatttactcattacataactgtttattgaattttatcaagaaaaaagtgtactgagcatggtggcacgcacctgtagtcccagctacttaggaggctgagggaagaggatcaactgagcccagaagttgaaggctgcagtgagctatggttgcaccactgcactcctgcctgggcaactgaatgagaccccacctcaaaaaagtgctgttctagaaacagaggtactaaggtgagcaacttggggtaagggctatcttttcatgccacttattttctaatgagggaaaattgacagtaactcagtaaagaaatgcatatgcataaaatagcaagtggttatgaaaatgaagtaaggttccatgatagagagaaactgggggactctcagggcctccctgagagtgtgcattttaattattacaaccaactgcctcaaaaccagtggccactaatcacaagggggagctctgagagaaagtatgaatgaatttctaagaggcaaaccatcatcattagaaatacaatttgaagagcataccactaagaatggaatccttgtggcctgcaacagttaatccagcttccaaaagcagctctttgctactgttataataatttacacactgggacagtctacctccataatttttttaagtattgggacttcattttttaaaagatattatattatgtggcagttgcatatttatgactcaaaaaataattggcttgaactcaccagatggtataaaagcccaatttaaccatcttttgagtggaattaaagttctgttcttttcaatggacttggtaaaaactgctaatcaaccagccttccagtcaaggtatatagtcacacataataatttgacaaaatacaccattaggaaagtgattttgcagaaagaagctgtattgcttctcagtgctccatactttgatgtttagtattgaacaacatctccagataatctggacccatggacagatcacacacttcttgccattactgaatttgcagaaatagtactgaagtattctgctacatttttatatttgcattttttttgaaactttttttcatttttttttttttttttttggagatggagtcttgctctgttgccaggcaggagtacagtggcatgatctcagctcactgcaaccttcaactgcctggttcgagcaagtttcctgcctcagcctcccgagtagctgtgattacaggcacatgccaccatgcccagctaatttttgtatttttagtagagacagggtttcaccatgttgtccaggatggtctcgatctcctgatctcgtgatccacccgccccagcctcccaaagtgctaagattacaggcatgagccaccgcacctggcctcatctgtatttttaatgtgaactagattttatagctataattcgaaaagaaaaaaaagtagcaggtaatgggtatattatacactatttgcgtgatggttacaccagactttaccactacatactgtatttatgtaacaaaattacacttgtactccttacatttatgccaaaaaagcggcaggatcacaaattcacacatagttaatgtgcccctccaacagtcaattatgttctatgactaacctgaggatctttatagaatctgagtaatggaaatgcctgggtttttccatttaacaatatattgggctcttacagttacaacagtcttctttcgggttaaatatttcttctcttgaagggtccactccttattaaagataagattgaactgaatgtttacttaaacgttcagtcttttggagtttctttactcttctcaaaatggtggttggatttataagaacttgctgt

SEQ ID NO: 14187 - DNA, 69701 bp, Human
agaatattcaacatcaaatgcctaagctaatttccaggctgagaaaggtaaaccatccttctcctgcctgcagtgcttctatcggtcctgaaagagacagaggaggtaagggagaagaattggtacgaaatggtgcagagctggtctcagagggcaacaacagccagccctccatgaccacactcccaccgtgcactcacgtgcccctcttgaagcggctctgatcctgtgacctaaccagtttccacctggcttctctcagtgcgttgccatatagtataattttttgtttgtttgtttcgtgtagggttttgttggttcttttccaagtatcaatcaaaactacatgccaacgtccactccttggaaataattaaatgacatgacgtgcctgattttttcagctggtgatgcactgtaatttgcatctgctgaaggaatttatcttaagtcctgaagcccagccacttgagacaactgaggtgatttttctgctctgcttttgctcatgcggatggtgcgttattgttaaacacaaaagtggactaattgcttcattctgcaacctactccgtgaagaaagctgctcttctttgtgaagagaatatgttcatgttttgttcatgaattccatgcaatttcccatccccttgttaagtaatgtagcttctttatattggcaaaattccctttatcttgctgtgacctgcgctttgtcctcccgagcagagcaaatcatctgtggtttaagagcagctttggattcaagtccccttttctcctgtcgagggaagtgagtctatgaaatggccttcatctgaaagccacagcgaagcacctcctagcccaagtctagctgctgtgtggcagctccagcggcgtgaactgtgactgccctgcagacacctatcaagcgctgcgtcagctattaataataaaatcaactcttctccctcccccccgcgaggggggttccctcgtcagggcccagaacccgctggggaagaatcggggctggcgtgcgaaggagctggcggcagggggtgtaggatgcggtgttcccgaggcgacagatgaaggatttgggttgtgtgggaagtgaactgcggaattcctccccttggtttctgaggggggctctgaaggagccagattaggatgcagagcgcagcccgggcgaccgagggcgaggaggcgagccaaggacatcagcccgagggcgcctcgagacgccccgcgtggaccgcgctcccagctcctcggcctcgccttccaaccatccgcccaccggccccagagcagcgtgcccactgtgagcgccccaccctgcgtctgcaggtgggtgggtcagagaaccgcaggcacagaagagggtacccagcttcccctccgccagccccgcgaccgcggcgcgcgcggcctcgatccgggttcctaggggcggcgcgcgggagggggcggggcctgcgcggcagcgtgggcgccaggcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacggtaggtgcagggcgctccgctgcaggggcccggcgcggccgggagagccagggaagatggctgaccgggctccacctcgtgggcttcggctccgcgcccgccgacagctgcgggcggagggtcgggccagcgcgccggccccgcgggagagaaaggggctgcggtcctcgcctcgccttccctggacctcttcgcttctcgggccctcgaccttttcggcgcgcaaggctcggaggcttctctccagcagcagccggccccggtggagggagggacgtggcttctgcagctaggttgagcccggcaagacgttttctcgtcccctgccgatttatgaggagtcgaggtcgttggaaggcctctgaccgttcttgtcctacccaaagttacacatctggcagaagtgatgacatcgctgaaaccactcctaggttcaggagcccgaagtgatttcacgcttagggctagacctcaggccattgattacaaagagtgcatgcttccttgagatatcttcgtggtatgccctctgctaaaaaaatcggatattcttatagctaggtctgtgttttaaagatattgatgcttagaattgtagcagttctttttagaaaaacgaagtgctaaaatgtctctctctttttttttttaacctccctcttgacacattgcttgacgaatttctacattctacagagttaccggctgaagaaggtaatcttaacatgctgtttctgttttttttcctctgttggtgtgctgatggtaagatgacagttaaaacacatgtgtttgtttcttacaggaaaaaccttgctggaacttgtgattgagcagtttgaagacttgctagttaggattttattactggcagcatgtatatcttttgtaagtataaaaaaatttattttctttccccccaaaagctgaaagtattccatagataaatcagaaaacaaatgatgtccattgggtgaaaacatatttggagttgcaagctgtgtctctatgtttaaaaacaatctgggcattttaaaattacaaaacaaaacacttgaagccattggtattcagaaaatagatgcctgacatttacagtgtggttaggagttgtcccagagtgtggcatggtcttagaaattcttgtggtttatcagcttttaatatcaaaaagttcttttctgggaagcctttaatgttttgggttcttccattgttatcgtgttgtaagatcatactaagatgatgttggactctttgtagtctgtaaatagaacttacaaaaggaatattccagttgctttcccttcctggtaatggcaaggtgacagttgttcctgacggtgacaagaatgatgacggctgtgatggcacccttgttgaccaaatttggtcactgacctttagggtggtatatttatctaaattggacccctgtcttaagtgattcttaggttgaaagaacaaggtttagtacagttggttctagatcttaaaggaaaaaaaccagcatggtgttttttcttgttctgtgtgtgcttacccacttgagtgctatatggttgctaagaaactagtgaaatgcaaagaactacagcagaaaaagggtgttggggtggcaagtatatttctaggtttttaacttttttttaaatgttcggtattaattttttgttgcattttttttcttgggcagtagattgcttgctagttttcctaaaaatggtcaggaataggacacagatgttcctaattctaatagcatgagatgccttttattcttgaattacgttattcttacaaaaaccacgataagtgaaattcacccagtgcagtacttctttctagttaaaacaaaattgacaaaacttcacggtttcagttcttgtacatatatgtatgcaggtcccagggatcagcctcagtctttgtgagaaccataccatagagggctattttgagaacgaaataaacaaagcagtgggcatttatttagttcagatgaggaaaagattaaatttatacccatcttttaagtagatagtggcagcagtaaataaatttgtggaataatttttacataaatcctgctatgatactttattatgccatattagccaagtattgtgtagccattaataattcagtccccaagaaccttttctgtggttttcattgattaaaatggggacttacatagcaaaccattcagcattctgagtcagtcacaatgtacctctgataaaatgtttcttcttgattgattaaaaaattttcccccagaaaatggctgctgttttaccaattaagggaaatgagtagacccgattaactatagtttatcaatacattgtcatggggcaaaataaatgatacatttggagctagtgtaagatttgtatttaactgggtacataatagcgttggcagttaaataatggggtccgataaggtcattgggaacttcttaaaaattaatcagctgactacaagccagaagcaaaatacatttttactgaattctctgtgttacaagttgaagcagtgtgggaaaccatgccactggtgttactattggggttgcactgggtctgttttttgagtggccagtttgagtgactttatattagcattttaaattaatgatgtgtgtgggttttgtttgttcattttttactttgaagtaattagaggcttatagtttgtaagcatttcaagcaggtttttaaataaatgctttaattttttttataagataggaccttggctttgtggagcattatagagctatattttggagttgaaatttgagctcctttttggtaactgtggagttactgctcaggaaatgaactgtgttacatttttattttatgagttggtaaatagcaaaagaataagtgtttagggagtacttctatagaattaatttgctttggtttgtttgatcaaggaattgcagatataagacctgttgtgttgattttcttcatgtggggttgggtactgctgctgcattgtctttagtgtttcattcctcctgtctgtatcttttaaaagaaagagcactgactctctttttgtgtcagtttattcctattgatgtaacagaaaaaacatggtagaatattcaggtttttttggagaagtgactaggcgattcttatatacatcatgcgtcatcaagtcatgcttaaattaaaaagaatattagtgacttacttcaaatatcaaactaagtagtaaactgttaactatagttaatattttgctgtggcatagaataggaagctatgcttgtgacctgtagggatctagtttaatttgtaatattggccaaagtgtttttttgaaacggtcacttggattgaaagaaataagcttcatcttccagtgcatatgaacattagaaattgcttaatttgacactgaagaccccccctctatcattcactttatcttttcattctcttcttgattaccaactttgttctaaatgtaacacatcgtatggttgcttaactgatgcctgtcctttcttctcttttcctgctttgttaagatatttattgagcacctgtcacagacactggggatacagtagtgaataaaacagacagagacccttacctggaggataatactgctgagaaaaataaagcaagggggtttggatatcagagtatgtgaaagggggaacagttttcaaattgggtggtccggaaagttcttgaggaaggtgacatttgcgaaaagatctgaaggaggtgggcattagggccatgttggtctcccatctgtctaaatcataaagtcataattaatatggtaataatttgcataggtttctctaccttccaccgtcgtttcccatgtcagctacttagattgaccctaaaatgctaataaaactttctagactgtggtacttctcaacctttaggttacatttgaccatttgcatgtgtgtgtctcttttcttcctactagacccccttgagttagtgcttttttttttttttttttttaaatgtagatggagtctcactcttgttgcccgggctggagcgcagtggtgcaatctcggctcactgcaacctccacctcctgggttcaagtgattctcctgcctcagcctcctgagtagctgggattacagatgtccaccaccacgcccggctaatttttgtatttttagtagagatggggtttacctttgttggccaggctggtctcgaactcctgacctcaggttatcacctgcctcagcctcccaaagtgctgggattacaggcatgaaccactgcgcctggcctaagttagtgcttttgatgtcacaaaaacttgggtgagtttgtttcagtagaattttctgaaaatacatgagatctttttactgtagtttctcagaagagaatactcaaagcatttgatactggatttgtagtgattttaattttcttctgtatcttttaatttttgattttaaaaatgggataagaagggcaaattactgattggtttaactagtttattcagagcttttcttaaaataatgacttgaaaggtggatttaatagagtactttttaaaaagattgttttctcatgcctgaaagcattgaatgtttttacatagctttatatctggatcagaagggaacgagttctaattcatgcttttttttccgttttattaatgactgaaagtcctcccccagaaattatcgtaacgtttattggtaattctctgtatcattctcgaaatgtttaatttccatttcctctttatttaaaaaaaaaaaaaaacttgatgtaaatttcttcatttattgagcaattgtttgagggcccaaaggcacagtgcaagtttctgagaatactaggagcaaaatgtgcttatgatctttttaagcacttttttctttcgttttctttttatgatactaagagctcttcctattatcacagtgtatagatatctgagtcacaatatcatgactgtctcccagtttacagcagaacgtgctttttaccttggattaaaatttgctttatttggccgggtgcagtgagtggctcatgcctgtaatcccagcactttgagaggccgaggtgggtggatcatttgaggtcaggagttcgagaccagcctggccaacatggtgaaaccccacctgtactaaaaatacaaaaattagccaggcgtggtggtgggtccctgtaatcccagctactcaggaggctgaggcaggagaatcgcttgaacccgggaggcggatgttgcagtgagccgagattgcgccactgcactccagcctgagtgacaaagtgagactccgtctcaaaaaaaaattttttttttgctttagtatacttatcagaagtataatgcagtacagagtgttgtacagtatttcagtgctgtacagagattaatcttgtggataataattgggagatactctatccctactctatttttaacagtttaatgtagttgagtgttcattagcaagtggttactttgaataatactggcacatttgaagcattgaacttgtttgataatgtatgtcccagaagacaggtattattgtatttagcacaaagcaaagggaagaagaaacactgtttatgtccaaaactatggggcagtggtcttctcttttacttttctttgctgctgttcatgaagcttgttaccttttcgctgtcttttttttgagacggagtcctgctctgtcgcccagattggagtgcagtggtgcgatcttggctcactgcaacctccacctcccagcttcaagtgattctcctgcctcagcctcccgagtagctgggattacaggcatgcaccaccacgcccgggtaattttttgtatttttagtagagacggggtttctccatgttgaccaggctggtctccagctcctggccttaggtgatccgcctgcctcagcttcccaaagtgctgggattacagacatgagccacctcacccagcccagataatccttttacacactgtttaaaattttcaattttcctggagatagggtctcctgtcgcccagcgggtaaatgcagtggtgcgattatagctcactgcagcctcagacacctgggctgaagcctgattcttgagcctcccaagtagctgggactataggtgtgagccatcatgctttgcccttttttttttttttttttttttttgaggcagagtctcactctgtcacctaggctggaatgtagtagtggcacgatcatagctcattataacctcaaactcctggtttcaagcaatcttcccgagtagtcaggactacaggcatgccctgccatgcccaactaattaaaaaaaaatttttttttatacacatagggtctcactatgttactcaagctagtctccaattcctggccttaagagattttcccaaagcattaggattataggcatgagccacctcacccagctgaaacagataattctttttttttttttccttgagatggagttttgctcttgtcagccaggctggagtgcaatggcgcgatctcggctcgctgtaacctctgcctcccggggtcaagcgattctcctgtctcagcttccccagtagctgggattacaggcgtccaccaccacactcggctaattttttgtattttagtagagatgggttttcgccatgttggtcaggctggtcttgaactcctgacctcaggtgatctgcccacctcagcctcccaaagtgctgtgattacaggtgtgagccactgctcctggcttgaaacagataattctttatattcaacctgttgtcaaaatttttagaaacattttcccagttccttgtataagtatactttgtataacttctggcaaaccataattatgaactcacattactatagtactataatactgcagtaagggatcttgcgtttcagtaatgtcactcatccagttttcctcccctttctcttaccccatctccctcccagtctcatggtttctgttgtcaatcctctttctccttacacaaggcaagaggttttcttaccaatagatcagaactgtgaaggactgcccgacatgatctgatatggttgttcttcattttgggctgtagtattttaaagtagaggtttgctctgatggtcccatcactgcttgccattgtctttccctttgctctagctatcaggggatgttgctttaagtttgttccccaggctttactgccaagagggaaattcatacccactttaacaaggtgtgaagcttatcttacagttgctaatgcctcactgaccttttggaaaggtcatagttactcttcaagttgagcgatttttctcccccaagagctaattaaagtttcttgtttctgatatgctctccttggcaaatgtttgaaagtctagtatcagagcagctgtgatcctgcatctatcaaaatttataacttcctagagaagttttcattctggcattattcctggccttaacactagaatgccctgttgaaagcatacagtaacatttattatactcattctggttgtctgtttgccctagctcactggacgttggtggtgattggcatctgtcaggacttggtggtcctggtgcctcctgtttttatttttctttttgtcctgctcaaacagatatttcttattcatgccgtcttctaatgagtcatttggattcattattgccataaatcatttggaggagtgttttcatgatttactaagtagatcttttaaagaagattttattatgaaatatgcaaacattttaagcaattttttaattaaaaaaaattcgacctccaagattaaatcattagatgtggttaacactgtttctggattggtaagtttccacaaaaagaggtttttaaatttttaaccacatagaccactctttaccatattcattattcttagtattcattgtggtgagttctctctttttaccacgtttatagttgttggattgggaagtgcagtgtgactcttactttgtagtttttaaatcttaacaagtttatagttgtatgagctaaaagtttaaacctctgccccattttcttggggcagtgttctgtgaccagttacatttttggacttaggttatctctgaagtgctgtgttgctgtataaatgtcatatggaggataacctacaaaatacacttcggatctcccaacagctttgcggttctgaaacagccttcagtagtaccactgaaaagaaacggggaattaactggttttttgtttcttttatagagatgagggtctcgctatgttgcccaggctggtctcaagctcctggcatgaaatgatcctcctgccttggcctcccaaagtgccgggattataggcatgagccactgttcccggcctagaattaaacagtttatatatgctctaaaatttaagtcagtgatcaagttgtttatactgtggatttatgtcacatggatattacttgatatgaataataactaaatgaacatgactgttagatgatcaccttttactttaatcaagaattgaagttttattttttctaaatagatacatataaaatgaatggaatttattccctctccccagattttatttggattctaaaatggaattattacatcaaaagataaggtatttttaagaagtatagttgtttttttgagactgagtcttgctctaacgcccaggctggtgtgcagtggtgcgatctcagctcactgcaacctttgcctcccaggttcaagcgattctcctgcctcagcttcccaactagctaggactgcaggtgtgcgccaccacacctggctaattttttgtgtttctagtagaggtggtttcaccttgttggccagggtggtctcgaattcctgacctcaggcgatctacctgtctcggcctcccaaagtgctgggattacagacttgaaccaccacacccagccatgaagtatagttttttgtttgttttttgagttttgcttttgttgcccaggctggagtgcaatggtgcgatcttggctcaccgcaacctctgcctcccgggttcaagcgattctcctgcctcagcctcctgagtagctgggattacaggcatgcaccaccacacactgctaattttgtaattttagtagagatagggtttcttcgtgttggtcaggctggtctcgagctccagacctcaggtgatccccccgccttggcctcccaaagtgctggaattacaggcgtgagccatcgcacccggcttttttttttgttttgagaccgagtcttgctctgttgcccaggctggagtgcagtggcacgatctcggctcactgccacctccgcctcctaggtacaagtgattctcttgcctcagcctccccagtaggtgggattactgacacacatcaccatgcccaggtaatttttttgtatttttagtagagacggggtttcgccatgtcggccaggctggtctggaactcctgacctcaggtgatctgcccgcctcagcctcccaaagtgttgggattacaggtgtgagccactgtgcccagctgaagtatagttttgactttcaagaattcttatgaacaagacatagccagttgtttatataattgcattttctaccgtttatttctagagaaagaaaatagattttgtctatcataatccctttagtgctagccactttttttttttttttttttgagttttcgctcttgctgcccaggctggagtgcaatggcatgcagtacactcacggctcactgcaacctttgcctccccaggttcaagtgattctcttgcctcagcctcctgagtagctgggattacaggcacctaccaccatgtccagctaattttttgtatttttagtagagatggggtttcgccatgttgggcaggttggtctggaactcttgacctcaggtgatcgcctgccttggcctcccaaagtgctgggattacaggcctgagccaccatgctcggccagtgctagccactttttaaaaaagtgacattaagcctaaaaagacacattctaacgtgccatttctcttctaggttttggcttggtttgaagaaggtgaagaaacaattacagcctttgtagaaccttttgtaattttactcatattagtagccaatgcaattgtgggtgtatggcaggtaagcaaaaattcctgtactgcaaaatttcaataagttatgtaagtgattagggctgtattaatctttctgttatctgtttttcctgatgtgttgagtaaaaatatgtttgcgggaagtttacatgtattttccctttattccataaattaattgttttctgacacagtctcactctgttgcccaggctggagtgcaatggtgttgtctcggctcactgcaacctcttcctcccaggttcaagtggttctcgtgcctcagcctcccaagtagctgggactacaggcacgcaccaccacgcccagctcatttttgtattttttggtaagagacagggtttcaccatgttggccaggctggtcttgagctcctgacctcaagtgatccgccctcctcagcctcccaaagtgctgggattacagacgtgagccaccatgcccggcctattaatttaattaattgcaaatttttgaccttaatgcatataaactttgcagttaagattgctcattcttcgccaagtgtggtggcaccagcctgtagtctcagctactcaggaggctgaggtgggagggttgcttgaacccaggaggtcaagactgtagtgagccatgatcgtaacactgcactccagtctgggcaaaggagcaacactgtctcagaaaaacattgttcattctttacggtagcaaggaattaaaatgggtgagagaagctgcttaaggaaatgagaatgtgagaaccattatctttatgtctcctagttgcttcctgtgacaaactttaaaagctacatgtcatttttattctccttgggtttttttggtaggtttagctataaaaattgtttccccttcagtgcttactacagactctgagacttaaaattcatgttaagtgttgatcttttaggtatttgacggatataatcacccctttgaggactgaagtagaccttttttttgtttttgttttgagaccgactctctgtcgcccaggcaggagtgcagtggcacgatctcggctcactgcaacctccgcctcccaggttcaagcagttctgcctcagcctccttgagtagctgggattacaggcacctgacaccacacccagctaatttttgtatttttagtagagacggggtttcaccatcaggctggtctcaaacccctgacctcgtgatccacccacctcggcctcccaaagtgctgggattacaggtgtgagccaccactcccggcctttttttttttttttttttttgtttgtttgtttgtttgtttgttttgaccgactttcactcttgttgcccaggctggagtgcaatggtgcagtcttggctcactgcaacctccacttcccgggatcaagcaattctcctgtctcaccctcccgggtagctgggattacaggcacgtgccaccatgcccagctaacttacttacttttaatagagatggggtttcattttgttggtcaggctggtctcaaactcctgacctcagatgattccccctgccttggcctcccaaagtgctaggattacatgcgtgagccaccacgcccgacacatcttataaacatacttagtcctgttgaaattgtaaacttctaatctttaccaataaatgttaacgatctttatgtggtaggttcatagaaagatggcctacttagagatttgtaattgtgccatatatatgtgtgtgtgtgtgtgtgtgtgtgtgtgtgtgtgtgtgtatatatttttttttttttttttttttttttagatggagtcttgctctgttgcccaggctggagtgcagtggtgtgattttggctcactgcaacctccgtcttgtgggtttgaacaattctcctgcctcagcttcccgagtagctgggattataggtgactgtcaccatgcctggctgttgttttttttgtttttttgagacagagtctcactctgtcacccaggctggagtgcagtggcatgatcttggctcactgcaagctccgcctcccgggctcacgccattctcctgtctcagcctcccgaatagctgggattacaggtgcccaccaccacgcccagctaattttttgtacttttaatagagacggggtttcaccgtgttagccaggatggtctcgatctcctgaccttgtgatccgcctgcctcggcctcccaaagtgccgggattacaagtgtgagccactgtgcctggccttcttcttatgtttttctcaaaaaaattatatttggtcagggcatggtagctcatgcctgtagtatcagcagtttgggaagctgaggcgggtggatcagttaaggtcaggaggtcgagaccagcctggccaacatggcaagtccccgtcgctactaaaaatacagaaagttagctgggtatggtagcatgcgcccccagctacttgggaggctgaggcagggcttgaacctagggggcggagtttgcagtgagccgagatgatgccactgcactcgagcctgggcgacagagctagacttcgtctcagaaaaaaaagattcgagtttttaaaaaaagaacattcttaagtctttagtatactgaatggtatgagcagcaatagagggttgtggccttctgaaagtaaggaaaattataatgacagtataaggtagtatgaggggcatagtcttttatttctgaccagtgtcatcaaggagggctttattttttttaagacggagtctcgctctgtcaaccaggctggagtgcagtggcacgatcttggcccactgcagcctccacctcccggactcaagagattctcccacctcagtctcccaagtagctgggattacaggcgtgcaccaccacgcctggttaattttttgtatttttagtagagacagtttcaccatgttggccaggctggtctcgcactcccaacctcaggcgatccgcccacctcagcctcccaaagtgccgggattacaggtgtgagccaccatgcccagccttttcattgattgtaattgtcatctttgttctcagggtcagagataatttatcttttttttcccccaagacagcttcactcttgcccaggctggagtgcagtgtcataatcacagctcactccaatctctgcctcgcaggcttagtgatcctcccacctcagcctcctgagcagctgagactgcaggtgtatggcaccatgtcaggataatttttgcatttttcgtagagacactgtctcgttatgttcagcccaggttggtctggaactcttgggctcaagcagtcctcttacctcagcctcccaaaagtgctgggattacaggcatgagctactgtgctcagctgataatttaagcacatgcaaaatacagtgctcatgggatatttgtttaaccttgagcagtccagttaaattccacccaacatgatcttgaagggtaagaatgtctgatatgagattgaaattaactttatcatgaatttcccaattaaggtttttttatactttttctggggtatatacatcaaaactgaggtacacgtgttaccagctttcatctttgtgtcatttgattctctttaggctggtttgattctacaacttccattctgaaatcgggaagaaaattactgtgacttctaacggttgatagttcatatatgatgtcatgagaaatatatagcttgggactggcagtgctatgatgagagtccagccattcattggtctttacaactggagggatagttcttagaatttgtgagagatactcatcactcatagcatttactgtgtgcccaaacacaatctaagcatgttacatatgacttcttatcctcacaaaccttgaggtaggaactgttagtgttgtcattttatagacagtaaacttgtgtgttgtgtaacctctctacagtgacatagctgttaagagcctgtattgaacctgggcagcttagcccagagttgggttgggttggggttttttttgttttgttttgttttgtttttttgacatagtctctttctgttgcccaggctggagtgcagtggcaggatctcgtctcactgcagcctccgcctctcgggttcaagcgattcttctgcctcagcctcctgagcccagactattaagctgtactgcctctcatgagacagaattgattttaaatggcagggggatttggctaaaggtgaaagctgtgttttacagtcttagggacagcagagtctgtaattgcttttcctcattgttttatccccttagcttaattgagggtacttaacgtttcgtttttaatacaaattaataaatgtccttgtgtctgttgccttagatgtgaattgtttagtacaaatgttactggtgggcttcctttctttttaaagattagacctctaacattttattccttgggttagaaataattgcagtgtcaggcaggtctttactactcttctgttttcttttatacaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctggtgagttgagtttgtcatttttcttttattctagatagtatttctgaatgtagtccttttctcaaggctcataattatatttaaaataattgttttcatgtatcaattaacacattttattgccattcatacaaatcctacattctctaaaattattttgaaatgttttagcacctcccttcctgtcattgataaggcttttggtttttgtttttaaacaaggtattttgaattctacttgtttaaatacattgtagaacacaagtgctagagaggtaaaacctaatgttgatttgacagttagttatagtgaacaatttgttagaatactggctaatgacgacacagtttttcctgttttgtttcttggcaccaaagttcatggtcaagggtaatttcttgactctgaaagctatgcttggccaggcttggtagctcacgcctgtaatcccagcactttgggatgccgaggcaggcagatcacgaggtcaagagattgagaccaccctggccaacatgaaacctcatctctactaaaaatgcaaaaattagccgggcatgatggtgtgtgcctgtagtcccagccacttgtgaggctgcagcaggaagaatcgcttgaacctgggaggcggaggttgcagtgagctgagatcgcaccactgcactccatcttgatgacagagtgagacttcatctcaaaaaaaaaaaaaaaaaacagtatgcttaaaaatacttatgtgttacactgagccaggagtctctgcctgaattccagagatagcttcaaagagtccatgaatccactgtgagtccagaatgctccacagacctccaagggtcagtatcctcactgctgtagattagtgctgtttttttgttttgttttgttttgttttttgagatgggagtctcactctgttacccgggctggagtgcagtggcatgatctcagctcactgcaacctccacctcccaagctcaagcgatcctcccactttgccccccaaatagctggtaccacagatgcatgccactacactcgcctaatttttatattttttgtagagagggagttttgccatgttgctcaggctagtctcaaactcctgagctcaagtgatcctgccttagcgtcccaaagtgctgggattacaggtgtgcccagcagccatatttctgacagtccaaaatcacaacacccctgggaccaaccaggatagtctaggtgggttgtttgttttggctatttcacttagagagtcattgcatactgttattcagattatctggcttttcatacccttctgagttaagtatactatttactttgttgctatttgtgaattatctcatagtaatatgcttttatattgacttgggaagggtgtgctttgtctttattgtcttactcattttaatgaattgaaagagctgcattccttaacccatgctctacaactttggcctctgaaaggaaattgccttgtcctattctctcatccagaaatttttgttgttcctccagaaaaaaaggatagtgttacatatatgccagtaagccaattatttgggactgtgtagtgtttgtgtgtaaatggtgtgtgtaaatgatttaacagcttccttaagtatagtgttaagaagagtacaactcagaatgaaatgtcttggctattggattttttaaaacttcctgttttggccaggcgtggtggctcatgcctgtaatcccagcactttgggaggctgaggtgggcagatcatgaggtcaagagatcgaaactatcctggccaaaatggtgaaaccctgtctctactgaaaatacagaaatcagctgggcatggtggctcccacctgtagtccgagctcctcgggaggctgaggcaggagaatctcttaaacccaggaggcagaggttgcagtgagccgaggtcgtgccatttcactgcagcctgggcgacagagccccagactccatctcaaaaaaacaaattttctgttttgacacaaatgttatactatcacagatgtattattttttcactctgtatacacacatttttgtatgaactgttgaagggtatattgcaggcatgatgcccctttaactcctaaataacatttgttttatagtatcaaggatgttctcttatataacctcagtatgattatcagaattaggaaattgatgcaatagtatgtaagatcttattcagaatttaccagttatcactttttttgatgaggggaagacagggtctcaatctgtcacccaggctggagtgcagtggcaccatcacggctcactgcagcgttgacctcctgggctcaagtgattctcccacctcagcctcctgaataactgggatcacaggcatgagcaaccaagctcctagctaagttttgtatttttttgtagagatgggtcttgccctgttgcccaggctggtctctcaaactcctgggctcaggcagtcctgcctcagcctcccaaaatgctgggattacagacgtgagcccactgcgcctggcccacattttttttaatagcaaaaaatatttgaattagggaattctgatggtgatgaagaaaataggtcagaatggggaaggctgaagatatagggaggctattttagtagtctaggcaagagataatgaggacagtaacattaagaataatgaaggaaagatttttgagttcatgaatagtggctcttaagcaggagtgcacatcacaatcatctgggggcactctttttaaaaaagtttttggcaggtctcaacctagaatattaactctgaatctccattgggtacagagttctgatcgtgagtagttcaaagagtgagcctctgacttagttacaaaacagcagatttgttttgttttgttttgagatggagtttcgctcttgttgcccaggctggagtgcaatggcaccatcacggctcactgcagcattgacctcctgggctcaagtgattctcccacctcagtctcctgaaaaactgggatcacaggcatgagccaccatgtacctggctaagttttgtattttttttgtagagatgggtcttgccatgttgctcaggcttgtctctcaaactcctgggctcaggcagtcctgcctcagcctcccaagtagctgggattacaggcatgcgccatcatgcccagctaattttgtatttttagtagatgtggggtttctccatgttggtcaggctgatctcgaactcccgacctcaggtggtccgcccgcctcagcctcccaaagtgctgggattacaggagtgagccaccacgcacggcctaaagcagctccttccgtcagtctgtccgtccgtctgtccttccttccttcctccccctttccctcccctcccctcccctcccctcccctccttctgtcctccctcttttccttctttctcgctctctcttttttttttttttttttttaacttggagacaggggcttgctctcttgtccaggctacagtggagtagtgtgatcactgcgacctcgaactccttggcttcaagggggtcctcctgcctcagcctcctgagtagctggtaatacaggcacatgacaccatgcccagcttttttttttttttttttttaaagacggaatcttgaactgtcgcccaggctggagtgcagtggcacgattgcggcccactgcaagcttcgcctcccaggtttacgccattctcctgcctcagcctccccagtagctgtgactgcaggtgcccaccaacactcccagctaattttttgtatttttagtagagacagggtttcactgtgttagccaggatgacctcgtgatcctcccgcctcagcctcccaaagtgctgggattacttacaggtgtgagccaccatgcccggcctttttttttttttttttttaaagtaaagatggggtcttgctttgttgtccaggctggtcttgaacttctgggctcaagcgatcctcctcctcctgccttggccttccaaagtgttgtaattacaggtgtgagccactgtacctggctcaaagcaacagattttgataatagataggagagtgtgtaaatcaaagatactggcaagatttctagtttacgtgactgggtgtgatgatggtactctactacctacagaaggaaacattggaaaggagattgtttttccacaaatatatgtggtgggtgaggttgtagatgacatcacctaaatatgtgtatgagattctgtttgattttatgcttacagtttctccagcttcttcttgtttaatttttttaaaaaaatagagacagagtctagctatgttgcctaggctggtctcaaactcctggcctcaagtgatcctcttgccttggcctcccaaagttctgggatttacaggtgtgagccactgtgctctgccttgttgggctgttttagtgtgttgagtctacttgaagccttagagaaattacccccaaagcctttatccttagtttgcatcagtagatggcaatggtagacagcttcagaggaaactacaactgtgatacctcaaagcaccatcctttttgaagaaagagacaaaagccagcttctcttcagttggtgattctggtttctctgtatctttgaatcctgattcttgccagtccttcccgtcttttgtaagacactctaacctaattaactgtgagaaacttggaagtcatcttgattttttcccccctcttatcctctgatttgtccgtaaggccactgattctgtctccagaacacacccaagttcgtgaactccgtttccttggtcagcacactagtctagccatcatctcacaccgcagctgtcatcatctcctaactaggctctggcttcctttgttgtcttcctccagtccattctccacacaagtgccagagtggtttcttaaaggttgtgttatttattcatctgctaaaaaacccttaagggacttccccattgcacttaaaatacaaaattctctgacctgataaacttgcattgtgtgtatgtacctcctgctttcttctatgatttcatcttgtgctgctccttcatgttgcagacatccaggcctttttttcagttttcagtaccaccaaagtcacctttttttggaaggttaggcaaattttatagagtttattaatttgctcaatgcactgatcttatggtggtgaagctttgattattaccctgacctatctcgctttctcacactgaaatttcattttctatattgtaatatagttttgttgttgcatttgatagtttagaaaggacaaataatgtttgatctatagtgtatgtgacttaagattttcagtctaatgggattttccttatttatattgtggtaaagtatacatattataaacttacccattttaaccatttttaagcgtgcagttctgtggcattaagtacattcacattgttttgggactgtcaccatccagaacttttatcttccctaactgaaatgtacaccttaaacactgacttccagttcccctcttccctggcccctggcaaccattccctttatttgaatattcaaaagacaatgaatttaatattcaaaaaaaacctgagtttaaatcccttaggtgaatatactactactataaagtggagtacaaatttaaatccattttcctttcacctgtttctgaatccttcatagatagtgctgattctggtagttatttaccactttttttccccagctcttcccccacagtatggtaattgctaaaaagcgtatatattgctttgacgttgggctctgtttttctttaatttttatttttattactattattattattattattattattattactattttgagacagggtctcactctgctgtgcaggctggaatgcagtagcgtgatctcggttcactgcaacctctgcctgcctgttcaagtgattcttgtgcctcagcctcccaattagctgggctcaccagcatgcaccaccacacccagctgatttttgtagttgtagtagagatggggttttgccatattggccaggctggtctcaaactcctggcctcgtgacccactcacctcggcctcccaaagtgctgggattacaggcgtgagccaccgtgcctggcctattattattttagttaagcccagctgtgtgagacattgggctcttaagtgctgcttgctttcgtcttaaattgtgacctttttaactgagtaatgcagaacagacatctaggtttagaatgtatgtgggcattttattaaatactgttgtcatactactaggcagtgagcaccttaaggacagaactgtcatattgactgttgtaacgttatcgtaagttctctatgaatgaaatttgaaatcagaagtatatgataggctcagctaatgtaaacatagttgctgtgcagaacaaacagttgaagtgtatgtgtgtgttcaatacaattattattataatattatacagacagagtcttgttctgtcacccaggctctagtgcagtggtgtgatctcggctcactgcaacctgtgtacctcccagtttcaagtgattctcctgcttcagtctcccgagtagctgggattacaggcttgggccattatgcctggcttgcttgcttttttgtttgtttgtttgtttgtttgttttgagacgagtctcgctctgttgccaggctggagtgcagtggcatgatcttggctcactgcaacctccgactccctggttcaagcgattctcctgcctcagcctcccgagtagctgagattacaggcacgtaccaccacgcccagctaatttttgtattttttagtagagacggggtttcaccgtgttggccaggatggtctcaagcccctgacctcgtgatccatcctcctcggcctcccaaagtgctgggattgattacaggcatgagccaccgcgcccagccacgcctggctaatatttttgtatttttagtagaggcagagtttggccatgttggcccggcaagtcttgaatttctggcctcaagcgatccacctgcctcagcctcccaaagtgctgggattacaggcgtgagccactgcacctggccttcaatacaattattgaatgccagattattagtatattcaaggtctgtgtgatcctcattattatcttaattccagaacattttcatcaccctcagaaaaacccatacccattagcagttgttgccctgttttcctcccaccagttcctgacaaccacagtttattatctgttttgtggattactgtctgtttttctggatattgcatataaatggagtcaatcttggtgactggctttctcttagcatagtgttacatttcgttcatgaatatagcatgtatttcattccttactgctgaataatgtttattagttgatggacatttgggttgtttccagttttggtctattatgagtaatgaatagtgctataacttgtacatacatgcttgtactaatttttgtgtgaacataacattttctctctgttaggtatgtacctaagcatggaattatggggcctatagtgactctatacttaacattttgagcagctaccaaactgtctttcagaatggtggtgatattgttctacattcccaccaacaatgtatacaagttccagtttctctacatccttgtcaagacatgtcattgtctatcgttttaaagttttacccaggaagtgagtatcattgtggttttgacgtccgtttccctaatttcttaatgatgttgggcatcttttcatgtggctattgtccatcggtgtgttttctttggagaaatgcctgtttaaattaggttatttgtctttttaatgttgaggtataagaattctttacatatcctgccttatgaggtgtgattagcaaaattttttccccattctatagggattcctttttttcactttcttgatggcatactttgtaacatacaagtttttaatatgataaagtccacttatacattgttgttgcttgtgcttttggtgtgatgtctaagaaactgttgccaattgaaggtcacaaagactttatatattagccagtatatatgatccaggcgtcgtggctcatacctatatgatcccagcactttgggaggctgaggcaggaaaaaccacttttttttttctttttgagacggagtcttgctctgttgtccaggctggagtgcagcgagtggcatgatctcggctcagtgcaacctccgcctcctgggttcaagcgattctcccgcctcagtctcccgagtagctgggattacaggtgcacaccaccacactcagctaatttttgtatttttagtagaaacggggtttcaccgttttggccaggctggtcttgaactcctgacttcaaatgatccgcctgcctcagcctctcaaagtgctgcgattataggcaagagccaccatgcccagcctaggaaaaaaacacttttaaattagccaggcaaggtggtacaggcctgtagtctcactactcaggaggcagaggtacgaagatgacttgagcccaagagtggaggctgcagtgagctactatgatcctgccactgtcctccaccctaggcaacaaagcaagaccttgcctctttaaaaacagcaacaacagcaaaaactatggtgtgaggtaggagatccagctgctttcttttgcatgtggatatttagttgtctcagcaccatttgttgaaaagatttcttcactaatttgtcctgcaacctttgtgaaaaattaatttacaaatgcaagaatgtatttctagactctattcttactccattgatctctgtctttaggtcagtaccatactgtcttgatagctagctgtcgttttgtattttttgaaattgggaacttgggagtgtaactttgttcaagataattttgggcattctgggttccttacatttacatataaatttttaagagttgcttgtcaatttctgcagaaagcaagctggtattttcagtaagaattgtgttgtatctatagatgagtttgggaaatatggtcgtaatatcaagtctttggatccatgagcatagggatgtctgttttttttttgttttttttttttaaggtctgtcatttctttcaacactggttgtcagtgttcaagtcttgtgcttcttttgttattgcatttttggcggggggaatatttgtaattggaataattttttgtaacttgaaattggcctattggtgatatttatttatttatttatttttgagacggagtctcgctctttcaccgctatgacaggctggagtgcagtggcacgatctctgctcactgcaagctccgcctctcgggttcacgccattctcctgcctcagcctccccagtagctgggaccacaggcgcctgccaccatgcccagctaatgtttttgtatttttagtagagacagggtttcaccatgttagccaggatggtctcgatctcctgacctcgtgatccacccgccttggcctcccaaagtactgggattacaggcgtgagccaccgcgcccggcctagtgatatttatttttaattaaaatttttagattcaaggtacatgtgcaggtttgttatgtggatttaatgtgtgatgctgaggtttgggcttctgctgatcctgtcatccagatgatgagtatagatgatgagtatagtacttcacagatagtttttcagccctcgcccctctttccctcccactttttggagtgcccagtgtttattgttcccatcttaatggctatgtgtactcagtgtttagctcctacttacaagtgagaacagacagtatttggttttctgggttaactcacttaggataatagtctctggctgcatccattttgctggaaaagacatgatttcattcttttgcatggctgcgtagtatcacatggtgtatatataccacatttatttttgagatagggtctcactctgtcgcccaggctggagtgcagtggtgcgattttggctcagtgcaacctccacctcccaagctcaagccatcctcccacttcagcctccttgtgagttcaggccatcctcccacctcagcctccttgtagctggaactacagatgcccaccacgcccaactaatttttgtatttttcgtacagataaggtctcaccatgttgcccaggctggtctcgaattcctgggctcaagtgattcacccaccttggcctccgaaagtgctgagattacaggtgtgagccaccacgcccggccacaatttctttttcttgggatatatacccagtaatgggatcgctgggttgaatggtcattctgtttttagtttcttgagaaatctccaaacagctttccacgggggctgaactagtttacattcttgccagcagtgtataagtgttccccccagccccaccaccttttttttttttttttttctttttttttgaggcaggatctcagtctgttgcccaggctggaacacagtggcatgattatagctcattgagccatggctttccaggctctagtgaccctcccacctgagccttccaggttagctgggactgtaggcacacaccactatgacaggctcatttttaaattttttcgtagagatgaggtcttactatgttgccctggctagtagttgaattcctgggctccagtgatcctcccacctcagcttcccaaagtgctgggattacaagcgtgagccaccgtgcccagcaataatagtcactctgactggtgtgagatgacatctcattgtggttttgatttgcatctctctactagtgatgttgagcattttttcctatgttgactacttgattgttgtcttttgagaagtgtcttttcataccctttgcccacttttcaacagtgattttgtgtgtgtgtttgtgtgtggatttaagttccttatagattctggatattagtcctttgttgagtgcatagtttgcaattattttctccaattctgtaggttgtcagtttactctgttgatagatttcttctgctgtgcagaaactctttcgtttaactaggtcccaattgtcaagttatttgttgcatttgcttttgaggcttagtcataaattctttgcttagggcagtgttgagaagagtatttcctaggttttcttctaggatatttacagtttgaggccttacatttaagtctttaatttgccttgagttaggaattcttttttcaatttcattttcagattgttctttgctagcgtgtagaaatagttttttacgtattgatcttgtagtttgccatcttgctgaactcattagttagttttaatagtttttatgggttccttaagattttctatatacaagatcatgcatttgcaaatgaaaatgtttttacttctttctagtctggatgccctttatttcttgcctaattgccctggttagaatctccaatacaacgttgaagtaccaagagcagacatccttgtcttactgatcgtaggggaaagcatccagtccttcacagtgaagtgtgacataggtgtgggtctcataggcgggtgccctttatcatgttgaggaagcctagttacagctgtaatatttaggttgtcagtatactctggtgacctttcatggtgtttgtaaacttatatgcaaatcagaaatgatagtttgctgggttactaggaccagcaggtcattgaattgggtaagatataattctaaggcatttgcaactattatatggaacattttggaaaagcataccgtgactgtataacctgggccagataaataggtatttattttattaagactatacacgttgagccttttaaacttccacctcttttagaattagtaatcaaattgactgtgcaatctagcatttagcctgataattcagttttgtgaaaactatagagtgaactttaattctgaattttttcttgtcagtcgaaggtactatttgcgtagcctgaaagattaaatggcataaattgtgcttttagacatggtgacttttatattttcatttacattatgaaattggatgtgaaggggtttttcagatgtgttggaaaactggagagtgttgtaaactaattcgaagctgaaaataaaaaagtactgacttaacgattttgatatttgcagaaaggaacagacctttttgtagtcactgtttggaatgtaagggtcatctcctgactttaaaattctttgtcagcttttggaagatatctggtaggatggttctggctgaacttttcaaagactaagctggaataggtggttttttgagggagatatggagagagagtttaaggaaactaatttttttttttttttttttttttttttttttttttgagatggaatctcactctgtcgcccaggcaggagtgcaagggcgtgatctcagctcactgcaacctccgcctcctgggttcaagcgattctcctgcctcagcctccctagtagcagggattacaagtgcccgccaccacacccggctaatttttgtatttttagtagagacagggtttcaccatgttggccaggctggtctcgaactcctggcctcaagtgatccgcccgcctcagcctcccaaagtgctggaattacaggtgtgagccaccatgcccagccaggaaactaaattttatatgttgctataccagctaatcattccaaagagaaactgggtaagcatacatagcaaatgctaatgtgagtcttaagtatctagaacacaagagccaaatgaaattgatatggcaaataaaaacatggagaaaataacccgcacataggctgtgctcagtggctcatgcctgtaatctcagcacttttgggggaggccaaggcatgcagatcacttgagtccaggagtttgagaccagcctgggcaacatagtaaaaccccatccctacaaaaaatacaaaaattagctaggcgtggtggtgcgtacctgtagtcccaacgacttgaaaagctgaggtgggaggatcacctgagcccaggaggtcgaggctgtggcagtgagctgaaattaagccactgcactccagcgtgggcaacagagtgagaccctgactcaaaaaaaaaaaaaagagaaagtgacccacatgttcacctcttaagaagccacagtaattctacattatcttaaggccaagaaaatatttctccggatggatggaaaccaaaagtagtgaagttgtacataatcttataagaaatgaacgtcattgtttttaagctttctgtattatctgctgacatgaaagtgaatcaagctataatagcctaagtcatttctgttttctttttttctttttccttttttttttttaaagtagagacgggattttaccatgttggccaggctggtctcgaactcctgacctcaagtgatctgcctcccttggcctcccaaagtgctgggattacaggcatgaaccaccgtgcccggccatggttttgtgggatgtttttttgagacaaggtctccctgtattacccagcctagtctcaaactcctgggctcaagggatcctcttcccttggcctcccaaagtgctgggattacaggcatgagccaccattcccagctagaagtcttagttttagaattttggggcttctagtatatgccgcaggggttatttattgacttcttaagaacactgttttcagggttgtttaaaacaaactttatgtatcttggtaacccagggttgatgaatagcaccaggaaataaatattctcagatgacttctgtcttgtagtatatactctggagcgaatcatcttttaagatttaagtagtggaagcaacacaatcttaaaattgcatttgctttagcacttgtacagaaattgataattttatttcctaaaatgaagacttaatagccaacagggtgccagcaatttcaagatttactcgggaataaaaagaataattcttaaacttgacagcaatttaaaggaagaaaactttcaatttaaaggaaggaaacttttacttcagacagttaacatgcagtactgagatttagtagcaggtataaactgcttttgaagcagttgagtaaaaggcagagttgtgaaatagatgagtggattcatataagaacctggattatgatcctagttctgcatgacattggactatgtacattaacctctgcagaattaggtaattggagtactgtttcaaggagctttcttgctctaaaaagtgtgatttagatagtatggccatgagtccatgtggacttttttttgcttttagaaagctgttggggttggaattgactggctttaaacatttagcaaacattaaatgctctttaacacaaaacagagtagtcagtctgctgtagagcagaggagttggcatactatctttgtgggttggttggttggttcgtttgtttatagacatgaggtctcactgtgtcactcaggctggtcttgaactcctggcctcaagtgatcctcctgccttagcctgtaatcccaggtctttgggaggcggaggcgggtggatcacaagatcaggagttcaagaccagcctggccaagatggtgaaacccccgtctctactaaaaatacaaaaattagccgggtgcagtggcaggcacccgtaacccgtaatcccagctactcggtaggccgaggcaggagaattacttgaacccagggggcagaggttgcagtgagccaagatcgcgccactgcactccagcctgggggacagagcgagactccatctcaaaaaaaaaaaaaaaaaaaaaaaaaaacgctgggattataagtgtgagctatagcgtccagctaatattttgggttttgtgggccacaacaatctctgtaccaaagtcttttgtaaaatatgaaaagagaattgtttaaaaaaaaaaaaaaaaaggtgttggctgggtgcagtggcttatccctgcaatcctagcattttgggaggccatggcaggaggatcacttgagcccaggagtttgagaccagcctgggcaacatattgagaccttgtctttacaaaaaaagttttaaaaacttgcatagtgaggctgggagccatggctcatgccagcactttgggaggctgagacgaggttcacttgagctcaggagtttgagaccagcctgggcaacatggaaagaccccgtctctaaaaaaataaaaaatgaaaatttgctgggcatgttgacgtgctcctgtagtccctgcttctcgggaggctgaggtgggaggatcagttgagcctgggaggtcagggctgcagtgagctcagatcgtgccagtatgctccagcctgggtgacagagtgagacagagtaaaactctgtctcccaaaaaaagttcggggggtggggagccttaagattttgcacactgcttagatcaatgtttctctaacttcatgtgtgcaggaattacctggggatgttgttaaaatgtatgttttgattggttcagtctgaaatggggcctgattattctgcatttctaataagctcccaggtcaataatttgagtagcaaggctctagagcagatcttaatcatttctagatcacagtccctttgagaattaatgaaatttatggactttcttccccaaaaacatatattgaaaatcttgtgtgcaacttcaggaggttcatttgtcctcctcctcagaaagtccacctcaggattctagctatttagttttgaaaactgaagtacaggccgggcatggtggctcatgcctgtaatcccagcaatttaggaggccaaggcaggcggatcatttgagcccaggagttcgagaccagcctggccaacactgtgaaatcccatcttcactaaaaatacaaaaattacccgggtgtggtggtggatgcctgtaatcctagctacttgggtggctgaggcacgagaatcgcctaaacccaggagatggaagctgcaatgagcctagattgcacaactgcattccaccctgagggacagagcgagactctgttgcaaaaaaaaaaaaaaaagaaaacaaaacaaaaaagaaaaattgctttagttgttctgtaaatcctggaagctatacctctgtttccaaagccaaggtataaattattactctagaaaacggataagcagaagagcaaaatagtctaaaacaaaaatcagcatagagagtttttgagtttgagagcccctgagcactgtcagaatagctaagacattaagaactgtgagaaatgagagttctcctcaaccatcagaccatgataggccagttgatcttgaagcctgacctgatttcatggggctggcatttccttcctgatttcctgtaatcacctcctctctactccccatgattcagtggtagtcacagtaccaggaagtgccaaccttttcattcttgctactgagatgaagattttggaaaaaggagaagaaaccatgtggtttgggaaccacctttccttttttttttttttttttttttgatacggagtcgctctgtcgcccaggctggagtgcagtggaatgatctcggctcactgcaagctccgcctcctgggttcacgccattctcctgcctcagcctccccgttagctgtgactacaggcacccaccacaatgtccggctaattttttgtatattttagtagagatggggtttcaccatgttagccaggctggtctcaaactcctgacctcaagtgcttcatctgccttggcctcccaaagtgctgggattacaggtgtgagccaccgctgctggccatgggaaccacctttcctaagcattaacaccaaaccacctagatgggcagatttaactgtgaccaacttttatattaaaagataatggaacttttttttttttttttttttttgagacaaagtctcggctctgtcacccaggctggagagcagtggtgcaatcttggaccactggaacctctgcctcctgggttcaagcgattcttctgcctcagctttcccattagctggaattacaggtgtgcaccaccccacctggctattttgtattttttttttagtagagacggggtttcaccatgttggccaggctggtcttgaactcctgacctcaagagatccacccaccgtcagcctcccaaagtgttgggattacaggcatgagccactgtgcccggccgataatggaacttttgaaaaccaagggcttggtggccgggtacactggctcatgcctgtaatcccagcactttggaggccgaggcgggcagatcacctgaggtcaggagttcgagactagcctgaccaacatggagaaacgctgtctctactaaaaattcaaaattagctgggcatggtagcgcttgcctgtaatcccaactacttgggaggctgaggcaagagaatcacttgaacccaggaggcagagtttgtgctgagctgatatcgtgccattgcactccagcctgggcagcaagagtgaaactctgtctcaaaaaaagaaaaaaaaaaaaaaagtaaaacaaagggcttggcattatcagtgccagaaaaatacaagattgagagaatggggaaacaggagggacataaacttggtgggagtatacatttgtatgcaaaagtaaaagataacagacgaagatgttaaccctgtaacaccgtaaaaggaaatgttagaaataactagatagccataaaaatagaggatgattcatttagttcatggtatggttgtgaaatactgtggccttgaacaagtaccttttagtgtctcattttcctcatctataaacagggagggagtaaagataatagatccctccttagagttgtgaagattgaattagtaacctgtgaagctgttccagcagtacctggtctagaaataatagtctcaaaatttcattgcttattattactatacagccactttttaaaatgagacaggtatgtataaatataaaaggtctaatattgttttagtgaatgttgtacataaagagatgtccagaaaatccagaagatacactttttttttttttttttggaaatggagtctcgctctgtcgcccaggctggagtgcagtggcatgatctcagctcactgcaagctccgcctcctgggttcatgccattctcctgcctcagcctcccaagtagctgggaccacaggcacccgccaccatgcccggctaattttttgtatttttagtagagacggggtttcaccatgttagccaggatgatctcgttctcctgaccttgtgatccgcctgcctcagccttccagagtgctgggattacaggcgtgagccatcgcgcccggcaatatactgttaactgtatatatatctgttgaaagaggggaagaagaatggtgtttgaccttttaaacgtgcatttttcttttgtgataaaaatctctgttggtaggtaggctggagtactctaacattgcttagtgcatggttgcctttgcaacatctaatgaattggttacctttctacccccataactctagtaactggaaacttgcttaatgatcagtgtcatttttttagtcagttcattataaaatattccttatgagctaaaatatattttgtctgttgtgtatgttagcttttttaatttggagccacatagaaatctgatttatcaccagtttagatctgaaggggagcttatgaaaccttattttaggggatgagaagactaaaactcagagtttgtaacttatccaggagcatgtggcagtttgtggcagtactaggactgtcaaatgttagcagtatagcgtatcctaaaatttttatttttggccgggtgcggtggctcacgcctgtaatcccagcactttgggaggcctaggtgggtggatcacttgaggttgggagttcgagaccagcctggccaacgtggtgaaaccccatctctactaaaaatacaaaacttagccggccgcatcggcacacgcctgtagtcccaggtatttgggagggaggcaggagaattgcttgaacccaggaggcgggggttgcagtgagctgagatcacgccactgtgctccagcctgggtgacagagcaaacaaacaaaattagcttggtgtggtggtgggcacctgtaatcccagctactcgggaggctgaggcaggaaaatcgcctgaacctgggaggtggaggttacagtgagccgagatcatgccactgcactccagcctgggcaacaaagctagtctccatctcaaaaagtaaaataaaataaaatgtttatttccaagttagtcttagcatttgtttcaaacgctttaccatcttggtagttctctttggtacccagattgaatgcagttatgtaaatggagtctggttgtcattctagacattttttgtcttctgacagtctatggaaatttctttggcagtcttaattactctaccagctaaaactacagtctttcttaggtgttcttcccatccccccattcctaaatttctagacttttactggcatagattattttggttttagtctaaacgtagaatttaagcaactaccattattgaacctcatttagcttaaccaaagctgttatctctttggaccctgattttttattgtttctagcttcgtgatgttcttcaacttggtaattagaagtcttttgctacatgtatactaaaggaaatatgtgtgccaaatgctttattcattgacagatattttatttgacacccactgtgtgccaggtatagtggtagggctaggaaatcagtgatgtctgagtgactctgcctttatggagcttttggttttagtggggaagattcatgaagaccatgcgagtgtaaggaaaggacaggatgctctgtgggcacacagtgagggatgccagcctaatctgggagttagaggaaagccttactatttatgggagaagaaagggtatgtgaaggcccagaaacaagttagaggaactgaagagcatagtgtgtgatgctcagagggaggtgagagggtgacaggcaaacagcacttgggtcatggaggctgttataagcccgggttgggatgccaaagaagctgttgaaagattttaaaacaggaggagatcacgtttgccattttaaagacagtactgtctaagaaacagattgggagcaaaccacagtagtataatggggtattgtgtaatgttccttccctgttcaccgtgaggcctggaagtagtttaaagtagtcaagtagagcttctcaaatgaagaatttcattcagtctctgctaaactacaaaatttatgactcaaattggaaacacggtgaaaattttgagtcacagttaaatgtttaagtagtttaagataaatctgttatgccttgtgtttcctaggagccatttagattcaaaaacaacagtggcatttagaaggtaatttctggtcttaaatagtgtttttcttataaaagattttaataactggtgtttgccacaataaattaggtttttaaaatgcataatacaattgattaataaaaaggattttttaaaaaaataatgctgatttttggtttgtttgggttttttttgagatggagtctcactgtgtcacccaggctggagtgcagtggcgcaatctcagctcactgcaacctcagcctccaagtagctacaattataggcgcccgccaccatgccgggctaatttttatatttttagtagagacggagtttcaccatgttggccaggctggtctcaaactcctgacctcaaatgcttcgtccgccttggcctcccaaagtgctgggattacaggtgtgagccaccatgcccggcttgaataatggtagttttaaccatcagtatttatatttgacataagtggtacaaataatgtttcagtatcatggcttataaacgtttgcatggagttctaaaacgtggcaaactgataatttaatgaactcttacttgaactcttgtgcaagtatactgtgaggattttgttctgattggaaatctttattgtaatagcaaattaaagagctgtggattttcaagagctgaatttgaaaggtgtcagatgttaaatggaaggtaattcagagtttattcttttattgtacctgcctccacccaaagagtcagagaaaaacatttggaagaaaaaattgcagagcatccctttggcaagagtaagaattttccactaccacttgccctaagagcattgacatgcctcaccagggaaatgttacaggatgtgatcatcggaacagcctagcctgctcttcatgcacaaaatcctttgtctgaaattcacagaagcctctccagacaaagggaaattgttgtgtcttcacttgaaaagtattcggtggacctttactttcatgaaccttttaactctaagaacctgttttcctaatagagtcaaccctaaattgactctgatatcaacaaaaggaatgtaacagtcacacagcaagttaaacaaaggttttcattaattgagcttccttagagaaggctacttttacttcctagcctgagttcctgtgcataaaatgaagaggacattggttggtcaagatgatgtgatggtccctctagctaagaaaatactagaatatggcaggttcgttggtttgtttttgagatggagtctcgccctttcacccaggctggagtggcgcaacttcggctcactgcaacctccgcctccaaggctcaagcgatagtcttgctttagcctcccaagtagctgggattgcaggcacccaccaccacacccggctaatttttgtatttttagtagagatggggtttcatcatcttggccaggctggtcttgaactcctgacctcaggtgatctgcctgtctcagcttcccaaagttctgggattacaggcataagccaccgtgcccagtctatggcaggttttttggatttatgtttcttcaatatctttctacaaagatcagtttctaatagaagccaattaaacatagaaactctaaggtagcatatttcccaagtgttgggaggctttggagctttttagcttcgagttggtgtgcctgatagatgagaaacagcacaacagaaaagctgttcataggatccatgactctagctattgcattttttctcttgcattaatttttctagtgtatttgtaaaacctttttaaaaatatggattcttaattttaaaattaacctggtgcaatggcacatgcccgtagtcctagttacttgggaggctgaggtgggaagatgacttgagcccaggagttcaaggctgtagttcaccgtgatcacgccagtatactccagcctgggtgacagagtgagaccctgtctgtaagaataaaaaatgaaaaaaaaaaaaaaaaaaaaaaagtggattcctagaccccactccaaatgcatttaatcatactcttaaagaatctgtaaaagatctccagataactcttcttgtcgtttctaaatatttaattgccacttgattagaatggaagttgtaagatggaaacatttagaacagctgtggtcagtatttaagggtttcccaggcatttgacatttgttcctctagcatttgacatttaaggtattcctcagtatttggccaaaagttaaatgtgtatcaatacagtttctgcacagcaaagaaacacctttcatatattttagtagacctttataaagggaaagagtacatgttggtttccttataatgccagtataaatataatctttcatatacataatatatactatattatatattaatactatatataataaatctatactacacatattgtatatttatactataggaccaataggtaagacctatagtcctgtactacctgttggtcctgtaggtgtatctattagtgttaggtaggaccattactaaatacagtgtgtatatatactaaatatgtatatttagtattggtcctacctaatactgttagataacgattggatatccctaatctgaaaagctcaaagatcagaaactttttgagcaccaacatgatgctcaagggaaatacttactggagcatttcagattttgagttttttgtgtagagatgttcaacagtaagaatataaatcaaacactccaaattttaattttaaaatactgtttccaagcattttgggtaagggatactcaacctgtaatatgttggcagtgttacccaggaaatttaaccttggtatttcttacctgaaaaatacattttctatttatttcaaatcctctgagcttccactgaaacacagcaaaacacatgccaaaacattgcttttgtatcctcttgtaggttgtactcaatttaaatattagatttgttgaccttttaaaatttgtcaagtatatgagagtatgagctagggtttatatattgaattgtttaagtctgttcagcagttacaatgcagaagtaaaatagtgcttatagattgacgaccgctatctcacattggacagaagtcttctactccataggatcatgacattgacgtaaatcaaatcctcagacaccaaaggaacatttggaaataaattttccatttagggtcataatattcatcattgaacttgtcctctttttgaaatgttcgagggcatgtaggatcaggttaatcatgacaggcagaaatagtgcagtatagggcatgttagctgttaaagaccactaaagtttagaatatagttactttgttgtcttaaatcatctgttagatgtactctcttcaatgtagttagagcagaattatattaaaatgaaaggttctcgttgattcagtctgaatattgctgttcattgcacaagcatttccagcaggaatttcaccttagcttgtgtgtccctgcagtcaaatgcaagggtgatctttgcctgttgagattatatattgacaaactgtgccgccttgtgaccacattgcttacttaggctatagcattgtttttatgcactcaaattaaaaaagtaaaccatattctccctgaacttaagctccgaagtagagaaaaatcagaactaatttgaaggtttaagaagttcagtgttggctgggtgcagtggctcacgcctgtaatctcagcattttgggaggcaaggcaggtggatgcctgaggtcaggagtttgagatcagtctggctaacatagtgaaacgctatctctactaaaaatacaaaaatgaggctggttgtggtggcgcacgcctgtagtcccggttgatcaggaggctgaggcaggggaatcgcttgaacccgggaggtggaggttgcagtgagctgagatcatgccactgcactccagtctgggtgatagagcaagactctgtctctgaaaagaaaataaaaaataagaaattcaatgtttacttcttggacaggagtgctattttgccattttgtatatgactggtaacatgcaattcagtatagagagtaagtctgaaaaatgatttgattttaaaatgccatctgcaagtatgggagaattttcttatgtaatttgtagctgccctttcgtaagacttacaaaccaccttaattatctttcagaaaatcacggacagctgttttgttgttattattgttgttttgagacaaagtctcgctctgtctccaaagctggaatgtagtggtgtgaactcggctcactgcaaccgtctgagtagctgagactacaggcacactaccattcctcccagctaattttttatatttttagtagagacaggttttcgccatgttggccagactggtctcgaactcctagcttcgagtgatcctcccgcctcagcctcccaaagtgttgggattaacggacagctgttttaatgtccagctgctttgtgtgattgtgccactcattcagcagtatttgaataccagcagagggctgggcactattctcaaggtgcatggctttgtctgttacttgggctatgttgtggaatttcactttgtacacacatcaaggaaaggggctgagatttgggccttttaagagctattaaagtaacttgttggcctaggaaagaagactcagttgacttaaagatcttcaggttatgcaagaggtttattattcatttaattgatatttctttttttttttatgagacggagtctcgctctgccgcccaggctggagtgcagtggcgcgatctcagctcactgcaagctccgcctcccgggttcacgccattctcctgcctcagcctcccattaattgatatttcaaaaagtatcaaaggatatatgccccagctgtgcagtgttactagtttgctacaccttcccagaggtgtttctttataccattggaagttgtcattttagtatgaattaattacatgttatacgagcatatcaaagggtttgaaacagtgaaagagctaagattaacttggaaataaacattttattttattttactttttgagatggagactagctttgtttcccaggtggtgtgcacctgtagtccttctgcttgggaagctgaagtgggaggtcaagggtgcagtgagctgtgattgcctcactgatctctacatcctgggtgacagagcaaggccctgtctcaaaaaaaaaaagtggtgttactgtgtagttttattttgcatttgccatgtgtttcgttaattgaatatctttttaaagggggccatttgcttcctgttcacaataatttagcttttttgatggaatgaatcatggcatatacaactttattctctttgctgtgccttgtgtatatgtagtaagacttttacttactgctaagtaggaaagtattctttaaagtgaaagcttgaaggcctgtctgaagatacagagcaaaatttcttagaataatgtagttaggtttccttaagcctcattctcttccttcctaattcaaatcttgaatccatctaaagttttttatgactccaagataggttgatcactttgcttgttttaactgaattttatgtatttgtgttatatgcagatcatttattttctttaaaaattgatttggagacaaattcatctttagataacatagttttaaaagttgctcatttcagccgccttttttttctcctaattagttggtgacaaagttcctgctgatataaggttaacttccatcaaatctaccacactaagagttgaccagtcaattctcacaggtaaatatgatatattaagtcattgaatttctgaagaccttcgcatattccatgccaatagagttggctcttgcctcactgtccctttatggtatcccatcttaatcctctctaagatacttatttcttagtgctttagtctcgctccattgcccaggctggagtgcagtggcgtgattgcggctcactgcagcctccgcctctcaggttcaggcagttctcctgtctcagcctcccaagtagctgggactacaggctcctgccaccatgcccagctaatttttgtatttttattagagatggggttttaccttgttggtcaggctggtcttgaactcctgacctcaggtaatccacctgcctcggcctcccaaagtgctgggattacaggcgtgaaccactgcacctggctgccgatacggttttaaaggcatgatttaaaaacaaaacaaaatggctgggcacggtggctcatgcatgtaattccaacactttgggagactgaggcgggcagatggcttgagcccaggagttaaagacgggcctgggcaacatggcaaaaccccgtatctacaaaaaatacaaaaattagccaggcctgtaatcccagctactcaggaggctgggtgaaaagatcacttgtgcctaggtcaaggctacagtgagccatgcttgtgcctctgcactccagcctgggggacagagcaagactctgtctccaaaaaaaagttgtaatttgttcgttaccataggtaaatcttaaggttgaattgttgtctgttttgtggaaagcaaattacttattcgatgtcctttttccaggcaagaaaaatagactccagtgctgtaatttttttcactggaggagtgctaatgttgtatcaatctttacagtatccaaatacacaatgaacaaaagttagcccccataagagatgaaaattgtactacctggaatttgcacaattgtttgaaacattttcccgtttttgtgtgataaaagcacaatctagggtggagggttcatactaactggaagtaagtttgtcagaagaattaactttaaatacaatgctaacttggattaaatagtaaacataaagtctaaaggctctcaagatttatctgattatcaattttgaaaagcagctaatgtcatggagacagttatatgagtaacctggctctattttttttggtattgtttctttataaatagcttacttattaaaattctcattagcaacaacaagctggaggccaattaagccataaaatgttggagaaatggttgggttatatgtgtgaaattctcatagtgtgccctaaagacgtagttgccatttaaaaaaaatttttttttttttgaggcggagtctcgctctgttgcccaggctatagtgtagtgctgtgatctcagctcactgcaacctctgcctcctggattcaagctgttctcctgcctcagccacctgagtgtctgggattataggcgtgcgccaccatgcccagcttatttttgtatttttagtagagacggggtttcactgtgttggtcaggctggtctcgaactcctgatctcatgatccgcctgccttggcctcccaaagtgctgggattacaggcatttaaaaactttttaggctggtcacggtggctcatgcctgtaatttcaggactttgggaggctgcggcagtaggatcacttgtggccaagagtttgagagagcagttatagtctctataatgaaaatctttttttttttttttttaaagacagagttgcactctgtggcccagtggcgcgatctcagctcagtgcagcctctgcttccggggttcaagtaattctcatgcctcagcctccctagtagctgaaattacaggcatgcaccaccacacctggctaattgtatttttagtagagatagggttttgccatgttgtccaggctggtcttgacctcctgacctgaagtgatcgcccgcctcaaacccccaaagtgctgggattacagacataagtcatcacacccagcctataataaaaaactttaaaagtttaaaaaaaaatttaaacttcatagaggttctcgaatattatctttctttcattaagaaatcataatgtagtttttggctaacttgtggaaccaatttttttggtcaaatattgagagtgaagtttgctacctgtaacttaaagtaacatttagagacatattttactcagattgaccctaattatatatctatgacatgatttttaaattgaaatcagctgggcatggtgtctcatgcctgtaatcccagcactttgggaggccgaggtggggggatcacctcaggtcaggagtttgagaccagccttggccaacatagcaaaacctgtctctactaaaaatacaaaaattagctgggcatggtggcacatgcctgtaatcccagctacttgggaggctgaggctggaaaattgcccgggaggcagaggtttcagtaagccaagattgtgccactggactccagcctgggcaacaaagcaagactccgtctcaaaaaaaaaaaaaaagtagttctttatttaccatgcgatctttccagtacacttgctaattgctactccagagcatagccagatgtggcccacacctgtaattccagcactttgaggaggacaagatgagcaaattgtttgagtccacgagttggagaccaccctgggcaacatggtaaaacctcatctctacaaaaaaataccaaaaaaattaacccggcgtggtattgggtgcctgtaatcccagctattcaggaagccaagttgggaagattgcttgagcccaggaagttgaggctgtagtgagttgtgatggtgccattgcaccagcccgggtgatagagcaagacctctgtctcgaaaaaaaaaaaaagtatcagtatatatgttaaagtatttattaaagtatacaacaaatatatgtaaataatacagtcacagtatcagagtataaaatgattactgaaaaataaattaatttgaatagttactccagaaaataatcaatggggattctacttgaaaattcacttttttattttggaattgtgttgatttttatcctgacaccctttgttctggtattaatttccattactaagttttcccagcttacctcctttgaatgaattgggccttttgccaaccttttctcacactaacagtatcccaagagtggtaatgggtgggcatgaatgagaggttctaggttcttggtgtgggtcgcagagatctgttttttctgtctcacaacccgcttaggtgaatctgtctctgtcatcaagcacactgatcccgtccctgacccacgagctgtcaaccaagataaaaagaacatgctgttttctgtaagtactttatgaaatgtgtttttatttacagacatttccaaagcctaatcaaatgttatgtttttcactgccaaccatcactggctatcattctaaaggataatcacacttttcatggtcagtcttaggtgtcagaatatggcagtaacataacgtgtgacttagatgtcttttaattggcaagttttgggggaccaaaaaataatgactagcttatacatcttcaaactcttacctgcaaacatagttgaaaagtagatttgtttggaaaagccttagccaataaagggtattttcaaaatgatgtagatgacagctgctatttgtatgtggttcacaataaaaaggtgcgtgtttagagagagagagaaagcaaacatggcaaaccattaataatggtgagtctaggtgcaaagtatatgaatgttcattttactatttcactttttctattgatgtgaaaaattctttgaatagtgaggaaatgattttaagttggggacatttgtgggtttgtatgagaacctgactactacccatagtaagtaaatagaggtaccctgaaaatagtgaagccatgtccttctcttataacactaggaattaaagtggcatgggagagactgctcacatttgatttctttggtttttggaccctgtcacatgagtaggggttgtcaagatagcccatggggctagttgccgtttctattacagtgagaaaagtaggggccttgagttgttggagccagaagtggagaatgcttagagttgaactatatgagtttgaaaaattgggaacacagaggggttaagagcactgcttgaagatggtctgcaagccgggctcaaatagaaatctaggtgggtcagtacagagctgcctgacataagtaagtagcacatggagcattgcttgttgtcacagttgtatggctggttgcttgaacagtagccagtggaagacctagtagaatgtgtagagaatctgggtgccctagtcaaaaaccagcgtcggtatttaagttgggatgtggtattcatcttgtgaccagttctctacttctgtcctagggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcagggtaagaggagtaatttagaatattccgtgtcgtggttctttgttcatcctaccaatatgccttcatgccatcaaaacttttgatttgtaatttcatacatttctgtgggctgtatgtatagcctgagcttaatttctaatatttgagaggatctaatcatttaattcctaaaactttcacaaaatacaggatatctgtatggctgatatacttgtattagatgtaagagaattagagaaattatattttcctttaattaaaaaaaaaaaaagcctgggcgcagtggctcacgcctgtaatcccagcactttgagaggccgaggcgggtggatcacctgaggtccgaagtttgagaccaacctgaccaaaatggtgaaaccctgtctctaccgaaaagacaaaaattagctgagtggtggcgtgcacctgtagtcccagctactcgagaggctgagacaggagaattgcttgaacctgggcagcggaggttgcagtgagccaagatcacaccactgctctcaattctgggcgacaagcaagactccatctcaaagaaaagaaaagaaaaaagacaaggtctcattctgttgcccaggctagtgtgcagtgacacagctgtggctcacttacagcctcaacctcccaggctcaagtcctcccaccccagcctcacaagtagctgcaaccacaagtgcatgccaccatgccccactagtttttttatttttttttgtagaggcaggttctcactatgtcaccaggctggtcttgaattcctgggctcaagtgatcctcctgccttggcctcccaaagagctgggattataagcatgaaccaccacactcagcctcctttctaattttcctgatcctctgtctctaggtgtatgttaatagacaagttctagagaaagctgctagttaacctccctacctgaagtcctaattggtttttctatcacatgttgaatgaagcgtgctttttctcaaaaagtagatagtcatctctctgtattcattagagattggttccaggacctccctcagataccaaactctgcagatgctcaagtctctgaaatgaaatggttcagtacttgcatataaccttgttcatcctccagtatacttgaaaacatctccagattacttacagtacctaacgtaatattataaatgatatgtaaatagttaaactgtgttgtttagggatagttaacctgtgttgtttagggaataatgacaagaaaaaaatgtacatgttcagtacagatgcagttattttttccatctgctgtttagttgaccgtggatgtggaacccacaggtacagagggctgactaaaattgcttttaacttgctttattctgtgtattcatcatatatatttttgtttgtttgtttgttcttgttttgagatggagtttcactcttgttgcccaggctgtagtgcaatggcccgatctcagctcactacaacctccgccttctgggttcaagcaattctcctgcttcagcctcccaagtagctgggattacaggcatgcgcccccacgcccggctaattttttgtatttttagtagagatagggtttctccatgttggtcaggctggtctcgaactcgcgacctcaagtgatccacccgcttttgaaagcctcccaaagtgctgggattataggcgtgagcccccgcgcccggccatcctatattttttgaccatcatttgataaaataaataatttaaacctgctgttagaaaagtaacaactgaataaataatgcaataattatacagctggattattttgtataattcactttccttaggttttgcttaaacaacttggtacaagtctattccaaaaggtacacatgactcatacagagtagacatttgtcacatattttattcggctcattaattagcaagggaatctgtatttgaggaagtgttcaatattagaatattagaatagggattgctaggttagattacaaaactaatgtcttacagggaaacctcatataacatgagcatttatttagtaacacagtgttacattttcctagaatgggcttgttaaataatgcttctgtatgatattgaaagggtgtagttatcttggcctttttgtcaggttttagataattatttttaacatcggaaattgttttataatcagttaagccctgtgaatttttatcttgccaattttaagctcatgatgattttttagatacaggttctccctcccccgcaagctccttgtgaagtccaaacccacatttagaattgacagaactggggtgttccaactttcaaagtggaaagcttctaggtttgtcttaggtttctccaggatattaaggtgtttgagctacttaagttcttattttttggaaccaaaaggttggatgaattggctaaaagtcagttttgtcatactggttgtttcaggaagagaaagggaattttcttatttacgattttgtgtctcacttagcctgaaagctttaattcctcagaatagtctttatgtctgtgaaagtaagccatgtgtaaagccatgtgtaaaattgtaatttttaaaatttcagtttcccagttcactataatttttttttgttcttttctcccttgaatggcttggcttaaaatgttttcttataataaagaaaaagcctgcctgttctgagtgaagctctacctcacaacaggaagctggtgctaattggtattctgcaggaggcttcttgcagtggtattgcataactgcccttgacttaggaagattttcatcctgcatatcctaaatggttgacttgctcacagtcaaaaatgtctaagtacatttagatttagctaatgtagattcagattctgaatgtcttttagaatattttgggctttggtatagactcaaagaatttcacatttttggctgggcacagtggttcacgcctgttatttcagcactttgggaggccgaggcgggcggatcacctgaggtcaggagttcgagaccagcctgactaacatggtgaaacctcgtctctactaatattacaaaaattagctgggcatgttggcaggcgcctataatttctttgggaggctgaggcaggagaatcacttgaacccgggaggcggaggttgcagtgagccgagtcgtgccattgcagtccacccagcctaggcgacagagtgaaactccacctcaaaaaaaaaaaaaagttattttaaaataaagattaactaatttccttattgaatgtgagatgaattgctctgaaaagatgtgtttttaaaacacaacatagctttgttgttgctgttattacggagttttgctctgtcgcccaggctagagtgcagtggcgcaatctcagcccactgcaacctctgcctcccgggttcaagcacttctctccctcaacctcctgagtagctgggattacaggtgcccaccaccacgcccggctaatttgttatatttttagtagagacgggtttcaccatctttgccaggctgatcttgagctcctgtcctcatgatctactcaccttggcctctcagtgctgggattataggcgtgagccaccgtgcccagctcaacgtggcctgtttaacttgagttttacattttttaaattccccttagagaatgatttgatcagattattaattgctcatatttcagagaaagcacgagaaaatatagttttgacatcactttctgtaattttttctttttagaggaggttttacaagttttcatttgcaatgaaaacacaagcctaaatcttacttttccaaactgggcttctgaattataatttgtgaatgcaaatcaagcagtggaaaaattatctttaagaaaatagcttatgtcgctttaaaaaataaaattaatcctttcctaagcatgcttccatctgtattgtctagggaacatcaattcattcagctctgcgggctccttactgtatacatatagttatgcagcttcatagaacatgagctattgccacaataaaaataagtgggaaggagcagagaagcagtttgtcttattttactcgggaaatgtttatgcaactctgaaatgtgagtttattcttcccaagcttttgtgcttagctctaaggcaggactacctaataccactctcacagccagccatttgaaatttgggattctgagcaatctaaagagtaacttgtctctggaactgaccttttgctgaccgggagtcctcataacttggattttgtgtgggttgttgtgtctttggtgccactgctgctcattcattcagcacctcagtgatgctgtttttcatactgttcgattggtcgggggtgtgatgggcgaagcagtctaatataattaagctagttagggtaagggacagtactgctgatgctgagtgagcctcagtgagttttattaaagttgttttcgtaaatgaaagaggttgtttgcctttgtcctaagctaacaaaggtagtttatttgtgtagcattttttaaaaatcccttttaaatactctgatgcgctctccccctacagatgttcattctggacagagtggaaggtgatacttgttcccttaatgagtttaccataactggatcaacttatgcacctattggagaagtgtgagtaaccctcctcctcatttaaaggatctggtgtggcagtttagtatttgtattgatttgcagcatgtctacaaagttaagacagctttctgaatgtggctcaagtcaacacttattactaaagtagtaaatgtttttaaaacaaaaactttgaaagatgaaccaaaggttataatccagtcatctttttgcatcttctgggctccaaactttcaagagggatttgtgtttgttattcactgtagccagtggtggaagaattgaattaagaatttctggtctttttactgattgatttctgataccagagatgcattctctcttttgtttttgtctaatattggctctggcatcaaattgtttggaattttttccagtatgttgtcccagaaattctgttttcattattaaacaattgcgggggggcagggggcgggaggaatcaatagtggcgaccataccctgctctaagagtgttttctctttgggcaggcataaagatgataaaccagtgaattgtcaccagtatgatggtctggtagaattagcaacaatttgtgctctttgtaatgactctgctttggattacaatgaggtaagtctcttcataaattagaaggaatggctgttcctagttcaagggtggggtgggtggaatgaaagtctagcctgccttcctcccttttgaaagtcaagggtgcctgattttgtttcccccttccattcagaacctgatggtggggccagcatgacctcaccaaagaaagctgagagcctttcacatatcctctgtgactgagcattgcagttagttaacttaaagttgtagtatatgtgatgttctttctgttgatagcatacttactataaatgaataaaacccaggatagaaaatgctttcctgaaagcaaaggatatagtttctgtctcaaaggtaagctagtccctgtcagagacagaatgtgaactcttcagaatgataagcagtgacatggaattacattattatgtgaaggcactctttgaattaatagtgtgatcagtggcttcttatatttgggtgaaataataaatactgtgtttgatgtcatcttatatttaagggaaatgaaaaacctacttattagaataagatcacatgcacacctgtactttgagtatgtttttaattatctgggtcacctgtttcagaggaggataaaaatggccttacagtgttgtaatagaggacagattgtgcttttgtggaaaaaaaatattaaagataaatttatctgtgtacttctcccttttttctactttctgtgcctttaaccaatacaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtgagtatttgaacctggtttattgttcatgctgcttatcagtcgtactatatatacttagtgtctgcactgtcctactctcttagaaaactaattataccttatctcctcaaacttacagtatttccttccccatattcactctcaggtaagatgctcttcctgtgtatttgaccaggaaaataaaagcaatcaatagctaatttccttgagcgaccctctgggcccacaggggctgccttctcccatagtgctgtgaacagtgttcttgctcctagcagaagccacctcctcccaacatctttgctgcattattgatttccatctctactagatgttcttcagcatagggggaaataatagtgtctttctatcttgaaactttcctttgaccttatttcccctgtcagctaccacactttcttttcctgttcaattaaaccttttttttttttttttttttgagacagagtttctctctgtcaccagattggagtgccatggcgcgatcttggctcactgcaacctccacctcccaggttcaagcgattctcctgccttagcctccctagtagctgggattacaggcacacgccaccacgcctggctaattttttgtatttttcgtagaaaggggtttcaccatgctagccaggctggtctcgaactcctgacctcaggtgatccgcccacctcggcctcccaaagtgctgggattacaggcatgagccaccgcgcctgggcatcaaacatttcttaactcatttgatgagaccagcataaccaaataccaaaggtcaatgtggtgatggtggtggcagtggcagtggcagtggcagagggcacccacattgttcatgtatacactgaacaaataagtggcctctgagcctttttctgcctgtcagagtctttgagacagggctcattcgaccagcatcactatgacaagggccagtagcaaggatggggagtctccacagtgagttggacctgagtgaggttcctctcaaagagctgctgctccctcctgccaagaccaccatactggacctgtcctgcagtactgcccttagatttctgtggcctcacaagcccggggagcctagacctcagtagaaacactttgcaacggctgctggtgaagaatggccatccattgagtctctagcacctgggtctcctcaaaagactggtccccctgcctgtcacttggctcagcttaagaacttgaagtggaccaggcgcagtggctcacacctgtaatcccaacactttgggaagctgaggcgggagagtcacttgaggcctagagtttaggttgcagcatcactgcacttgagcctgggcaacagagtcagaccccatctcaaaaaaaaattaaggcctgaagtggctaaacttgaaggataactccctttatcttatcctggccaaagtggtagatgattgcttggatgagaagtgatatgcagataagatgttgcaatacacaaagtctgtgtgggtcagtcggtcacgtgggtgccaaggacaggtgggagagaagaagcaagctacagaagcagctcaagaatgggaactgcggaagctgattgtattggaggaaggagtgtgatgctctcagagcagccagggaggagcagaaggagcttagggacgtaagtcaggctctcaaagtctatgtctggttcctgcccccacaaaccaccacccaggaaacatcattcctgagctgtgtggcagcagcagcagctgctccttttatatggcagacagggtgattgcttgttgggcaagagccctcctacactatcttagagtgaataccctctatctgcagtccagggtctgcacagccacatggtcctctaataggtccaccagaccatttgcctgcaaacagcctcatcctcagtgcccactgtctcctagctgtggagcttggattcctatggaattgggttctgctgaacatacctctttttagcatcagacctacctgtctgtcatcaccatggggctgccagtcagtacttttgcagcctctttataggacattgttgtaacttagggttccctggtagaataaggagcgatgggaaggggagaggttctgcctgcctgaaggaacaggtctgggggaggagagaggtaaaactcagccttttctagttgtcatacacagctgtataaaggcaagcctcatttagcaaaatgattagttgtcaccacgtttaatgctttttgtatgtcataagccctttcatcccttcctggataataagggcaaatgaggaggcattgtgtcattggggggtagtacagcctgagttgggagggagcagtatacctgttttcttaataacctcaaatatcaggcattttagtgaccacacaaaatctcagggtgaaaagttctagaccatcatgtccagcctgcagttagggacacctagcccttccatgacctgtatggcgtggtcttccggttagtgtgaggcagcattttgtctcctttatactgtcctgagaaaacaaaactcacactggaattgagactgtctcagctgaaatatagattccttttcagtaaactgatgcacaattcacaaatagcagtctcaaagccatgaaggccttggaccactcctttggcttcttccctctacccatgtgtcttccatgaacccgaagcagtccaggcttattcactctgccagtaagcaaggagttggatcctggcagagccacgctgcctgtgatctattagttggtgtaactaaaaatctgaggcagcctgaaaacagcttcacagattgagggtttgagtcgtttgattctagacctctgactactccactgagtgatgggaaacaagtcatgtaatggggctgaaccagcactggctcactagccagtgaccacacaagtacgggcaatactgtcatccttgtgtctccctgctccagagctcccttgtcccatctttttcacatcccttggccaagggatcggaaacagctgtcatgctgctcattcactaaggagttccaaacacaagctctttgcctcccttcccacttgagacagcaggaacccatgtgtagtttagaagcagagagagcaggtccagcattttggccccatggcttgtttggtgaggtctgtggttcttggccagcctagtactgaaagggatttccctcccccactcccagcccaagacctcttacctgggtaggtccacgccttcctcagaatcattgcgtgttcctttagtcatcccagtgccattggcgcaaatgcttaattgaaactaaacacacgtgtgattgagatgatacagaatctagcgtagcactcatacccattcctttgctgcctgagacggttcagtggctggcaggccagcaggatcgctgcagggccctgagccccatctagtcagttcatcagccttcagtcctcccgtagcttcctaggttagatgctgatgttcttggggatttctatgatgatttttaaatgtgtgtcagtgggagcaaatataattaactcaccacattaaccaaattaaggtggaaaaaacaataaggtcacctcagtaggtgcatatgatgaaacgcatcttatcacaccaaactaagactataaaagtgtgtctttaacgctgacagtgtgtttacacagagaccatgctaacataacagaattctcaccatttctatgcagtattatactggcattcctggtctgtgtaataggcaagaaaagtacaaaaactggaagagaaggggtatctttagttgtaggtaacgatataaagccaaaggtttattctcagtcttcgtcttcctattttgttggtgctgtcactcgctccctctttgaagcacctcttcacttggcttccacgatcccatacttgctctccctccctggcctctcattcgaggtctttgtagctgggtctttcacaaggcaccaggaggtgaaggctccatagtcctcagccatttctgtctatagttactcccatgatctcttctggtctcattactataatcagtagccactagctatctaaaactacttagaatacctaaaaacacttccttagatgccctagccatattcacttaaagtgcttatccatcacgtgtgacagccacatgaacagtggccacagagcattgccatctttcacagagttctggtggacagctctgcttggggccatctcttcacctccaacgttccctagtttaagtcagtgtcattatactgaatggtattccttgtctcccttcagccaatgcttttgttttttgagatggagtttgctctttcgtccagggtggagtgaagtggcgcaatctcatctcactggaatctctgcccccctggctttaagcagttctcctgcctcggcctcctgagtagctgggattacaggtgcctgccaccacacctagctaatttttgtagacagggtttcaccatgttggccaggctggtcatgaactgctgacctcaggtgatccactgcacccgaccaccttcagccaattcttgacaactggagcttgagaccctccgttgtcttctgttttacttgtcttaaaagccaaatgccccataatgacttttgaggtcttaatgacctgcttctaccatcctctgccattacctgcctcaccttttgctcatgtaaactctattccagccacgttggcactcctttaccattccaggacttgccaggttgcacttccgttctctgcctggtgggtcttcaccaccacccactgggttcacacacatcttttcaggccccatggggccatctttattcaaatgtcaccgccttctggccactttatgtaacagttcatatgtatgtatgcaaattttctatcccccttccctttttctctatagcacttgtgttacttttgcatcttagtctgtctctcccaaaataggggacaagtttcatgagggcaaaaacctgtctgttttgtttattgctatattcctagcatctgtcatgtaataggtgtgcttactgcttgttaggtaaaaaagttcagaaattgccacccagtagtatccatatttgttccctttgtaggtcattaaacagctgatgaaaaaggaattcactctagagttttcacgtgacagaaagtcaatgtcggtttactgtacaccaaataaaccaagcaggacatcaatgagcaagatgtttgtgaaggcaagtatggcagattgcaattgagatgttcttgccagggttaagatcccggtgaaccaataaaacaaaattgtttatctaaatctgtaacatttccagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgaggttagctaatgaaaagtttctttgtccacaccctgcacgattcattgtgtttaaacagtactccttcaagcaaaaggtcaaacagttctcacttttgccaagaaagaggtgtggttatttgtttttctgcctgccagctgtgtcacccttaaaatttgctgcttcaaacatacatagttaataatttcataaaagtgttattttcaaagtagaatattttcaaagtagaataatcaagatgagcttaagcttgtaaaccccattttgcctctcatctaaatcatgattttttttaaattggtgacatttctagaatattcattagttactgaaggtcaaaagatccaagttggagattacttccacttttctactcagagtagaattcttttatatcaaggatgtgacatcctaaagctatgaacaaaatgaagaagctttggtactgtgggctcagaatagcacaagagttaaagaatggtttgataacgggtgtagtggtatttttttttctcataagaaaatgcaaaaaccgccaggcacggtggctcaaatgcctgtaatctcagcactttgggaggccgaggctggcagatcacctggggttgggggtttgagaccagcctgaccaacatggagaaaccacatctctactaaaaatacaaaattagccaggtgtggtggcgcatacctgtagtcccagctaccctggaggctgaggcagaagagtctcttgaacctgggaggcggaggtcgcagtgagctgagattgcgccatggcactccagcctgggcaacaagagcgaaactccgcctcaaaaaaaaaaaaagaaaaaaaatgcagaaacctgtctcaatgtttaactgggcatttttcaaactaggggacaaaaactagaacttgccacttttatttaaagtgatgctcttattttagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatggtgagcatgtttgaacatgtacaggtgactcaggctacacaagcacatagtagcctctaattttgaccactgaatttttttgtcatagctccctaatttggaatttgtcatgatttgggtcttttctctagaattcggtgaatcagtggttagcatgttgtgtgctacttgcagggaagatcctagagtcgtttaaaacccagaagggccttccagatcagtcccagaggaacaatctggtgatctagtctcttttttaaatgagacgtgtttttattgtaagttttctgaaaattgaggatgtaatcagtcagttgtttggatcaccctgcttttaagttctttaagagctggctattgatgaagcatttccagtattcttcccctcacctgattttcacccagatacattatgttaaatttactttcttctcttttaaaaaaaaatcttagttttgaaacatactataagtgtactctcctctcccccagaggtaactgaagttggaatttagcaaaaatattaaaaacatgggagtgctgtttttgtgtctgtagacagtattatttttgcatgcttttgaaggcatattttttggccgagtgcagtggctcatgcctgtaaccccaacacttgggaggccgaggcaggtgaatcacttggggtcaggagttcaagaccagcctggccaacatggtgaaaccccgtctgtactaaaaatacaaaaaattgctgggtgtggtggtgggcgcctgtaatcccagctactcgggagattgaggcaggagaatcgcttgaacccaggaggcgtgcagtgagccgagactgcgccactgcactacagcctgggcgacagagcgggactccatctcagaaaaataaaaatttgcatatttttgcaatctgcatctttctacttgaaatttatccatgtggatacaagtgcttcctcttgactgccacataggttgtgtttttgtttttagtaagataatacagataaatttgaagtcccctttgtcccacttcggtaaacttatttggtaattttacatttcctaggtaaaatgtgttttgtgacaccaacttatgaaacaaaaattctaaaactctttgccaagagacctacggctctattcattttcctcctgcttcccattcagtgggcttttgcctaggggtatgaatgtggcatgccagttggctgacccaaccattgctttccctttcagactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctggtaggtctctgtgacagcatcacttactgtacgcctttatctaaatgggtcatggagcccagttctcgcagtttgctctccagattgcagcagctttggtctttgtgcctgagttggaagaggggagtgggcaagacagaaatgccttatggaagcagtggtgctttggccctcgggagggttgtctgcagctgccccaatgtgcaaagaatcctctttaacgtgagactgagctaacattaaccaggtagtcacatgaaattcttgccctccaaaagttggctttatctcagtcagcttaataatttttttatttttatttatttttttgagacagtctcgctgtcgcccaggcttcgggcagtggcacgatctcagctcactgtcccctccacctcctgggttcaagcctcccgaacagctgggattacaggcatgcgccaccactccctgccatttttttgtgttttagtagaaatgaggtttcaccatgttgcccaggctggtctcttaactgctgagctcagccagtctgcccaccttggcttcccaaagtgctgggattacaggcataagccaccgcacctggcctcagtcatctgaatttaagtaataaactaagtaaaattgagctttaattcaaaattgggtataagtattttacagattacctgaagttgttgtcatttatttttctggaggagggcgggttgatgatgctctttaaatagtggccagaagtcatttgggctctctttgtcttcttttcttgattggaaacagtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgtgagtacaatttttttatattactgatttttaaacaaaatgtttgtgagctgaaattttgtaaattcatcccttaaaagcgtgttttttcttctatccccgtatagggtagcaaaagacagagatgccctcttacagttcgatgaactatacatccaatttaccagagtcctttcacagttagttccagttttagcatcctgcccttacttgggcttttctgaatgagcaattaaacatcagggttttcagattgagccctctgtgcaaagggataagaatgattcacgctaggttctgccttccaagagttcataggtgggatttaaatagataattgtcaccaagttataaaatttagtccctgtttccataagagaagggttgcgcagtggctggtcccttttatatataaatcatctctttagccctcatcttcctcaccccgggttcttccccatttcatagattgggaaagtgaggtgaaatcacttccctgggatcccataggaaggcattgtgttttcataatatattcacatgacttcaaattcaaaaagcacacaatggcatagaatggaaagggtttgggccagtcacttccctctggcgttgaggtgctcatgtaccctgtgcccttccggagagattccagcatgctgtgcacacctgcatgttgacccttgtcttgccttcttcctgcttgtcagatccttccatatccggacatgcgtagtgcctcatccttgcagccagcggccttcatgctccactgtaattcgtgggttagtgggtatatgcacttgttgtttttgatgctaccacatggggatatttgcctcgtctgaactctgtgtattctctgctgcaccttgttgcttctttgcaataaacttcctgaactcaaagctaatactggggggaatcccagaagctgctgagggcagggccatgctgctcagtgttccaccctagctcctgacagcatttccctagaaaactgctgctgggcctctaatggagcaaataaatctgtgtacaactaggcagcaatagtttgtccaaaagtcctggtgtaatctagtccctcaaactgtgcagccttacatggagtacacacacacttgcagccttgaagtactacccactgaggggagaaggcacggcaaggggaaaggttggcacaggatggagcaagtgctttttctcacacattctggaggaaaagttatccagttcttctgttctagaaacacccctgtccttcagaaaccagggtctagttgctctggctaccaggcgtgagcaggtggtggtagcaccacaggccccggttaccatcactgtcccatgtctttgatcttcgtccttgtggggactggcctgcatggcctcggtggcagcgagccctgcagaggcaagtgcatcagcatcactgtgtttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggca

SEQ ID NO: 14188 - DNA, 17645 bp, Human
ctgaaactgaccagagagctcctcatgtgggtcagtgtccctgccagggcatggggccaggggccaggggccaggggcatgagggagcctcccagagactggaatgctgagccagggctcctcagaggaaaggatgtagaggagggcccaggaagtagcccagtggggccagtttcctctcctggacagctaagaaagtacttatgaccttcggccacctgggctgtctgagcaggcagggcctgctggccaccaccgtcctgtacaggcacttaggggaatgaatcttccccacctgcagccccagcaaacacacaccaggctggtccctggcaattcaccccaagagccaggccacagctgggcagaggggtggccagtaacagctggtgtcattctctgcaggatagcccctggacaagaggcataagacccactcatccttgccctgccccaggcacacttagaaaagtcctctcaccgggcctcagtttcccacctataaatgggaagatgccaacacgcccgagtgggactgtggtggggcaggcaggaggtgggaggagagcccagatcatcccaggccttccctaggggacgcagggggaccctcccttctgggcctggttcttccagcacgttccatgcagcaggcaagagggccaggcccaggggttcctgacagcttgctggccctggagtccagattcttgtttgttggctggcgctaggcctctggattggagatgcccggggcacaggcggcccacggggatctgcagcagggcctcggcccctccctctgcaggggctcgtctggtccctcccgctctctgcctctcctcatttatctctccctttctgcttcttggctctgggtccagtcctatctcccctgtttcagtttgtcttttcctagccctttgcgctctctctgtctctctcagccctgcttgtctcactgtctctggctgggggatctgtctctttcacttccacttttgctctatttccctgctactgtctttcctttctccttgtctgtctcttctcctcccctcagccagcatctgtctgtctctgcctttctctcctgctccctccctccctcctctccagcaccttccaatgccaggtggggctgccattccttccaccttcccagtgacccgccagtgtgactgccttgagaggaaagtcctaaactgtccctatcttcaccagcctgccctcaaatcattggttcaaatcgctgtcgagaagtttgggagctcccagggcgggggctttctaacagctctgcctagctcgggcctgccctcaaccgcagcatgcagggcagccacagacaacctctctgcaacttctgatgcctccgtgcccccatccacagagccctggctctgggggactggggactctgggacatccctaacatggcatgcagtggcggtgcgggaggacttgactgcccctctggagccctgggcccggggactccaggccagtgcctctctgggtcgggatggggatgtcaggccagcaggatcatggtacctgcctccagggagggcaacgtccacccactgagtccagcccgcccaccccacccactccggagcacctggctctgccctcaggaactccctgagctttgcacacagggccgagacacctggatttctctggttccctgagtggggccagcttggaagaatttcccaaagcctattagagcaacggctgcctcctgcctgcctccttgggctgggcagggctgagggcggagggagagagagagagagggagggggagaggaggaaggaaaaagttggcaggccgacagcacagccgtgtctgcatccatccagaggaggtctgtgtggtgtggggcgggccaggagcgaagagaggccttcctccctttgtgctccccccgccccccggccctataaataggcccagcccaggctgtggctcagctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacgtgagtggggtgtccctgggcttgggggggttctagaatgatgctgaaaggcactggttccatcctctgcccattgtgcagatggggacactgaggaacggagaggacaagaggttgctggaggtcacgtagagagctggggggaagagctggggctggaactcagctatgcatgcctcccaaagcctgttttctgccaggcactgtgggaagctgagatccagagaataatggtcttgccaatgtcccctgcagggcatctattatggggaataagcttggccagcagttcctcgccccttggctgtagctttttggcccttctcagtcctgcctgtgccgccagctccctcctcctgcagccctgcaccctggggaaactttgcccgctgtccccagccaccctgaaccaaatgcccagcctgtctgcagctggctctgcaagtgtgtgagcaggactccctcagggagccccccatattcacactagtttccaaataaaccacctctaggaatcaagagaaaggccctcttccactcttttgcccctgagattagacaaagataagggagtgaaaacactctctggggctgtttgaaggcagttttcctggattacagtatgggctggggggcaagcgctgggctccatggtctctaggcactgagaggtgtggcgtgtgtgtgcatgtgcgtgtgcgtgtgtgtgtgtgaaggtgtgtatgtgtgcatgtgtttgccagcatgagtctctgtgcttgtgtcaactgtgtgcatgtttgtgctgctgtgtaagggtgtgtgggggtgagtttgcaacacgtgcccatggctcctggcttgaatggggtctggactggggtcactaatgacaagcagatgctggtgactgggtggcagctgtggaaaagaatgtctcctgggctgcttagcatggcaaattggccctggtggcagctgcctgctgtcccagacacggcctttcccagctcctcagacaagtgcaaactcaggccgggcttgggccacagcaggggaggatttggcctgagagactggggaaggcttggaggatgtctctgagggcccaagggacaggtgagcaggcctgggggtgcccttacagggagggagagaagccaaggagcagagaggaggactcgtctagagagatgaggctggcggggctgtgggcagggcatgtgggtgtggggacggtgtgggccatctctgagggcgcctcagagatggcagatagtgattacagcagctgtcctctcgcttcccagccaaagttcagatcctgcggctggcagcccaggagaggctaggtgaaggtctggtgcagagggcagctggctcagcctggccatggggggcttagcacttctgtgtcacggtgacacctcacccaacctcctctgcagccaacctctgctaggcccaagattgaagattagctccgtgggctggagtttagactttagccagtttagacgtggccgcgggggatgtacgggacagagctcaggcaggccacatcaagctctgcccccccaggcctcagttgccagtgggtgcagagcttgtggcctcagggagttctgctgggtagggtcaagctcacactgaagcttggctgggtatgatgggctgggggagcgtccctgtaggggagtggatgtgatttccaggctttctggccccgtctcttccctcccatctcacagggcggagcctctgcacctgctggcgaaggcttcaccctctagtatgcgcatccgaggcagaggcgggagggtgggccccttctgtgccatctggaacagaggccacaccagcctcccgtgccccattccctccctggccttcattttttatagtcaccccaatacttgggctgggcgtgttgcaaatgggagagaaagaggagcagcctagtgtggggtccggccctgggctgagaggcagacacctgggttcaagacgtgtccactgctaacttgttgagcttctttggagctgcggaccctgaccctcgagagggaactcaggtcttgtgacctcacagccacacccagacagccagctcacttcattgctttgagcttatcacccatcccacgaaagctggctaagagcagcccagcaggggcagtgctgaacataagggcgcttagcatgatggtgggggctcaggcgctgtcctgtcccaacagtggaagggtggggttcaggacctcaactctgggcctagaaatagagaaggtacccctctaagggctcccgtcagacactggccctggaactggaggggcctcaggggtggcctggatgcctcaagaggagcagggaacagtctgggcagcaggtgacacactctctttcatgacctggggtaggctcctgcagcctctctggccctgagccccagcccagtcaaaacctgggtggggcaagtggttggcatggagatttccaaggaaaacagagaaagatgtggcaggaagtggttggggtgagtcagggggtgtcccttcgggacatgctggggacaactttctcctgactgactcagggctcaggatatgccctagagagaccgtgggcctccgtccagcctgcaaggtcccggctagttctaagagccaaataccaattttggctaagggtgagaggctctgaggctggggtggacactctcacctgtccctgtcctagctcagccactaacaccatgtggcatcacacaacagactggcctgtgtggccctagttcctgtctatgagatagggacatagcagggtgtggctgggctctgagaagtaggagatgctggtggactcaggattcctggcatttgctggcttttttcattcttctgctgtctggtctgctcagccggctccctgcaagcatgaccagggactgctgggtgctcaatgcagggctgggttagcccggctccctcccgagagaagcccacagccctaggtcaagataagccagtgcccagctgcctgtgatatgaagcaggaggcagatgcgataagaggtgtcagggcgggcccgggaacttttgaacttaaggggtgggagggccaggaaggcatcagggaggaggtttcgtaggagcctgaatgtggagacactgcagagggaaggggcagagggactgtgtgagcaagcacaggctaggaggaggtgagggccgtggtacgggagttgttgggtatggtcaggctgggggtgcatgggaggagggtggtgagggctcaggattcgggccaggggctgcatccgggggaaggggtctggattcccagagcctgtgatttcagcccgctgggctcaggcagagggcaaagctaccctcttcggggtcttctcccagccctgctaattccaggcctgactgctcaagaagtgtttctacctgcagcatcaggggcctgactgaagccctaagttctcccctttatcccgtttttctgggcttcagtttccccagtcatagagtgagaggcctcttcatgccaccagttctcccgggggtgctgctgcctcctccagagctcaggggagggatggggaaaggaaggcagagtttccatgtccctgcccagcccgtcctgcccagggaggggctgggggctgggtggtgatgccacatctgggacatataattactgtttccgccagccccagatgagggggagggcacagagatggggagctttgtggtggagacttccctcaccatggaaaatcctgacgctgcttcccctttagggacctcagaacagcccagccggtcccagtgttgcccaccctgatgcttggccctgactgggatttgccctgggaactctgaaggggccatgctttgagaggggacacggcctcctgggatacctgtctgaggggctcaccccctgctcaccactcccaggccacagcctcctgtcacaccttgccttcccttctccaccccaggcaaccttctagcagcatgaagtggccattagctcactgcaagccaattccagatggtacccccacttagtctagggcccccacccagcaggggccatggcccttaccttctggaagcaccaatgagtctggagtctcctgagtggctgggatctgagccctcacaccgggaggtgaaggcaggaaaatgctgtccgcgaggccctgcaagtggccaggatcccctcagtcagggcttccccatggggatgagaggggctccttgcccacatggagtggtgcccagggggatcatgaggggctgtcttcactcagccaggagctacagttctgtggggtgggcagactctgaggctgaaatctccaacttaaaagatatccggaaaggccggaaaatgcccccggcccttccagcagctcctttcagtgcctgcaatctcgctgtcagggccccttgaaaggcagatttctactcagtgtaaagaaggttgttgttgatattgttgttgacacgaagaaggggctgtctctaagtcaataagctccctgccattaggggtgtgcaagtagatgctttctggtgaggaggctgctttgggggtgctagtctatgcgggggtccagtggggtgggtgacaggttctgcagcataggctttgtgtcatgctgagatcagcaattctgatggcctgcgggggatcctgtgcttaggtttctggatctggggctggagagtgaccaccccgatgtgaggcaggaggcacttttggagactgcgggggctcgaatctgggccaaggcctccattttactgatggggaaactgaagcccacagaggcgtggagacttgtcaaggtggcactgcctcctagcccttgattattcctgctgctccaaagtgtacacacatggcacaaacacaaacatgcacacacatgtgctcttacgtggaggacacacacacatggtacacaaagcacattctcaagactgggtggtcccactcagactctgggacccaaggagggttgggcggggattcctcaatggagccttttcctctccctgccctggagttaggaaaagaaggagggagggagggaggaagccattgctttgtgtattgtttcttgtcaggaagatgaaatggcttctgggagcaaataaaggccttgttgagacctgctgctttctcacatggggggctcatttttttctcttctcttccctctctagctggtagtggcagctatgtgggtgtgtgacacagggagacagtgaggcacccagaagtgccatcagacataccagtgcaaacacacagcacagcctccaggacctcatgtcctgcagggatgcctgtatgatatagctgttcccagggaggccgaggcacttggtcagtacctcatcagttgatgaaaaagagtgtgcattctctaattcaggggtacagggttttcatatttttctgaagtcaagcttgttaattatggggttcaaaccctccctgatcatgttattggtagttttcggctgcttcatttattctgtacatttctaatagaagattgttaacatttttcactctggtggtagggtgatccagtcctccttgtaattttgtcaattttcccctcatttatttttaggctatgttgtttggtgcatacaagtgggggatttttgcagttcctttatagatttttatttttttttttgagacggagtctcactctgtcgcccaggctggagtgcagtggcaccatctcggctcactgcaagttctgcctcccgggtttatgccattctcccacctcagcctcccgagtagctgggaccacaggccaccacacccggctaattttgtttttgtatttttagtagagacggggtttaaccgtgttagccaggatggtctcgatctcctgaccttgtgatccacccgccttggcttctcagagtgctgggattacaggcgtgagccaccgcgcctggccagttcttttatagatttttaaaatgtaattattgtgtaataaaccacttacaatctaacaaaaaagagaaagagggagtcagccctggacacatgtggtcatcacagacacagcagacacttatctacaaagacacacagaggcacacaaaaccaggaatccccccatgtccacgtgtgaacacccatggaggagtgacactctggagcccacataggtcccctcactgcccagtgctgagtcttggaggcactggggtgggcagggcaggcctcgatgtctcctatcccttgagaacgaaagctcagagcctcagtcaggcctggctctggagcctgctcttccccaaggccagggcaccagggtgcccaggccaagtcaggggccccatgccttggaagccaccctggttggcctgtctatgggtagcagggagtgcttagagcacattgcctggagagatcatccctgggctgccctagagccaggacacactggcagccacagaaccaccttctgccagctcccaagtccaagctgggaatagccaggtcccttgactgggcctaggagtggccagcccattgacctgtgagtgtagggtggcacagactatggggcaaggatcctggctttgctgcatcctccctgggcctcagcctctgcgtcatcatctcactgagccatcgcacaggctgccctctagggctcccagaggctaatgattggcccattgtttcccagctagaaagtgaagaagaccgccctgggtccggagagcatctctggagccaggctgcccctagcaagggtgggagttctagaaaattagcattctctgccacttctatcagcacacagtaagcctcccctcagaggcgtgggcagagaaatggcagaggtcccccactctgtcttcaccgagctcccaggccaggaggagatgcacccacataggccgcaggaagattgatttcctacaagatgcacagagaattcagtgagggcatggtgggtgggagcagaagttaattccagccagggatctgggaaggcttctaggagctggtggggtctgaactgggccttgagtagtgggcttacaagggcttagcacaaaatggagagcttgtatctttctgacacttcagaagaaatgtgtggattattctttcggtaatacttgcattcacaaaacccagggctgcagacaaaagcgggaagacaattgagaattgagaattgagaattgttctgattcttacttttttttttttttttttgccttaataagacctgggccaggcaaaactacctggggatgtgcaaatatatatgtacatatatataaaacaagtgactacaatgggaactgtccttgtttaagcaagttttcaaatttaatgggttgtaaacagtaacgtacatttgaagtattttacctgctctttcctggacattgagtttcaacaggcctttgagtgccccttccaattctgaattatcaagtgtttccagatgtaaataatgcaagtgtattagatagttgaaggaaggttgtcagtagatgttgaagctatcaggggaggcttcctggtggtagtggtagtgggtattggagaggaaggctgtcagcccatgtggttctcagcagtcacgaaggcacattccagaattcccagggcaggtggctgacccctccccttcccaaggactcagagtacagggcctggaactatcaccctctgctctgcccactttgcatgaaaagcatgttgtctttgggtaggggctggggctctcgcacctggttaagaaccagaggagatgagctctttctggtcacatctgtgagggatggggctgggagggttctccaaggcgggagccacttacagcgatgactccattaatcatcggggaagggctggtttcaggacttctgccagctagcaattaggccaaccctggagagcagaagagagaggaatagaaggagccacgagcttcctgagggctcagatacagagggacaggggcctcacaggtgcaagtgtgggtgggcatcaggactagccgggctggcctcaccagcctcaaccccattcagcctgtcctaactctgggcaggcttctgccagcagctccacccgccgtcactccttctgcctgtccccagatcctgcacacacaatgagaagaaccaaaacaagagtcactaccactgccccatccctcctgcgtcgacaactctttccaaaagccctgagacggcccctttggcctttgaacctcccagctgctctggagagcaggcacggacaatgagatccattttgcagatgggaagactgaagaccagagggaataggccatgctcatggtgccagaaagtagaagagtcagaacctgaacacagggcttctgcctctttggcccaaccttgggacagaaagggaactgggcattggccagagggctggcggacctaagggatgtagccctggggtccgccaggaaaggcccaaagctggggctgcaaggcaggggaggggatgtgagtcattccctgtaacccagggctgcagacaaaggcgggaagagaattgttcttgtaggatggcctcagggtggggctgggaaaacctccaaggtgtgcccccctaccttggattttgcaaaattctctatggccttggagacactcccatatcctgaggatgggagctgggtagtttgtctcccagctgggaagtgtttgggtgcaccagccctgcctgggagaaggcagcctaagtggcctcaagtgggcatctttgcaagtgagcctttgctgatgtggtccatctcccctgtgtgagtgcacttagcccctgggacggccacaaagcatagtggaaggtgctggggcttcctggggaggggtcctccgggggcagctgcatggggagggccttcatgacctcacagcagcttccattcccttctctttccatgagtcatgtttctaaaagtggcccaggagtaagtggcagccagacggtggtggcggggcctatctggccaggcagagggagggtgaggctgaggccagcagtggggaggaagaagagagaaggagagacagggagggcagggccagaagcaatgggagacaggccttggaccaaggaaagagacggggtggagaaggagagagagagggtggagacaatagggaggcaggcacagaggagaaagaggggtggagggagccaggacctcaccgaaggcctcctcagccctggaatttagatgcagtcgggcatggggtggaatgttctggacttttgggtatgaagccgtgtcccctgctgggccttcccacctttttgcatctcttctcctaggagtgctcctgaccatcaccttcatgcctggggctcgccccttgcctctggtcttggtaccccagaataccctggcctggatgcagctggatgcaaaggccccagctcaccccaggcctctccagcttctaggcagagtggggcctgggtctaggcaggtattaggggctgggctggagtttcattaacacagggggtgggttcaaggcctgatttccactacctgccgtgtaggcttgcctgggaccctgtgatgggctctgaaggcccatctgagggtccgcccttcatgcctgggcctgggaggcctgggtatccttggggtcctgggacacagtccctgcctaccctcctcaccagtcctcaccacctctctcccctgcagctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctgtgagtcaggggccctcccagatggaggtgggggaagggagggcgggggctggtggggtgccctgccatgggcagccagtgggactcccgacagggctcttgccattgggtggaggatggcgggtcagcgctgggggctgggggcagggtcctgccctggagaggagcacagggacctcctgcccagcttggggtcagcactcctctttccctgggtctcattgtcccccaccctgattgttctctttctccctccaacctctccctcctctcactctctcttcacctatgactctctgccttcgcccctccctctgtttctttccctcacagattgactacactggctgtgggattaaccctgctcggtcctttggctccgcggtgatcacacacaacttcagcaaccactgggtaggagacccacggggggtggggtgggaagctttggtgtcccatggtaagcctgaccccaccctcacagtgtcccttcctgttctggaggctctgggagacagccagaggacaggaaatcaggaaactgaggcctgccatgtagaggcaggctgggggtcacactgccagcactttcaggcctagtctctgccctcccagctcggccctgccccatgctgcctggcctccaggtcttcccagctgcgtggttaaaagtggggctccaaatcctggctcagccactttcgggtttagcatgaccttgcgcagtgtgcttgagctttggtttcctgagctgcggagggggatatggtggtgcccacctctcagggtggccgagaagaggaaagggctcactccccatctgtaaactgagctcaacacagaggaggcgctcagtggattttagctcttatggttgtggatgtggatgtgctaggccagctttgcattagacaatggtctctggggcccttccaaagctgggagtgtgggggcagtggccttcctcaagaaggggctgctactgcccatgcctgagctgggccccacagaggcaaggagttgaccctaccacgtactctggcctgggccggttctgaggggcaccggaatcatgatgttaggatttggctctcctacctgcctccatcccaggtgggaaaaacctgtccaacggggtggtgggctgtggggtaacctagggaacgcttcccaggggcttttgagtggagccctctgaacacacctgctctgttcctagattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtccttcaggcttcctgtagtttttcttcttttgatgctgtgtccccacaaatgtttctggattactccacaaggaaatcaggccactgctagagacccagtctgaggaggagccactgcctccccttctgccttcaagacccctgatctcaggcaatggatacagccacaccacagaaccccatctgagggacacagggtcctgcccctagtaggagacttccagagcccagtgggatgactttggagacctgggggcagggaaaaggggcaggcttctgatcagtttaaatggaccgatgggagccatttctgattccggagtatggaagggatgggggaaagcagggctgaagtctaacagccccctcatcccctctaccctccacagagcagggcccagggaacactagggattgctccaccttcctccctccctccactcacatttgcaacccatctgacctgggctgggcgtctcatgggagacagactcactcatcagagcccagtgcagttagggctacttcaggctgagactgggaccctggctcctgaccctcccgacgtgcacacacacttagtagtgcctgataatagggaacaggtatcaccacggcagtgggctgaggcaggaaatagtgtatggacaggtcctggggccccagcactgctcctgggagacacatggttcctgtcccctctgtggaatgcctggctgatggtgatataaggggggctgggtctcagggagccaggggctaggcatccgcaatgaagactgaggccatgttgatggaacagggtttctaatttaagtgtgccctgggtcactaggctgtctaagtccctgcaaatcagtgcatcacatctgcacactcttttccgttcccttgcaagaacttctagcccatttaatagataaggaagcttatctcccagcttaagaggggcatataaatggcagagtgccagccaagctatgggaattgggtatgggccagcccgctgcatcccaggcctgcctgtgagggtgtgccgaggctatctctcacagcccttctcagcttgtctccttaatttgtcccattcttcttggcctgaagccctcccaatcaccactatgggcccagccacgccacctcaactcctactcattcacttctacccccacccccatttcacccccgctccatggcacagccttctttagtgtattgcttagatatgacttttagaatcctagagccacgaggcagggcctgaataagccattagggaactggtatttcttgagcacttaccatgtgtgaagaatctctctgagattttgcatacattcgctctaatctttacaacatccttagaaggtagagatacgtgtccccatttgtagaagacgccagggcccctgaagatgaaatgatttgccgtaggccacacagcaggttggtggcagaattgggatttgaacctattctgcttggcttcaaagatcaggctctttgcacgatgtggtctgggccggttttgtcatgattcctgctaagttaagctctgggctagccaggaagccggactgcatgaagaaggcagccactcctgcagagtgggcatggggagggggaagggaggagaagggccagccacagagccatctggcatctggagaagcctgttcattccagggctaactggacgtggtgtcacccaaacctccctgctgccttccacggcctgactctccccctccttgggaggaaagtgtctgaggaccatgttcacccagcagaatacctgagaaggggaagggcaatgctgcaccatgagggataataatgcactaagacaggccctcagctacccatcaggccagggggcaacagctttgggctaaagggatcctagactcctcctcaccttccagcctgtgggtttagtgctccaggcaccccatctctttggggctacccctgactctgatcttctcatcttctatacagc

SEQ ID NO: 14189 - DNA, 24029 bp, Human
gccaccgcgccaggccacttcaccataaaatttttaaaaataatttttaggagctctgttactggtggagggtgcccaggttcttgacattttgaacaaagaattggacaaaacgtacaaagcaaggaaacaatgaagcaacaaaagcacagatttattgtacatcaaagaacactccttccggtaggaagggcccaagcaagcagcaattacagaattttctggggtttaaataccttctagaggtttcccattggttacctggtgtacaccctatgtaaatgaagtagtggccagcgatcagtctgattggttgcaggaggggaccaatcagaggctgaagtaaagttatgaagttataccccatgcaactaaagacttggcctgccaccagcctgactgattgcccgcggggaccagtcagaggtactttcaattttttatctgccacccagaagagggattagcttctggtccttttgttacttgggctagaaagttggggttttccttttgatttagttctaggaagtcagcctaaatcggccttaggttccctgtctccagaccctattttcctgcctcgtagcttttaggagattaatgcctgcctgcagacaacttcctcatttaactttcacaacacccctgaggcagcaagatcctggcgaggcagagagcctctcaagcttttttggatgaatattttccaagtctgagtttacataggtaaagaaatgtaagcagtttttttttgttttttttttttgttttgttttgttttgttttaacagaagtggctgctggagtggagatgggaatgggtaggactttagccgctccagtagccattaacgccccaccctggttatccttaaaaaattcgattaaaaaaaaagttcttaatatataaacatgacctcagccatcctatatatacatcaacataagaaaaaggtcccgtgctttttatgggaacagcttcaagacaggtatcccagcccccggcccctccccagcccccttgcaatcagatccttgtcttctaaaacctgccacacctaagagcgctgcctgaaggccggtttggcctgttgactcctggttttgactgttggtgatttaagcgattggaactggaagcaccatttgacaacattttgtaaatcattacttctgaggttgttatgacgacggggtgtggcagtccggcttcacctgtggcagcagcttaggtccctgccctcctgcagagcacacttcaccgacagcaggactcaggttttatacaagtctctactcgccattgcttacgtccaagaacccaacctaccaggtttaaacaatttccagtcacatacctgagccaccaccaccttatcctgaagggatttttgggtataatgcaaatcgattgaccgaacatttatttacttattcaagacacaaactaagagatggggtgtaactgattatctaatttgttaatttagtcaataatatgccagcattgtgcaggggaattacagggaataggaaaaagttaaatttgtgtaaatcatcagattgagtcattttcctactttaaaacttccattttcttccgatattaaaataaaaaccagacaacaagcacctgggggggggaaatcccctcttaaaattacaatttctatttttaattttgtcttcagttataaaatttattttaaagttatacaaaaatgaagtggttggattgtggaattacgtcttttaaaatgttatttgtccaatgaacaaaaaccactcgcaccgcaactccttttactatcaaattctgcaccgttgcaaaacttccttcactcaacgcttctttacaaacatcgcgatagcggagcggtctcttgggcgcaccccgtcgcatgttcaaccccacccacttcctgtctgacgatctccttacgtcaacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggtaagggccggaaagcggctgccaagccttggcctccgccacgcaggcgacagaggctgggaaaggagctgggcccggaatggcctgcgtctgatgcggccggcctctttttctgggctgcgaggagagcctttcccctcgcaaagtgcactgtgtatctttgcctccttgtttttaggatatcgggcctcagtacccgcccacaggaacatatttgttggggcataaaagccacgcagttagtggataggacaagaattgtattagctgtttgtaatagatcgaaattgaagcgacaagcgggtgcagtttatttgttctcctagatagggttgccatatttagcagaaattaaaaataatatccagttaaaatagaatttaagataacgaataatttttagtgtgtgtccaatgcaatatttgggacatccttacagcaaaacaacaacgaaatcactcattgaaagttcaaatttaactgtgtcctgtattttatctggcaaccctattcgaagagagttcctaaatttcagtcgttcaaataccacattcacaatttttgccctgtgcctgtgctagttgcataataatttcttaaggcttttcttagaagaacctcactttttaaacttaaaaacatgtattaaattaaaaattattttgttaaaagagtgagatccagtatcttgaataaaaagtagtcagaaagcaaaatgaaggcaaagcatttcgatttaatattaataaattctgacttgatacttttatctaccaagtcactgagcccctaaaaggggcttagcaagtgttgagtactgaagacgtagcagcaaactgagaatttctttttttattcattcaacaaatcaccttttgagccacttccatatgccagcactgttcttggcctggagaatacagctgtgaatagaacaaataaaaatctctgctctcatggaactcaagtagggagagatggacaataaacaacataaattaagcaaggtgaacaatatgttagagagtaataagtatgatggagaaaaattagggatgaagaattgagggaagtttttattttattttatttgagatggagttttgctcttgttacccaggctggagtgcaatgacacgatctcgactcactgcaacctctgcctccctggttcaagcgattctcctgcctcagcctcccgaatagctgggattaggggcacccgccaccacacccagttaatttttgttttgttagtagagacagggtttcaccatgttggccaggctggtctcaaactcctaacctcaggtgatccgcctgcctcggcctcccaaagtgctgggattataggcgttagccactgcacctggccgaagttgtcattttaaataaaataagcaaggcctcactgagaaggtgacatctgagcaaaaaactgaagatgagggagcaaatcacgtggatacctgggagaagaatcttctaggcagagtgaagagcaattggaaaggccctgaggtggaaagtgtgttcggggaataggagggaaatcgttgtgactgaagtcgagtgagcaaggatgggagggaaattagggcaaaagcccaaggggtggccagattttataggccttatcatgggtttttaatcttaccgagatgggtagccattggaaggtttgaggagtcaagtgacagttttacttagattataaaaagatcactgtggctgataacattgaaagtgaagagtgttaagtggtattgcaataattatagtattgtgaaaagtgaaagtggtgagacgtgattggattctagttatacgttaacaaaaattgagttacattttaagtaaaatttaacagtggaagtggtgagaaatgattgggttctagttatattttaagatagggccaattggatttggtgacaggttgaatgcagagtgtaaggtaaagagaggggccaatgatgactccaattattttgacttgagtacttgaaagatagactcctgattttcttttatttcctcctttccttcttcctcccctcccctcgcttcccctcctttggtgtggtcttgccctgttgccaggctagaatacagtgatgcaattgcatctcactgcagcctgcctcccaggctcaagccatcctcccaccttagcctcttgagtagctggatccacaggtgtttgccactatgcgtggctaattttgtatattttttgtagagacagggtctcactatattttccaggctggtcttgatctcctgggctcaattgatcctcctgccttggcttcccaaagtgctgggattacagaagtgagccttggttttaagcatgttaggtttttacatgcctattaatatccaagtagaggtgttgaataggtaattggatatgtaagttcagaattagggtctccccggactggagctgtaaatgtaggtggtatttaatgccagagactatgtgttgatggaaaggactgagccctgagcatgcaaatattatgaaactggggagatgggaaggaataagcagagactgagaaggaatgcctactgaggtaggagaaaaaaacaaaagagaatgatatcctggaagccaagtgaagaaggtattcagtgggagggaatgatcagctgtgttatactgtttaagtaaatgaaggtctttggtgaacttgaaaagaacagttttaggagtgttaggagtgaaagcctaattggtataggttcaaggagaatgggaggtgaggagagtgggttaagataactggaagtttttagaaagggaagtcatggggtggtagctgaaattagaagagggtgtgagtgtttaacatttttaattttctttttgtgaaaagaattagagcatgtttttaagttgacagaagtggtctagtggaaaggaggaaaattggtaaatcgggacagaggatagaattgctggagtgatttttaagcaagaaagaatggaatctattgcccagtgggaaataatttagtcttagctaggagcacaattcatccctagtaacaggcgtgatggcaaaatatatgagcaccaacttcagagggtgtggtgggaacttgggaaggtcttttggttgtgtctgttttcagagtgaagtaggaagaaaggtcatcagctaagagtgaatgtagagacagaagacatgaaatactctagtgaataagcaagagaaatgttgaattactgggtaccatttaggacccacttggagttagtggtcatgaatttaaagtgagaccagtcaccatggctgtgtgtttttctccagccaaatccgaaacattgaaaggaatgggaagggagagtcctgctatttgcctgatgatgttattatttaaatatgatgttttgtattgtactttgagaaacacacccctaaaggaagctctgtcctcaaatcccagagagagaacagggtatgtcacaaagtaagtacttaggacaggtcatcagataaggtttgaactccctctattttcctgacttttgcttcttaaccttgtcaaatttctctgcttcttccttgctttcttgtgcaacagaggcttactgagtgaggactaagagtccactctcatgctgagcacagcagtgaatgggatacagctcctgtccttcaaggagctcacaactcacaactaagtaggagaaaacagattcgacataattttcttttttttttttttttttttttttttgagacagagtcttgctctggcacccaggctacagtgcagtggtgtgatcttggctcactgcagcctccgcctcccaggttcacgccattctcctgcctcaggcctccaagtagctgggactacaggcgcccgccaccatgcccagctaatttcttgtattttttagtagagacggggtttcaccatgttagccaggatggtctcaatctcctgacctcgtgatccgccagcttcggcctcccaaagtgctgggattataggcgttagccactgtgcctggccgactcgacataattttcatactgtgtggtgagatttgtgattgggcatggaaagccagaatctctggggtaggaattcccaagaggaagaagagggaaaagtgtttcagccatagaaagcaacatgtgccaaggtggtgaagcctgaagaaacacatgcagttttttgggggtttttttgtttgtttgtttgtttttttgatggagtctcattctgtcacccaggctggagtgcagtggtgtgatctcatctcactgcaacctccgcttcccaggttcaagtgattctcctgtctcagcctcccaagtagctgagactacaggcatgtgccaccacgcctagctaacacatgcagttttaatgaaagagaagtagttggatgtgcctggagttgaagggacctgtgaaagggtggcagaacaagaggttggaagggtgggatttgccatatgtcgaagagccttgtggaccatgctagtttatcctgttggcagtgggaggctgttgaacacttgaagccagtgtgtgccatgaccagattaatttaaaaaaggaaattgtgtaggatgagaaagaaagctccataaaacaggcactttctttgtatattttgtttgctgcagtacccatagtgccttgcatccagtttgttggatgaatgaatagatgaattggaacagagttgagtctgtgcactagttttgtggctattggagtaattggagggaggaaagatgcaggcctgaatagaagaactgaaatgacagagaagtgacggtttcagagagattttggaagcgggattgacaggatgtggtggccacttggaggtgaggtaggaggaggagtagaggagggtgacactgaggttcatgaggatgggaataaaggaagaggcggtctggggaggttagagtgatatgttttgtatgaggtgcctgtgagacatagaggtgttctgagacagattggaatatgtgcctgaggtcaagagagtccggagatgggtgctgagatttcagatgtggaagttgttgactggtgggtagaggggtagttggtgaagccttggaagtaaatgcaattgcccaagaaaagggtgatgcgaagtggaatgggaggacctaatctgactctttttactttcatctcccactactcttcatcaccccacacaccctgatgactctccctagacagaattagtcactgcctcctctgtgggctgacataacattttgtacccacaactgctgcagcacttgagttctgctgagcttgtttgcacattcaccaccttccttgggctctgaccactcagtgtgctgttcatctttgtattgctgacacctaacccccgccttgacccagtgtactcagtactgaccagattcttgaatcctgtgctatgatatccatgtggaagttaggcattggtacccacacagggaatgtattaaactgctttttaaatcaagagtgatcatcttctctaatcacaggtaacatcctcaagcaaatcagaatgagagcacccattcaggaaacctgaacagggaaggtgaacccctgtcctgaccaaaattgggtatgtttagagggcttttcttgtattccttctgctctaagtcctattattctgatcctgaaggtgcagacagcggcatgtaaggaaaattgatcagtgaagtagcaactaatggcatctagcatgacttacgaagccatataagatgtgtgattgaaagtcaaaagcttggtacctagaacccctgaaaatctaaaaaataaaacacctagcctgtcttttaagactgttcatccctacagtgtattatcatcttcttgtgattatcttacgattacaagcgtaaattgaagaaaagattgctgtatgaaatctcactgtcagtgagtcatctcagcatttttaccttattttcaaagacccaaccagaaaagaggaaactcttttgcacttttcaatcaagaaacttaaacataaagcagtagagggcttccctaataacatgtttcctccagcattcaaaattagtgacttcacatcactaatatgtgtcttacttattttgagtataaatgattgggcaaagaatccttgggaaaaaatagcctatttatttcaaatactgtatagtggattctctgtgcctgtgactcacctccttccctccatcactgttctcatactcaggatgcaaaggttcagtctctgtcttcaaaagtgagctcccagtctagctggagggagtgatgagtgaacaaataattacagcgtaatcctttggtaaaccagagcaggcagtaattaactctgcctagagatgaagtggcgctggagagagttcaaggaggcttcacagagaaggtggcagtggaaagctgaatcacctggtaggcaaggcgggaggaggggatgtcagatcagtgagggtcttttgtgctgagcagatgagtttggatcataggaaggtgtgagaaaattttttgccttttttttttcgtaaacagtttttcatgaaaaaaggtcatcaaagtaaaatgtattaagttttttttaagcctgctgactgatttttattaactttgcctagaatgcctttaagcttggagcctgtatgatcctgggtactcagtcttggggttagaatataacttgagggcaagctctcagcctagatcatcatttcagttatagtacttacctctgagtagctactccataaacatttgttgattgaatgagtgagtgaatgaatgcagcatcaaatacagtatctgaaataaagacttcaattttttttggaaggactttttaaaaaagacattagacagttttatatgttctgactttgttggattttggtaaaagatttcagaattggattttttttctcatgtttttcatcttgttcaggagatgaaaatgcctagaggtgataaatataggctcctatgaaatacagctgtattagacgtaaaataatgggatctgttattttgggtattacatcatatgctatcttgctgctagattttagcattacatagctatggtaggcattgtcagtttatagaaaattttgtggggagaaaaaaacatgccttagaaaaagatgagtggtaacaacagaactctttgtcccagcttgtggaatgagaatagtggagctaatgaaaatcaacatgttgaagtaatatactcttaagaaagtaccttccacctttttttaaggttgtggcaatataacaacagagaacactggtggccagggtcctaagggaaggtttgatgctgcttgtaagttctgataccttccaaaattcataatactgagagtatattgaaagacaggccgggcgatgtggctaacccctgtcatcccagcactttgggaggctgaggcgggcagatcacctgaggtcaggagttcaagaccagcctggccaacatggcgaaaccctgtctctactaaaaatacaaaaattagtcaggtgtggtggcacgtgcttatagtcccagttactcgggaggctgagaggctggagaatcagttgaacccgggagttggaagttgcagtgagccgagatcaccccactgcactccagcctgggcaatagagcaagactctgtctcaaaaaaaaaaaaaaaaggaaagaaagataacagcagtggcccggcgcagtggctcacgcctgtaatcccaacactttgggagaccaaggcaggtggatcgcttgaactcaggagtttgagaccaacctgggcaacatggtgaaaccctgtatctgccaaaaatacaaaaattagccgggcgtggtggcacacacctgtagtggtcccagctactcaagaggctgaggcaggagaatcgcttgaacccaggaaacagaggttgcagtgagccgagattgtgccactgcactccagcctgggcaacagctagactctgtctcaaaaataaataaataaacaaacaaacaatatattggacaggtcaaacatactggacagctactcaggaggctgaggtgagaagatcacctgagcccaggaggcagaggttgctgtgagccaagatcacaccactgcactccagcctgggtgacagagagagacccccatctcaaaaggaaagatagcagctaagctgggatctaactaaattgcagtaagtctgagatagtgatatcataagagattggctgaagaagtatggctttctgtagacaggggtgttctggtcactaggaggaggcttctgaagcaatggagagcaaaacaccaccactcttaggaaccccctgtgaacatcttgaaacatttgtcaaaacaaacaaacaaacaacaccccagcaagaagggaaaaaaaaaatctatgatgatcaggtatcacagcactgagaaagttatactgtgtctggctttaataaaaccatgtaactttgaattattttttaaagtaattattccacatctgtgggtggtacctggcacagctcagttccagtggaattagtttaagaaatactgccctgtagtgaattacccaggctctccaaggctgagaaacatggatggcacagctctcaggacatttcaccaccatttactgtcattgtatgctgaagctgccttgtgattactaaactagctttccagaagccttggaatggggcatgggttacagagtaccctgagtattaggtgttattgttccagtcattggaactgtatatttcctgttacatctaatttgttggcattctagaattaatgtgtttaaattgcatgagtcaatttcttggagtcctgactgctcttagatgaactaatagtgtctgacctcagagcccttcctttccatctgcaacagttttttaaggtaattgtttttaacttttaaaaaatataagtaattctaacaattgttcaatcccagccatctaacaaatcagctacgtttatcttttcatttaattaaaatagctttttagctattaaatagcagggaccatattttagacttgttaaacaacctacaatctaaatattgaccatctgggccaaatattttaagcgagggcttactcagggcagacaggtatctgataatatacacattcaaccacttcgcacctgaccagtgtggtaggaattcagagctagagaagtcctgaagaagtggcaccttaggcttgctgggggaaaggatttagacacaggcctggaagagcaggggagggcatttattcattggagtgtgggaagagcagggatcgaacagatgtgaagaagcacacacaagttaggtggaggtggggactgagagatgagcgtgactgtacaaatccacagattcatgctgtttgttcttatcctgcctattcagagaggagttggggtggcatgtagtaaatgtcatctattaaatgtgtgggttcttatgctgagacatcagcaccccaatcagtaaccataagtggaaggatgccccccttctttcccttgagaaagattacttctgatagaggagattgaggtccagatacagtcttaagatttattttttatttttcacaaatgtaggtttcagagggaactgaaattagtaatatattgtgtattttattcattcagctaggtcattaggttgtaatttgttttctaccctggaggagccccatcctctagctggagaaacacaatgacaattgcagtgatggagtctcacccagaataccaaccatgcagaaaggaggactagctaatccagcttagaggtgtcaggatctggaaaggcttcacacaggaggttcatctaaacagaaccttgaggattgagtaagagttggtcaggtgaggagaggaggcgcttcaggaaatgggaaagcatatgcaaagtcatatttgcaagagaacatggcatgattggagtttggtcctgcaggagggtaggctacctaaaggaaagccaaggccagagaggcatacacagggatcagatcttcttgtgtcttgcagaccatgttaaagagtttggagtttgtcatgaagcttgttcaggtcttagctcagatgtcactaacttcccattgcacttagaatagaattcagacctcttaccatggccacaaggccctatgtgatctggccccggactgcccatgtggccacacccatcttgagccactcctccattgcttgcccttgctatagccagttagccgatagagagctgtcaaaagattgtaagcagtgttatttcatattcagtctggccacagtatggagcatggattgaagagagcaaggccagcatcagaaaggcaagagatgataagaggctggtcttgagcatggaggtgggaatggagagaaaaggacaaatatgaaaaatgtagaagcaaatgcagaaggatttggtggccactgaggtttggcagaggagggacttctgtcagtgagtggatggtgtgttcataccctgaggtctgggatacaggaggaagctcaatttggtgggaaagatgattagttcatttaggaaatatgttgactttgaggtgtttgtggaatgtcccaagtggagatgtctggagagttcttgaatagtctctggagctcatggaggtatgggccaaacattggtataaatgggaaaagataacttgaatgttgtggtactaggttgatttcatctccaaaatatttctcgaaacaaccactacttttcactcctctgccatcacctcggggcaagctgctatatcttttaactagtctgcctgcttctgcttcagcccattcttacacagctagtggagtgatcttctaaaaatgagaaggagtcttataattttcctacttaaaaccaatcttcactaacttcccattgcccttagaatagaattcagtcttcttaccataactacaaagccctgtatgacctggccctggactccctgtctggccacacccatgttgagccacttctccatcacttgctcatgctgtagccatactgtatggcttcttctagggcctcaaacttctgtattgttgtgtgtcaagttctttctctctttcaggtctttgcatatgctactccctttgcatgaattgtcatcttttaggtcttacctcagatgtcattttttcaagggagtctcctctgacctcctgggctatattagtgccatcctgcattttttcctagcacctaacacaatatgttagtagttaattgtgcgtttgtatcacccatacaagctctgtgacgacaaaatccattctgtgttttgtttaccattgtacccacagttcctgacagtcctgagctcatagtcagcactccatgaatattttttagatttgttgaatgaatgagattataatcatttttattttttgtcttgaaaaacttagaaattttacactgtcacagtacaaatagaatggtgactcaagtgatagaacttatggagctgatttcatctacttttacattttcaactgttattaaatgctctgcctctggaaggttgagacatggaaattgcaaattaaatcttaaaaggaatttttcctccctattggctgtattcattatggtagttctggttagcatgaattgatctgttatcagtctgacaatggtacggctgctgagtttgaaattcagaaaactaatacttgttcccttgagtttgggcgtttgtggcagagtttagtagcagccttctccttcagccctgatttgggaagcatcccaatacatgctatttgcattgcagctgtgggaaagtccacgtttgtgaagttactcacgaaaacttacccagaatggcacgtagctacagaacctgtagcaacatggcagaatatccaggctgctggcacccaaaaagtaagtttttagttgtggtgggtagttggcaggcatgggtgaataatctaattgtcataatttaatttactctcagtgagtaaagtagcccagtttgagtatcctttttaaaatagcttcattccagaaagcagaccacatacaccagagaggatatgacttgtttgaatatgtgcagttttgatttttgtggtttttatatgtctatctaagtgactgcctctgttgtttgtggtttcccaaagcatgtccaaccatcatggatggctttgaagatgaattttgtcattcctacacttaagtatttatattattacttaagctaaccactaggattaatagctaattatagtgattttaactttttaaataaagtcttagaaattagaagggatattagagaggttccagtcacactttgagtcaatgggagaggttacagctaacatttatgagcatgtactatgtgccaggcactgtactatgccaagcacagtacatttcacttacacctcatggcttaggccctggtgtcaagactatggctttggcagaggccatagagttggtttccagccacatcagtctgagtaaggaaagacttgtttcgacatgacccttagagggagcagaagcaccatgcctcctcaggcaccatgaactgctcctgccgccacctgggatattcactgagtggcacattctggttcttaactctaattactaaacagttctgccttttaatgagccatgttgcacccctgtgactctgactcattggttcaagttctacctcttaagtcttttaacttttcgccgtaacaaccctatatatagttgaaggtaatgattttcctgttctttctccccctcaagtctctctccttttttttttttttttgacagtctcattctgtcacccaggctggggtgcaatggtgtgatctcggcccactgtaacctccaactcctgggttcaagtgattctcatgcctcagcctcctgagtagctgggactatgggtgcatgccaccatgctgggatactttttgtatctttagtagagacagggtttcgccatgttggccaggctggtctcaaactcctgggctcaagtgatccacccaccttggcctccaaagtgctgggattataggcatgagccaccatgcctggtcaagtcttctctctttgaagccaaacacctccagttttcctccaggctattctttactctgaagtaactttacctaagtgatgagtcctagtttgttcactttccactttgaatttactaagagtgctacttggaggtgaacaggacattctggatgtagtctaagtgggacagagtatcatggaacttgttctgggtgccatttttttttattccaacccagaattgtgttaccttttgtggctggcatatcatgcctattgaggatttttgctgcttaagttgtctctttatatgtctgtatgtgtgcctgtgtgtgtatttgtgaaattaactttcctatgcaggaataaattacatatctttttctgagtatgccacaggtcacctgtgtgtatttcaaaatacagtcatgggctgcataatgatgtttctgtcaatgatagaccttgtatacaatggtggccccataagattataacaacatatttttactgtaccttttctatgtttagatacacaaatacttaccattgtgttacagttgcctacagtattcaatacagtagcatgcgatacagctttgtagcctaggagcaatagggtgtgtcatatagcataggtgtgtagcaggctatcccatctaggtttgtgtgagtacattttctgatggtcacacagtgacaaaattgtctaatgacacatttctcagaacatattcctgttgttaagtggtacatgattgcatgtccacaattgtttgatattcctcccttctagaagtagagcgtaattcttgccttgaatgcagctggactttgtgatttgtttctagtaaatagaaagtagcaaaaataagaaatacctttctagggtaggacataagagacactgtagcttccatcttgttctgggggaagccagctgccatgtcaggaagcagccttttcaagggggccacacggaaggaactgaggcctcctgtgaacaggtacgtgagtctttttggaattggatctttcagccacagtccagccttcatacaactgtagcctcagccaacatcttgactgaaacttcatgagaaaccctgaggcccagccacccagctaagctccttcccaaattccttccccatagaaactgagataatgaatgtttttgtttaagccactgaattctggcataatttgttaggcagcaatagataactaatcatcctgtaatcccattattcagaagtaaaatggacatttttctacagagaaaatgtatagatttacatatacttacataaatgtataaaatatatatacatttgctttttgaaacaaaaattttgattgccacctgtatgtcacttaatagacaagatctccctttcacagtgatatcattttaatggttgtagtgtactgcataatatgaatattatcatttagttatccagtcctctattttgaatgtttagttttctaatttcttcctattataagcagtgttgcaatgatgaatatcattgtagctatactgcttgttttttaatataaagccatgttttgtgtatctttttgttctttagtgaattgcctgtccaaaccccttgccttgtttttttctattgagatcttcatctttgtgtaatggcttcataaaaactcattgtatgttaagtatattaactctgtcatatgtttgtttgtcattttcttttctttttttttttgaaacggggtctcgccttgtcgcccaggctggagtccagtggtgtgatcttggctcagtgcaacctctgccttccgagttcaagcagttctccctgcctcagcctcctgagtagctgggattacaggtgcctgccaccacacccagctaattattgaatatttagtagagatggggtttcaccatgttggccaggctggtctggaactcctgacctcaggtaatccacctgaattggcctcccaaagtgctgagattacaggcgtgagccactgcgcccgaccatgtcatttttcttttatcttggtatataatatatttttacaatataatacatttcagtttttatgtagtctaacctgtccttctttttcctcatagttagcacctttgatgttaaaattgtagcccaggagtataaaaataatctatttctttttgttgcttttatggttttatgttttatgtggctttacaagttataagactttagttttttcacaaatggttatctacttatccagtagtattcttgtttattcctgagcagaatatatattttgtttttattgtgactgagatcttttttccacatcatcttctgaaactggttattgctgttttaatggaaaacagttgattgttatatttatcttatatgatttaatttctcatttttttatttgcttgaagttttggaaaataatagttgtctctaaatagtaatcatttgaaagagttttctaatatctgtgccacatttctattttcttgttttctttcattgggtagaacttccagagcaatataaactaatagcagtgagggtagtttccttatcttgttctgtcattaatgaaactgcctctaatatatcagtgttaagtttaatgtttattattcatttcagtagaccgtgtggtacacgtacccttttgttactagaatagtaactgtttttatcatgatcaaatgttgaatttccatcaaaaaccactttagcatctagtgagataaacaaggggtttttctttttaatctcttagtattagtcatagatttaataatggtaccatcctcacatttctagaatgaacttttttttggtcatgatgtactattccattaatttggtaatgtgttgtttggaattttgcatgtatatttatttatacagttggttggtattattatttgtgtgtatggtgatttttgtttgttttgacttgtgggttctttttaggcagggtcttcctctgtcacccaggctggagtgtagtggcatgatcatagctcactgcagccttgaagtcctggactcaggtatcttcccacctcagtctcttggtgagttgggactataggtgcataccactgtccccatctacttaaaaaaaatttttttttttttttgtagagatagggtctcactttgctgcccaggctggtctcgaactcctgggctcaagcgacccttccacctcggactcccaaggtgttgggaccacagatgtgagctgtgatgcctggcccatgtgtagtttgtgacaggttttaccatcaatgttatgaaaataaatggagaaattttgcatcttttctagcatagaaatgatctattccttgaaggtatgatagaaatcatctttaagattatatggattcagtactgtttgaggggaatcattattggacaactgttttctgcctcagttattcaggtttttttttttttttaagatggagttttgctcctgttgcccaggccagagtgcaatggcacgatctcagctcattgtaacctccgcctcccaggttcaagcgattctcctgcctcagcctcccaagtagttgggattacaggcataccaccatgcccggctaattttgtatttttagtagagacaggctttcaccatgttggccagactggtctcgaattcctaacctcaggcgattcacccactttggcctcccaaagtgccgggattacaggcatgagccaccatgtccagcccctagggagaatttcttaagctgatactcttttctttttctttaaagagtctcactctgtcacccaggctggaatgcagtggccctattatagctcactgcagcattgcttctcagccttttggctaagatcaagtgtatagctcactgtagcactgaactcctgggttcaagcaaatcctcccacctcagccaccagagtagctgggactacaggcatgcaccactatgcccaggtaacttttaaatttttttgtggagacagagtctcactatgttgcccaagttagtcttgaactcttggcctcaagcaatcctcctgccttggcctcccaaagtgcttgggttataggtgtgagcccccatacctagcccttaaactgatactctgtaaggatcttctaattcactaattaggtttactgcattatacagtctgctagctaccatcttcattatcttcattgggtgttttacttgggcaattgcatttttcacctctaagaaagttattttcttattgttccttttttatgatagcttattcttgttttatcagcaaggccgtatcttttgttttctcctgtttctgacaacagccctgtctgagcacagagactagtcctctccttttgaattgctaagtaattttgtgtccaattattgttcatctgtttgcttatatttttggaaggatgtttgcatttgttctgtagctgagatgggttctttcagaaattgtgttggtttcttttacatttttggttccagaagagtctctctttgatagcccaaagcccactggtgcaatagaacccaccagtcaacctattgcatctgccagcacagcactccgctccacatacagtgtgtgaattgtgcaacaggcccagggctgctcccaaccatctctagtgacaccacagagactacaggagacacaaatttgtcctcctacttctacctccagctcttagtcaggggccacgtgtgaggctggtatgtgtgggcttgcggggtcagaaggagggaaatcccgaaaatacctctgagttaaatgtttttctggtccactctgctctatatgtgttgtttctgctgaagcctttcaaagggctaagacccttctttggaatctaatagtgctattttgccaaattggacttcttactgttgttgaatcttttttctccttctgtcctgttgtctctacctgaagtacaatcttcttaatctccatttccatctgtgagaattctactcatcagttacttcccagcttaatgccactttctttcagaaactccctgagattccttccaccatcagtaatcgtcccttcatcacatgttctgccttacattccagcttcgtacatcctcatcaccctcttcctttttgcactgtgagctctttgagttcaggaactgtcttgttcacctttagatggagggtgttggaatgatgaggttagaggaagccaggtttgagtcccttcaacatttactcgccatgaaaccttgcacaagtaagttacttaacctctgagtggattttcccctctggaaaatgggcattacaacagtacctacctcatgaagctgttttgaagattaattgaggtaacataccacagtaaaggttgaaataaatgttaattcctttttctatacccttacggtaccctgcccatgtagcgcctcatccacacaggccttcagtgattggtgattgaataaaaaatacagatccaaagtgcttttgtacaaaattcacttttgcattgttgagtcaatggcagatccagaaaagaatctgaggctgggcgtggtggctcacgcctgtaattccagcactttgggaggacaggagttcgagaccagcctggccaacatggtgaaaccctgtctctactaaaaatacaaaaattagcttgtcgtggtggcgggtgcctgtgatcccagccactcaggaggctgaggcaggagaatcacttgaactcggctggggtggggaggagggcggaggttgcagtgagccgggaggttgcagtgagctgagatcgtgccactgcactccagcctgggtggcagagtgagactctgtctcaaaaaaaaaaaaaaaaaagaatccggggctgctgaacatcccacacttgtgcccacttgcacatgccgagtaagtggaacgttttaattatgtttcataaagtctctagaattaagtagggttttgttttaacaaacaaattgtactccttatatgaaagataaaattctatttggtggttgattggttggattttcaaataagcagttgctttctggtttgccttgacattttataaacataactacagatggaagctcaaaagagaggcaacatagtgttatagtggaaagatttgattcagagttaaattttagatggttgttgactgttaactcctccccagacagacttcacaaatccctcaatcagtgatcgtgttaattctatatatggttcttcctctgcttttgttatattgaagtggcatgtcatctccctttagagagtcttatttaataggtaggaaaatctcatccctgattatgaaattttgactaagctggggatctgattctacctttttggtggaaggaaacttttgtaatttcttctttcattgattattaaacctgtttggggaggtaggggtgtgtgtggaggggtgtaccccatggagtaaatatgctttctaggaaattttcttctttttttcatctccctctaggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtaaaatgccaagccctccaccagtcacaagccccatgctcagtgctgcctgtttgatcttgcacagatcctgcactgctatggtcactgatgattataatttgaaaaattatcttcttttttaaagacaacactatacagatttgtccagagttgtacttctaccagattgtcatctatgtcaagaaaggaaattgggtttttcatcaactgaatgctttgaatttcttacattgctactgattaccttatgtttccttattttctggcatggagcaagctggtagccacctaatgtaaccatcacatgctaaaaggcacataatagacacttaagtagcagtgtatattctaagaaatcagatgattcagtggttgattatcccctttaagaaaaaagcagacgaaattaaaatttgtgttcctgaaaatgatataagagatattttcagccttttttttttattcttcaagaaaggatgcttaggcagaaatagcacatctgagaaactggcttctgtctcagatttagccctttttgaccccttcttctgtgagagggctttttgctggccagagtctagtggacatcagtgcctgtgtcagatcagggatgggcatcatcctgaccacctgagggagtgagatgtgaagtcactttgaatgcaagctagcagcaccctgggaagtgagcccatctgctccagaagagctaggccgtgcaggctccggaatgcctggctctgctgcagagaccaggctgtgacttgaggttaagccgcctagagacaaagtcaggatggcttgatctggacactgctggagtttttcttatctgaagcctatgaatgaccagtgtcagtgtgaaatggtgctttcaagcaaaacgatctttcttaaggctctttgaattatcaaaatgggaagtggtacattttcattgtcactgctgaagacactcagttggttactcttttaattccaaattagacaaactagttctatttcttagtgcttccggaaagcctcctagaagaaaaaaaataaggatacatttgtaaatgacaagtgatttttctgactttaccctaaaatcatgtaagatatgtaaaacaaaccctataggctatccgttccttgtttacgtaccccgagagagcctactttttataaaagctaaatatgtgaattacaaatggctgggctataggttttacttctttttcagctgttggatatcccacctgcctgttttcctctcttctctcccaagccatgcctctcggactcagaagttgaattacatataaccacatgggttgtttggaaacatagtcagtctttatttctagccgcttcatgaagtaggtgtgtgagaccctcagaggaaaatagagaagtagaaacactttgttaattagaaatgcattaagaagctgcatggatcttaacctttgcttgtaaaggaagaggtaataattgattacactgtgggcatacaacattccaggtgctatcttcagtgagggcattttcgagacagaaaggaaaactaatcacaagttctaatcccgagggtaatttagactttgttcacttgcacagatttattggatgcctcctgtgttgaagcaccaaggctggccctggggctgcagcagtgaataaggcagacccagtccccgcctaacagggactgaacacatgctcacgtgtgtgatatttgttccaaaggaggaacacaggttatctgggagagttgattatagcgaggaagaaatcttagtcttttctgtttgagttaaaggaaacattagcatatggttttagagcagaggccctgactcctagatccttatgccctgttctgtcctgcagcccctgcattcagtctgcagtacttccctcccactcagcaccacacccttctgcccctcaccccatcaccaccacaagctttgaagaaataaaggaagtgctctttctcaagaaagccaagaac

SEQ ID NO: 14190 - DNA, 36028 bp, Human
  misc_feature (1)...(36028): n = A,T,C or G
tcaccataaaatttttaaaaataatttttaggagctctgttactggtggagggtgcccaggttcttgacattttgaacaaagaattggacaaaacgtacaaagcaaggaaacaatgaagcaacaaaagcacagatttattgtacatcaaagaacactccttccggtaggaagggcccaagcaagcagcaattacagaattttctggggtttaaataccttctagaggtttcccattggttacctggtgtacaccctatgtaaatgaagtagtggccagcgatcagtctgattggttgcaggaggggaccaatcagaggctgaagtaaagttatgaagttataccccatgcaactaaagacttggcctgccaccagcctgactgattgcccgcggggaccagtcagaggtactttcaattttttatctgccacccagaagagggattagcttctggtccttttgttacttgggctagaaagttggggttttccttttgatttagttctaggaagtcagcctaaatcggccttaggttccctgtctccagaccctattttcctgcctcgtagcttttaggagattaatgcctgcctgcagacaacttcctcatttaactttcacaacacccctgaggcagcaagatcctggcgaggcagagagcctctcaagcttttttggatgaatattttccaagtctgagtttacataggtaaagaaatgtaagcagtttttttttgttttttttttttgttttgttttgttttgttttaacagaagtggctgctggagtggagatgggaatgggtaggactttagccgctccagtagccattaacgccccaccctggttatccttaaaaaattcgattaaaaaaaaagttcttaatatataaacatgacctcagccatcctatatatacatcaacataagaaaaaggtcccgtgctttttatgggaacagcttcaagacaggtatcccagcccccggcccctccccagcccccttgcaatcagatccttgtcttctaaaacctgccacacctaagagcgctgcctgaaggccggtttggcctgttgactcctggttttgactgttggtgatttaagcgattggaactggaagcaccatttgacaacattttgtaaatcattacttctgaggttgttatgacgacggggtgtggcagtccggcttcacctgtggcagcagcttaggtccctgccctcctgcagagcacacttcaccgacagcaggactcaggttttatacaagtctctactcgccattgcttacgtccaagaacccaacctaccaggtttaaacaatttccagtcacatacctgagccaccaccaccttatcctgaagggatttttgggtataatgcaaatcgattgaccgaacatttatttacttattcaagacacaaactaagagatggggtgtaactgattatctaatttgttaatttagtcaataatatgccagcattgtgcaggggaattacagggaataggaaaaagttaaatttgtgtaaatcatcagattgagtcattttcctactttaaaacttccattttcttccgatattaaaataaaaaccagacaacaagcacctgggggggggaaatcccctcttaaaattacaatttctatttttaattttgtcttcagttataaaatttattttaaagttatacaaaaatgaagtggttggattgtggaattacgtcttttaaaatgttatttgtccaatgaacaaaaaccactcgcaccgcaactccttttactatcaaattctgcaccgttgcaaaacttccttcactcaacgcttctttacaaacatcgcgatagcggagcggtctcttgggcgcaccccgtcgcatgttcaaccccacccacttcctgtctgacgatctccttacgtcaacggtgcgctggagcgagtgagcagcgatacctagggcggaagtgctctcggcggaagtgatcgctgtgtgaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggtaagggccggaaagcggctgccaagccttggcctccgccacgcaggcgacagaggctgggaaaggagctgggcccggaatggcctgcgtctgatgcggccggcctctttttctgggctgcgaggagagcctttcccctcgcaaagtgcactgtgtatctttgcctccttgtttttaggatatcgggcctcagtacccgcccacaggaacatatttgttggggcataaaagccacgcagttagtggataggacaagaattgtattagctgtttgtaatagatcgaaattgaagcgacaagcgggtgcagtttatttgttctcctagatagggttgccatatttagcagaaattaaaaataatatccagttaaaatagaatttaagataacgaataatttttagtgtgtgtccaatgcaatatttgggacatccttacagcaaaacaacaacgaaatcactcattgaaagttcaaatttaactgtgtcctgtattttatctggcaaccctattcgaagagagttcctaaatttcagtcgttcaaataccacattcacaatttttgccctgtgcctgtgctagttgcataataatttcttaaggcttttcttagaagaacctcactttttaaacttaaaaacatgtattaaattaaaaattattttgttaaaagagtgagatccagtatcttgaataaaaagtagtcagaaagcaaaatgaaggcaaagcatttcgatttaatattaataaattctgacttgatacttttatctaccaagtcactgagcccctaaaaggggcttagcaagtgttgagtactgaagacgtagcagcaaactgagaatttctttttttattcattcaacaaatcaccttttgagccacttccatatgccagcactgttcttggcctggagaatacagctgtgaatagaacaaataaaaatctctgctctcatggaactcaagtagggagagatggacaataaacaacataaattaagcaaggtgaacaatatgttagagagtaataagtatgatggagaaaaattagggatgaagaattgagggaagtttttattttattttatttgagatggagttttgctcttgttacccaggctggagtgcaatgacacgatctcgactcactgcaacctctgcctccctggttcaagcgattctcctgcctcagcctcccgaatagctgggattaggggcacccgccaccacacccagttaatttttgttttgttagtagagacagggtttcaccatgttggccaggctggtctcaaactcctaacctcaggtgatccgcctgcctcggcctcccaaagtgctgggattataggcgttagccactgcacctggccgaagttgtcattttaaataaaataagcaaggcctcactgagaaggtgacatctgagcaaaaaactgaagatgagggagcaaatcacgtggatacctgggagaagaatcttctaggcagagtgaagagcaattggaaaggccctgaggtggaaagtgtgttcggggaataggagggaaatcgttgtgactgaagtcgagtgagcaaggatgggagggaaattagggcaaaagcccaaggggtggccagattttataggccttatcatgggtttttaatcttaccgagatgggtagccattggaaggtttgaggagtcaagtgacagttttacttagattataaaaagatcactgtggctgataacattgaaagtgaagagtgttaagtggtattgcaataattatagtattgtgaaaagtgaaagtggtgagacgtgattggattctagttatacgttaacaaaaattgagttacattttaagtaaaatttaacagtggaagtggtgagaaatgattgggttctagttatattttaagatagggccaattggatttggtgacaggttgaatgcagagtgtaaggtaaagagaggggccaatgatgactccaattattttgacttgagtacttgaaagatagactcctgattttcttttatttcctcctttccttcttcctcccctcccctcgcttcccctcctttggtgtggtcttgccctgttgccaggctagaatacagtgatgcaattgcatctcactgcagcctgcctcccaggctcaagccatcctcccaccttagcctcttgagtagctggatccacaggtgtttgccactatgcgtggctaattttgtatattttttgtagagacagggtctcactatattttccaggctggtcttgatctcctgggctcaattgatcctcctgccttggcttcccaaagtgctgggattacagaagtgagccttggttttaagcatgttaggtttttacatgcctattaatatccaagtagaggtgttgaataggtaattggatatgtaagttcagaattagggtctccccggactggagctgtaaatgtaggtggtatttaatgccagagactatgtgttgatggaaaggactgagccctgagcatgcaaatattatgaaactggggagatgggaaggaataagcagagactgagaaggaatgcctactgaggtaggagaaaaaaacaaaagagaatgatatcctggaagccaagtgaagaaggtattcagtgggagggaatgatcagctgtgttatactgtttaagtaaatgaaggtctttggtgaacttgaaaagaacagttttaggagtgttaggagtgaaagcctaattggtataggttcaaggagaatgggaggtgaggagagtgggttaagataactggaagtttttagaaagggaagtcatggggtggtagctgaaattagaagagggtgtgagtgtttaacatttttaattttctttttgtgaaaagaattagagcatgtttttaagttgacagaagtggtctagtggaaaggaggaaaattggtaaatcgggacagaggatagaattgctggagtgatttttaagcaagaaagaatggaatctattgcccagtgggaaataatttagtcttagctaggagcacaattcatccctagtaacaggcgtgatggcaaaatatatgagcaccaacttcagagggtgtggtgggaacttgggaaggtcttttggttgtgtctgttttcagagtgaagtaggaagaaaggtcatcagctaagagtgaatgtagagacagaagacatgaaatactctagtgaataagcaagagaaatgttgaattactgggtaccatttaggacccacttggagttagtggtcatgaatttaaagtgagaccagtcaccatggctgtgtgtttttctccagccaaatccgaaacattgaaaggaatgggaagggagagtcctgctatttgcctgatgatgttattatttaaatatgatgttttgtattgtactttgagaaacacacccctaaaggaagctctgtcctcaaatcccagagagagaacagggtatgtcacaaagtaagtacttaggacaggtcatcagataaggtttgaactccctctattttcctgacttttgcttcttaaccttgtcaaatttctctgcttcttccttgctttcttgtgcaacagaggcttactgagtgaggactaagagtccactctcatgctgagcacagcagtgaatgggatacagctcctgtccttcaaggagctcacaactcacaactaagtaggagaaaacagattcgacataattttcttttttttttttttttttttttttttgagacagagtcttgctctggcacccaggctacagtgcagtggtgtgatcttggctcactgcagcctccgcctcccaggttcacgccattctcctgcctcaggcctccaagtagctgggactacaggcgcccgccaccatgcccagctaatttcttgtattttttagtagagacggggtttcaccatgttagccaggatggtctcaatctcctgacctcgtgatccgccagcttcggcctcccaaagtgctgggattataggcgttagccactgtgcctggccgactcgacataattttcatactgtgtggtgagatttgtgattgggcatggaaagccagaatctctggggtaggaattcccaagaggaagaagagggaaaagtgtttcagccatagaaagcaacatgtgccaaggtggtgaagcctgaagaaacacatgcagttttttgggggtttttttgtttgtttgtttgtttttttgatggagtctcattctgtcacccaggctggagtgcagtggtgtgatctcatctcactgcaacctccgcttcccaggttcaagtgattctcctgtctcagcctcccaagtagctgagactacaggcatgtgccaccacgcctagctaacacatgcagttttaatgaaagagaagtagttggatgtgcctggagttgaagggacctgtgaaagggtggcagaacaagaggttggaagggtgggatttgccatatgtcgaagagccttgtggaccatgctagtttatcctgttggcagtgggaggctgttgaacacttgaagccagtgtgtgccatgaccagattaatttaaaaaaggaaattgtgtaggatgagaaagaaagctccataaaacaggcactttctttgtatattttgtttgctgcagtacccatagtgccttgcatccagtttgttggatgaatgaatagatgaattggaacagagttgagtctgtgcactagttttgtggctattggagtaattggagggaggaaagatgcaggcctgaatagaagaactgaaatgacagagaagtgacggtttcagagagattttggaagcgggattgacaggatgtggtggccacttggaggtgaggtaggaggaggagtagaggagggtgacactgaggttcatgaggatgggaataaaggaagaggcggtctggggaggttagagtgatatgttttgtatgaggtgcctgtgagacatagaggtgttctgagacagattggaatatgtgcctgaggtcaagagagtccggagatgggtgctgagatttcagatgtggaagttgttgactggtgggtagaggggtagttggtgaagccttggaagtaaatgcaattgcccaagaaaagggtgatgcgaagtggaatgggaggacctaatctgactctttttactttcatctcccactactcttcatcaccccacacaccctgatgactctccctagacagaattagtcactgcctcctctgtgggctgacataacattttgtacccacaactgctgcagcacttgagttctgctgagcttgtttgcacattcaccaccttccttgggctctgaccactcagtgtgctgttcatctttgtattgctgacacctaacccccgccttgacccagtgtactcagtactgaccagattcttgaatcctgtgctatgatatccatgtggaagttaggcattggtacccacacagggaatgtattaaactgctttttaaatcaagagtgatcatcttctctaatcacaggtaacatcctcaagcaaatcagaatgagagcacccattcaggaaacctgaacagggaaggtgaacccctgtcctgaccaaaattgggtatgtttagagggcttttcttgtattccttctgctctaagtcctattattctgatcctgaaggtgcagacagcggcatgtaaggaaaattgatcagtgaagtagcaactaatggcatctagcatgacttacgaagccatataagatgtgtgattgaaagtcaaaagcttggtacctagaacccctgaaaatctaaaaaataaaacacctagcctgtcttttaagactgttcatccctacagtgtattatcatcttcttgtgattatcttacgattacaagcgtaaattgaagaaaagattgctgtatgaaatctcactgtcagtgagtcatctcagcatttttaccttattttcaaagacccaaccagaaaagaggaaactcttttgcacttttcaatcaagaaacttaaacataaagcagtagagggcttccctaataacatgtttcctccagcattcaaaattagtgacttcacatcactaatatgtgtcttacttattttgagtataaatgattgggcaaagaatccttgggaaaaaatagcctatttatttcaaatactgtatagtggattctctgtgcctgtgactcacctccttccctccatcactgttctcatactcaggatgcaaaggttcagtctctgtcttcaaaagtgagctcccagtctagctggagggagtgatgagtgaacaaataattacagcgtaatcctttggtaaaccagagcaggcagtaattaactctgcctagagatgaagtggcgctggagagagttcaaggaggcttcacagagaaggtggcagtggaaagctgaatcacctggtaggcaaggcgggaggaggggatgtcagatcagtgagggtcttttgtgctgagcagatgagtttggatcataggaaggtgtgagaaaattttttgccttttttttttcgtaaacagtttttcatgaaaaaaggtcatcaaagtaaaatgtattaagttttttttaagcctgctgactgatttttattaactttgcctagaatgcctttaagcttggagcctgtatgatcctgggtactcagtcttggggttagaatataacttgagggcaagctctcagcctagatcatcatttcagttatagtacttacctctgagtagctactccataaacatttgttgattgaatgagtgagtgaatgaatgcagcatcaaatacagtatctgaaataaagacttcaattttttttggaaggactttttaaaaaagacattagacagttttatatgttctgactttgttggattttggtaaaagatttcagaattggattttttttctcatgtttttcatcttgttcaggagatgaaaatgcctagaggtgataaatataggctcctatgaaatacagctgtattagacgtaaaataatgggatctgttattttgggtattacatcatatgctatcttgctgctagattttagcattacatagctatggtaggcattgtcagtttatagaaaattttgtggggagaaaaaaacatgccttagaaaaagatgagtggtaacaacagaactctttgtcccagcttgtggaatgagaatagtggagctaatgaaaatcaacatgttgaagtaatatactcttaagaaagtaccttccacctttttttaaggttgtggcaatataacaacagagaacactggtggccagggtcctaagggaaggtttgatgctgcttgtaagttctgataccttccaaaattcataatactgagagtatattgaaagacaggccgggcgatgtggctaacccctgtcatcccagcactttgggaggctgaggcgggcagatcacctgaggtcaggagttcaagaccagcctggccaacatggcgaaaccctgtctctactaaaaatacaaaaattagtcaggtgtggtggcacgtgcttatagtcccagttactcgggaggctgagaggctggagaatcagttgaacccgggagttggaagttgcagtgagccgagatcaccccactgcactccagcctgggcaatagagcaagactctgtctcaaaaaaaaaaaaaaaaggaaagaaagataacagcagtggcccggcgcagtggctcacgcctgtaatcccaacactttgggagaccaaggcaggtggatcgcttgaactcaggagtttgagaccaacctgggcaacatggtgaaaccctgtatctgccaaaaatacaaaaattagccgggcgtggtggcacacacctgtagtggtcccagctactcaagaggctgaggcaggagaatcgcttgaacccaggaaacagaggttgcagtgagccgagattgtgccactgcactccagcctgggcaacagctagactctgtctcaaaaataaataaataaacaaacaaacaatatattggacaggtcaaacatactggacagctactcaggaggctgaggtgagaagatcacctgagcccaggaggcagaggttgctgtgagccaagatcacaccactgcactccagcctgggtgacagagagagacccccatctcaaaaggaaagatagcagctaagctgggatctaactaaattgcagtaagtctgagatagtgatatcataagagattggctgaagaagtatggctttctgtagacaggggtgttctggtcactaggaggaggcttctgaagcaatggagagcaaaacaccaccactcttaggaaccccctgtgaacatcttgaaacatttgtcaaaacaaacaaacaaacaacaccccagcaagaagggaaaaaaaaaatctatgatgatcaggtatcacagcactgagaaagttatactgtgtctggctttaataaaaccatgtaactttgaattattttttaaagtaattattccacatctgtgggtggtacctggcacagctcagttccagtggaattagtttaagaaatactgccctgtagtgaattacccaggctctccaaggctgagaaacatggatggcacagctctcaggacatttcaccaccatttactgtcattgtatgctgaagctgccttgtgattactaaactagctttccagaagccttggaatggggcatgggttacagagtaccctgagtattaggtgttattgttccagtcattggaactgtatatttcctgttacatctaatttgttggcattctagaattaatgtgtttaaattgcatgagtcaatttcttggagtcctgactgctcttagatgaactaatagtgtctgacctcagagcccttcctttccatctgcaacagttttttaaggtaattgtttttaacttttaaaaaatataagtaattctaacaattgttcaatcccagccatctaacaaatcagctacgtttatcttttcatttaattaaaatagctttttagctattaaatagcagggaccatattttagacttgttaaacaacctacaatctaaatattgaccatctgggccaaatattttaagcgagggcttactcagggcagacaggtatctgataatatacacattcaaccacttcgcacctgaccagtgtggtaggaattcagagctagagaagtcctgaagaagtggcaccttaggcttgctgggggaaaggatttagacacaggcctggaagagcaggggagggcatttattcattggagtgtgggaagagcagggatcgaacagatgtgaagaagcacacacaagttaggtggaggtggggactgagagatgagcgtgactgtacaaatccacagattcatgctgtttgttcttatcctgcctattcagagaggagttggggtggcatgtagtaaatgtcatctattaaatgtgtgggttcttatgctgagacatcagcaccccaatcagtaaccataagtggaaggatgccccccttctttcccttgagaaagattacttctgatagaggagattgaggtccagatacagtcttaagatttattttttatttttcacaaatgtaggtttcagagggaactgaaattagtaatatattgtgtattttattcattcagctaggtcattaggttgtaatttgttttctaccctggaggagccccatcctctagctggagaaacacaatgacaattgcagtgatggagtctcacccagaataccaaccatgcagaaaggaggactagctaatccagcttagaggtgtcaggatctggaaaggcttcacacaggaggttcatctaaacagaaccttgaggattgagtaagagttggtcaggtgaggagaggaggcgcttcaggaaatgggaaagcatatgcaaagtcatatttgcaagagaacatggcatgattggagtttggtcctgcaggagggtaggctacctaaaggaaagccaaggccagagaggcatacacagggatcagatcttcttgtgtcttgcagaccatgttaaagagtttggagtttgtcatgaagcttgttcaggtcttagctcagatgtcactaacttcccattgcacttagaatagaattcagacctcttaccatggccacaaggccctatgtgatctggccccggactgcccatgtggccacacccatcttgagccactcctccattgcttgcccttgctatagccagttagccgatagagagctgtcaaaagattgtaagcagtgttatttcatattcagtctggccacagtatggagcatggattgaagagagcaaggccagcatcagaaaggcaagagatgataagaggctggtcttgagcatggaggtgggaatggagagaaaaggacaaatatgaaaaatgtagaagcaaatgcagaaggatttggtggccactgaggtttggcagaggagggacttctgtcagtgagtggatggtgtgttcataccctgaggtctgggatacaggaggaagctcaatttggtgggaaagatgattagttcatttaggaaatatgttgactttgaggtgtttgtggaatgtcccaagtggagatgtctggagagttcttgaatagtctctggagctcatggaggtatgggccaaacattggtataaatgggaaaagataacttgaatgttgtggtactaggttgatttcatctccaaaatatttctcgaaacaaccactacttttcactcctctgccatcacctcggggcaagctgctatatcttttaactagtctgcctgcttctgcttcagcccattcttacacagctagtggagtgatcttctaaaaatgagaaggagtcttataattttcctacttaaaaccaatcttcactaacttcccattgcccttagaatagaattcagtcttcttaccataactacaaagccctgtatgacctggccctggactccctgtctggccacacccatgttgagccacttctccatcacttgctcatgctgtagccatactgtatggcttcttctagggcctcaaacttctgtattgttgtgtgtcaagttctttctctctttcaggtctttgcatatgctactccctttgcatgaattgtcatcttttaggtcttacctcagatgtcattttttcaagggagtctcctctgacctcctgggctatattagtgccatcctgcattttttcctagcacctaacacaatatgttagtagttaattgtgcgtttgtatcacccatacaagctctgtgacgacaaaatccattctgtgttttgtttaccattgtacccacagttcctgacagtcctgagctcatagtcagcactccatgaatattttttagatttgttgaatgaatgagattataatcatttttattttttgtcttgaaaaacttagaaattttacactgtcacagtacaaatagaatggtgactcaagtgatagaacttatggagctgatttcatctacttttacattttcaactgttattaaatgctctgcctctggaaggttgagacatggaaattgcaaattaaatcttaaaaggaatttttcctccctattggctgtattcattatggtagttctggttagcatgaattgatctgttatcagtctgacaatggtacggctgctgagtttgaaattcagaaaactaatacttgttcccttgagtttgggcgtttgtggcagagtttagtagcagccttctccttcagccctgatttgggaagcatcccaatacatgctatttgcattgcagctgtgggaaagtccacgtttgtgaagttactcacgaaaacttacccagaatggcacgtagctacagaacctgtagcaacatggcagaatatccaggctgctggcacccaaaaagtaagtttttagttgtggtgggtagttggcaggcatgggtgaataatctaattgtcataatttaatttactctcagtgagtaaagtagcccagtttgagtatcctttttaaaatagcttcattccagaaagcagaccacatacaccagagaggatatgacttgtttgaatatgtgcagttttgatttttgtggtttttatatgtctatctaagtgactgcctctgttgtttgtggtttcccaaagcatgtccaaccatcatggatggctttgaagatgaattttgtcattcctacacttaagtatttatattattacttaagctaaccactaggattaatagctaattatagtgattttaactttttaaataaagtcttagaaattagaagggatattagagaggttccagtcacactttgagtcaatgggagaggttacagctaacatttatgagcatgtactatgtgccaggcactgtactatgccaagcacagtacatttcacttacacctcatggcttaggccctggtgtcaagactatggctttggcagaggccatagagttggtttccagccacatcagtctgagtaaggaaagacttgtttcgacatgacccttagagggagcagaagcaccatgcctcctcaggcaccatgaactgctcctgccgccacctgggatattcactgagtggcacattctggttcttaactctaattactaaacagttctgccttttaatgagccatgttgcacccctgtgactctgactcattggttcaagttctacctcttaagtcttttaacttttcgccgtaacaaccctatatatagttgaaggtaatgattttcctgttctttctccccctcaagtctctctccttttttttttttttttgacagtctcattctgtcacccaggctggggtgcaatggtgtgatctcggcccactgtaacctccaactcctgggttcaagtgattctcatgcctcagcctcctgagtagctgggactatgggtgcatgccaccatgctgggatactttttgtatctttagtagagacagggtttcgccatgttggccaggctggtctcaaactcctgggctcaagtgatccacccaccttggcctccaaagtgctgggattataggcatgagccaccatgcctggtcaagtcttctctctttgaagccaaacacctccagttttcctccaggctattctttactctgaagtaactttacctaagtgatgagtcctagtttgttcactttccactttgaatttactaagagtgctacttggaggtgaacaggacattctggatgtagtctaagtgggacagagtatcatggaacttgttctgggtgccatttttttttattccaacccagaattgtgttaccttttgtggctggcatatcatgcctattgaggatttttgctgcttaagttgtctctttatatgtctgtatgtgtgcctgtgtgtgtatttgtgaaattaactttcctatgcaggaataaattacatatctttttctgagtatgccacaggtcacctgtgtgtatttcaaaatacagtcatgggctgcataatgatgtttctgtcaatgatagaccttgtatacaatggtggccccataagattataacaacatatttttactgtaccttttctatgtttagatacacaaatacttaccattgtgttacagttgcctacagtattcaatacagtagcatgcgatacagctttgtagcctaggagcaatagggtgtgtcatatagcataggtgtgtagcaggctatcccatctaggtttgtgtgagtacattttctgatggtcacacagtgacaaaattgtctaatgacacatttctcagaacatattcctgttgttaagtggtacatgattgcatgtccacaattgtttgatattcctcccttctagaagtagagcgtaattcttgccttgaatgcagctggactttgtgatttgtttctagtaaatagaaagtagcaaaaataagaaatacctttctagggtaggacataagagacactgtagcttccatcttgttctgggggaagccagctgccatgtcaggaagcagccttttcaagggggccacacggaaggaactgaggcctcctgtgaacaggtacgtgagtctttttggaattggatctttcagccacagtccagccttcatacaactgtagcctcagccaacatcttgactgaaacttcatgagaaaccctgaggcccagccacccagctaagctccttcccaaattccttccccatagaaactgagataatgaatgtttttgtttaagccactgaattctggcataatttgttaggcagcaatagataactaatcatcctgtaatcccattattcagaagtaaaatggacatttttctacagagaaaatgtatagatttacatatacttacataaatgtataaaatatatatacatttgctttttgaaacaaaaattttgattgccacctgtatgtcacttaatagacaagatctccctttcacagtgatatcattttaatggttgtagtgtactgcataatatgaatattatcatttagttatccagtcctctattttgaatgtttagttttctaatttcttcctattataagcagtgttgcaatgatgaatatcattgtagctatactgcttgttttttaatataaagccatgttttgtgtatctttttgttctttagtgaattgcctgtccaaaccccttgccttgtttttttctattgagatcttcatctttgtgtaatggcttcataaaaactcattgtatgttaagtatattaactctgtcatatgtttgtttgtcattttcttttctttttttttttgaaacggggtctcgccttgtcgcccaggctggagtccagtggtgtgatcttggctcagtgcaacctctgccttccgagttcaagcagttctccctgcctcagcctcctgagtagctgggattacaggtgcctgccaccacacccagctaattattgaatatttagtagagatggggtttcaccatgttggccaggctggtctggaactcctgacctcaggtaatccacctgaattggcctcccaaagtgctgagattacaggcgtgagccactgcgcccgaccatgtcatttttcttttatcttggtatataatatatttttacaatataatacatttcagtttttatgtagtctaacctgtccttctttttcctcatagttagcacctttgatgttaaaattgtagcccaggagtataaaaataatctatttctttttgttgcttttatggttttatgttttatgtggctttacaagttataagactttagttttttcacaaatggttatctacttatccagtagtattcttgtttattcctgagcagaatatatattttgtttttattgtgactgagatcttttttccacatcatcttctgaaactggttattgctgttttaatggaaaacagttgattgttatatttatcttatatgatttaatttctcatttttttatttgcttgaagttttggaaaataatagttgtctctaaatagtaatcatttgaaagagttttctaatatctgtgccacatttctattttcttgttttctttcattgggtagaacttccagagcaatataaactaatagcagtgagggtagtttccttatcttgttctgtcattaatgaaactgcctctaatatatcagtgttaagtttaatgtttattattcatttcagtagaccgtgtggtacacgtacccttttgttactagaatagtaactgtttttatcatgatcaaatgttgaatttccatcaaaaaccactttagcatctagtgagataaacaaggggtttttctttttaatctcttagtattagtcatagatttaataatggtaccatcctcacatttctagaatgaacttttttttggtcatgatgtactattccattaatttggtaatgtgttgtttggaattttgcatgtatatttatttatacagttggttggtattattatttgtgtgtatggtgatttttgtttgttttgacttgtgggttctttttaggcagggtcttcctctgtcacccaggctggagtgtagtggcatgatcatagctcactgcagccttgaagtcctggactcaggtatcttcccacctcagtctcttggtgagttgggactataggtgcataccactgtccccatctacttaaaaaaaatttttttttttttttgtagagatagggtctcactttgctgcccaggctggtctcgaactcctgggctcaagcgacccttccacctcggactcccaaggtgttgggaccacagatgtgagctgtgatgcctggcccatgtgtagtttgtgacaggttttaccatcaatgttatgaaaataaatggagaaattttgcatcttttctagcatagaaatgatctattccttgaaggtatgatagaaatcatctttaagattatatggattcagtactgtttgaggggaatcattattggacaactgttttctgcctcagttattcaggtttttttttttttttaagatggagttttgctcctgttgcccaggccagagtgcaatggcacgatctcagctcattgtaacctccgcctcccaggttcaagcgattctcctgcctcagcctcccaagtagttgggattacaggcataccaccatgcccggctaattttgtatttttagtagagacaggctttcaccatgttggccagactggtctcgaattcctaacctcaggcgattcacccactttggcctcccaaagtgccgggattacaggcatgagccaccatgtccagcccctagggagaatttcttaagctgatactcttttctttttctttaaagagtctcactctgtcacccaggctggaatgcagtggccctattatagctcactgcagcattgcttctcagccttttggctaagatcaagtgtatagctcactgtagcactgaactcctgggttcaagcaaatcctcccacctcagccaccagagtagctgggactacaggcatgcaccactatgcccaggtaacttttaaatttttttgtggagacagagtctcactatgttgcccaagttagtcttgaactcttggcctcaagcaatcctcctgccttggcctcccaaagtgcttgggttataggtgtgagcccccatacctagcccttaaactgatactctgtaaggatcttctaattcactaattaggtttactgcattatacagtctgctagctaccatcttcattatcttcattgggtgttttacttgggcaattgcatttttcacctctaagaaagttattttcttattgttccttttttatgatagcttattcttgttttatcagcaaggccgtatcttttgttttctcctgtttctgacaacagccctgtctgagcacagagactagtcctctccttttgaattgctaagtaattttgtgtccaattattgttcatctgtttgcttatatttttggaaggatgtttgcatttgttctgtagctgagatgggttctttcagaaattgtgttggtttcttttacatttttggttccagaagagtctctctttgatagcccaaagcccactggtgcaatagaacccaccagtcaacctattgcatctgccagcacagcactccgctccacatacagtgtgtgaattgtgcaacaggcccagggctgctcccaaccatctctagtgacaccacagagactacaggagacacaaatttgtcctcctacttctacctccagctcttagtcaggggccacgtgtgaggctggtatgtgtgggcttgcggggtcagaaggagggaaatcccgaaaatacctctgagttaaatgtttttctggtccactctgctctatatgtgttgtttctgctgaagcctttcaaagggctaagacccttctttggaatctaatagtgctattttgccaaattggacttcttactgttgttgaatcttttttctccttctgtcctgttgtctctacctgaagtacaatcttcttaatctccatttccatctgtgagaattctactcatcagttacttcccagcttaatgccactttctttcagaaactccctgagattccttccaccatcagtaatcgtcccttcatcacatgttctgccttacattccagcttcgtacatcctcatcaccctcttcctttttgcactgtgagctctttgagttcaggaactgtcttgttcacctttagatggagggtgttggaatgatgaggttagaggaagccaggtttgagtcccttcaacatttactcgccatgaaaccttgcacaagtaagttacttaacctctgagtggattttcccctctggaaaatgggcattacaacagtacctacctcatgaagctgttttgaagattaattgaggtaacataccacagtaaaggttgaaataaatgttaattcctttttctatacccttacggtaccctgcccatgtagcgcctcatccacacaggccttcagtgattggtgattgaataaaaaatacagatccaaagtgcttttgtacaaaattcacttttgcattgttgagtcaatggcagatccagaaaagaatctgaggctgggcgtggtggctcacgcctgtaattccagcactttgggaggacaggagttcgagaccagcctggccaacatggtgaaaccctgtctctactaaaaatacaaaaattagcttgtcgtggtggcgggtgcctgtgatcccagccactcaggaggctgaggcaggagaatcacttgaactcggctggggtggggaggagggcggaggttgcagtgagccgggaggttgcagtgagctgagatcgtgccactgcactccagcctgggtggcagagtgagactctgtctcaaaaaaaaaaaaaaaaaagaatccggggctgctgaacatcccacacttgtgcccacttgcacatgccgagtaagtggaacgttttaattatgtttcataaagtctctagaattaagtagggttttgttttaacaaacaaattgtactccttatatgaaagataaaattctatttggtggttgattggttggattttcaaataagcagttgctttctggtttgccttgacattttataaacataactacagatggaagctcaaaagagaggcaacatagtgttatagtggaaagatttgattcagagttaaattttagatggttgttgactgttaactcctccccagacagacttcacaaatccctcaatcagtgatcgtgttaattctatatatggttcttcctctgcttttgttatattgaagtggcatgtcatctccctttagagagtcttatttaataggtaggaaaatctcatccctgattatgaaattttgactaagctggggatctgattctacctttttggtggaaggaaacttttgtaatttcttctttcattgattattaaacctgtttggggaggtaggggtgtgtgtggaggggtgtaccccatggagtaaatatgctttctaggaaattttcttctttttttcatctccctctaggcctgcactgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagtgacaggtaaaatgccaagccctccaccagtcacaagccccatgctcagtgctgcctgtttgatcttgcacagatcctgcactgctatggtcactgatgattataatttgaaaaattatcttcttttttaaagacaacactatacagatttgtccagagttgtacttctaccagattgtcatctatgtcaagaaaggaaattgggtttttcatcaactgaatgctttgaatttcttacattgctactgattaccttatgtttccttattttctggcatggagcaagctggtagccacctaatgtaaccatcacatgctaaaaggcacataatagacacttaagtagcagtgtatattctaagaaatcagatgattcagtggttgattatcccctttaagaaaaaagcagacgaaattaaaatttgtgttcctgaaaatgatataagagatattttcagccttttttttttattcttcaagaaaggatgcttaggcagaaatagcacatctgagaaactggcttctgtctcagatttagccctttttgaccccttcttctgtgagagggctttttgctggccagagtctagtggacatcagtgcctgtgtcagatcagggatgggcatcatcctgaccacctgagggagtgagatgtgaagtcactttgaatgcaagctagcagcaccctgggaagtgagcccatctgctccagaagagctaggccgtgcaggctccggaatgcctggctctgctgcagagaccaggctgtgacttgaggttaagccgcctagagacaaagtcaggatggcttgatctggacactgctggagtttttcttatctgaagcctatgaatgaccagtgtcagtgtgaaatggtgctttcaagcaaaacgatctttcttaaggctctttgaattatcaaaatgggaagtggtacattttcattgtcactgctgaagacactcagttggttactcttttaattccaaattagacaaactagttctatttcttagtgcttccggaaagcctcctagaagaaaaaaaataaggatacatttgtaaatgacaagtgatttttctgactttaccctaaaatcatgtaagatatgtaaaacaaaccctataggctatccgttccttgtttacgtaccccgagagagcctactttttataaaagctaaatatgtgaattacaaatggctgggctataggttttacttctttttcagctgttggatatcccacctgcctgttttcctctcttctctcccaagccatgcctctcggactcagaagttgaattacatataaccacatgggttgtttggaaacatagtcagtctttatttctagccgcttcatgaagtaggtgtgtgagaccctcagaggaaaatagagaagtagaaacactttgttaattagaaatgcattaagaagctgcatggatcttaacctttgcttgtaaaggaagaggtaataattgattacactgtgggcatacaacattccaggtgctatcttcagtgagggcattttcgagacagaaaggaaaactaatcacaagttctaatcccgagggtaatttagactttgttcacttgcacagatttattggatgcctcctgtgttgaagcaccaaggctggccctggggctgcagcagtgaataaggcagacccagtccccgcctaacagggactgaacacatgctcacgtgtgtgatatttgttccaaaggaggaacacaggttatctgggagagttgattatagcgaggaagaaatcttagtcttttctgtttgagttaaaggaaacattagcatatggttttagagcagaggccctgactcctagatccttatgccctgttctgtcctgcagcccctgcattcagtctgcagtacttccctcccactcagcaccacacccttctgcccctcaccccatcaccaccacaagctttgaagaaataaaggaagtgctctttctcaagaaagccaagaacccctttcatagggcttattagcaaatctttaatttctctttataagatccttttttgttttaagacagagtctcgctctgtcgcccaggctggagtgcagtggtgtaatcttggctcactgcaacctccgcctcctgggttcaagcaattcttgtgcctcagtctcctgagtagctgggattacagggacacgccatcatgcctggctaatttttgtgtttttagtagaaacggggtttcaccatgttggccaggctggtctcaaactcctggcctcaggtgatccgtccgcctcagcctccaaaagtgctgggattacaggtgtgagccacagtgcgtggccactttataggatcttaatttcatcttctagttatctgtaaagaactcaaaaacattttgagtttaaaatgttacccttttatttgttctcatcaactagactatggctaaaccattccagactgggaaagtttacttgtggagtttctaagttagcttcttcatagcctaacaaaaagcagttataataataactaagatatctagaagactatgtgccagtcactcttctaagcactttgtgaggattattacaagacatcatcataacaggctgagaggatttaggtgacttgcctgaagttacatagctagtgaatgtttcagccagtatcagaccctgaaatgttattctggaaggtattctctcagtggtgacactcacagccttgcagtctgtactttcctgagccatcatacacaagggttctgaattttattttctccaaagtggccagttgctgagcattgccttggaaactggagtcccttgcttaggatgcaaattgtgttttttattaaaatgcctgaggtttgaaagcaggattgacccctggtttgtctgaagccatggtttatgtttagctctgatttcctgtttaccagatgctcttttggttgtagaaataagcagggggcaaagctggtttgatttttagctttagctttcttttatctgaactagaaactcagcagcagaggaagcaagcaagcaggagctcataatgcattttgcaggagagtctgctttcttagtaatactgaaattagtaggaaatgcattttctgctccatagaggacaccacataaatactatttcttctgcatgtctcagctaaacaaaaggatggctcagtagcctggagacttagaagccctcagtccttgtatgaaatttagtgggtggatttatactggattcacttgtttatttgttttgggccttgctataataataataaggaaatctcaaaagttcaagtttacatatatttgctgtatgttctgactggtttctagcagagaaaattgttagggaccaatgatactatcttctgtctcttttcttccagtgaatcaatccatctggaaaggtgtgatttcagcctccaaagtctagatcctatttcccatcttagtactgagcagggagggagatatgggttaagaattcagatttcttaaggattgatgaggagctagaaaggttaagtggtttgaacagacatggaacaagttggttattgatttttctgcttctctctctctctcgtgcctttcattccatttcccattctcctgccctccccattcccatcccacttccaaccaggtatatctttgcaaagaatctttttgaaaatggttccctcagtgacatcgagtggcatatctatcaggactggcattcttttctcctgtgggagtttgccagccggatcacattacatggcttcatctacctccaggcttctccccaggtaacactgaacctacaaccttagactttagggccatatgaaacctaagaagtgacattctccaagcccctgattttctggttggagagattagagcgtagacattacctgcagcacagagagcagtgggggacaccctcctgtcccagcgttgagcaccctgttccccactggcttcgtgtagcagagtgctaaagccattgactatgcataaaaggatcgctgttgatgtaggaacaacagagcaaatcgagtgtcatctttatgatgacgcttagggtttgcaggtgggacgctctgacctgtagccacttgcctcagctcctcctttactctgactgggtcatcagagtgtgtagtctcagtggtttccttagtaagatgtgaggaggaagaggagaattttctcacctcatcatgatactgccctaatttatagcccttttttgaactgtgatgccattgggaaggcaggatggactatagcagttccattctgtgactctctggctggtgccatcctacatgaagtaggatgatgtcacggcaggagcaccagagtctctggagatagaagtgagctgtggcttctgctgactggtagtgaccttgggcagcccctggagacctttccactggagagatccttgcctgtaaaatccactggttcaatctagacgatctctaagggctcttctggagtgggattctgagtcaaggtgagttttttttttttagagatgtactgctctcagcttttgagatatacatccaatatatagtcaaatgccagatataccacatactgttagaaggaaggaaagctgtctccaagctagaggctatgctttttagagatggaactgagacttgtgggcagaaaggagccgagaacagactgagcagaaccagaggatgagtgggagagctcccatcacagagcctcacaccagccaacgaggagaggactggaaggaagggtcttgccttaagaaggtggcaaccaggaaaaaaggcccttgaatgtgactggggccagatattggggatctttgtgttgagagtttctggacattttgaggcaaaagctagatcgtacgagggaataagagattctacagaaataaataagggttaaagtttaaaatgaaactgggccggtgcagtggctcatgcctacaatcccagcactttgggaggctggcgtgggaggatcacttgaggccaggagttcaagaccagcataggcgatatagtgcgactccatttctacaaaaaagtttaaaaattagctgagtgtggttatgtgtgcctgtggttttagctattggggaggtgagacaggaggatcacctaagtccaggagctcgaggctacagtgagctgtgatcgtgccactatactccagcccaggtgacagcgtgagaacttgtttctaaaataaaataaaactgaactaaagattcagtgaggccagagggctaataatcttccatggaaagaaccacactaaagttagatgcattgatcgcaagttgacaaggtgggtcatgtttatgtgacttctttcaatagtcttcattgcctgagagccagaatagaagaaggggattatactttaggggtagagattagtgtcagcgattgtggggagaggagtcccctctcaaagaggacagtttgaagtgtcaaagtgtagggttcaagttgggagagaagtcctgagccccaggaaggcttgtggcctgggccaaagaggagtgagagtgctgtgaggttggattgagtaaagatcctggttggaatttgaagaagtgacaggtttcctatgggagtcttgggatggctggactgaaagaagcaggaggttctcaggacgagctgagcattaggagaagtgagaatgctgacttaaccttttccaagagaacagcacattcagctcagtgccatgaagccagcattggggaggagtgagagaggaagtgggctgactcattcctgggagtaaaatggggctacttgggccagctgaagaggctcttgtttctggggagtggaagttggacccagcaaggagaacaagaaagtcttaattgcttttcttctttgtgcactctgaatgaccttataacagaatgcctgaaactggttaatttataaagaggcttattttggctcacagttatggagactgggaagtccaaattgggcagccttaacttccattgaggacctcctgctgcctcatcatatgatgaggtggaagggagcaggcatgtgcaaaaggggcaagataggaggagcagccttgctttataacatcccactctcatggcaactggtccaatcccacgagagtgagaactcattccggcgagaattaacccagtcccaagagagtggcattaatctgtcttaacaacctaatcacctcttaaaggccccacctctcagcactaccacactaaggaccaaatttccaacacatgaattctggggggatacactcaaaccatagcaaatggtgatgatgatgatgatgatcatcatcatcatcgtcgtcgtcgtcgtcgtcgtcgtcacttgggggcagatctgcccttttggagaggctaattgaaatatttcagctggagtagaatgagaagagttgaaggattattacaacttaatggcagaaaagaaaaatagcttattcattttgagattagatggggattttaatgctgttttgatggcattagttccagagatgcaggaatgcccatgtttcttccctgaagtcacacttgacctcttctgtgaaattcagaggtaactgtgcccaagggaagagcagaatagaagttgtcctgtcactatgtaaaaagctgtgcaagtgcccaatcttccagttcagagccctcgtaaatactgagtttcgagcatgtcagatggacttcgtaggtccttctgctcctttctacctattcttccctaacttcttttttttttttttttttttttttgagacagagtcttgctctgttgcccaggctggagtggcacgatctctgctcactgcaagctccgcctcccgggttcacagcattctcctgcctcagcctcccgagtagctgggactacaggcacccgccaccacacccggctaatttttttttgtatttttagtagagacggggtttcaccatgttagccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggaccaggcgggtgcagtggctcatgcctgcaatgccagcactttgggagaccaaggtgggaggactgcttgagcccaggagtttaagacccacctgggcaacatagtgagagccccctgccctctacaaaaaatttaaaaattagccaagcatggtggtgtgtctgtattcccagctactcagcaggctgaggtgggatatcacttgagcctgggagattgaggctgcagtgagtcaggattacaccactgcatttcagcctaggccacaaagcaagaccctgtctcaaataaatgaataaataaatttttttttttagaaaaggcaactcaggccgggcacggtgactcacgcctgtaatcccagcactttgggaggctgagatgggaggattgcttgaggccaggagctcaagacgagcatggtcaacatagggagaccccatctctaaaaattttttttaaaacacaagcaagctaacaattttaaaactcaaaagagaaatagctaggcctcagtgttcctagccagccccatggaatcaagagagtgcagctgatcaatgtacatcaaaaagccaggccctacctgggactggcacagcatggggacagcatgcaggaggtgcatgggacaaatggcacctgggtttgggcttgagaggcatagtgaaaagacccactagcagtcactttccattttctgtttctgactccaagcaagcagagcagcagttcttcttcctgggtgggacaggttaagaagaccagtaaagggtctctccctcgccacttgtagctacactatctttcctgttcacattcaggtgtgtcttcctcatgaggactgagatgaagaggggtcagactaaagcactgtttgcacgggatttttttaaatagaatttgttatagcgatatcagtaaagcaagagttatgccaaatgctcatagtaggagtttacttcgacctctttttttttccccactcaatactgccaccagttaagacttagacttctcagggaaatccatttgctctgttaaggaaattaatagtaaatagaaatatgttagcttattttaatagatcaatgttagtgtcaaggtttgtctgcaagcagtgaatgaataattataaatagctttcctaaaaagaattgttctgcctttgtgtgtgtacttggaaacataaagtcacattttaaaaaaatttattttcacgaaacagacaacattttttttctcagaaaggaaaatgagatgatagctttgctatgcttagaaatcctaaagctacctttctggtgggaatataaattggttaacctctaaggaggcagtctggcagtatataattgcaagtgcatataccttttgatcattaataaaatttgtttctataatttcatttccttagagaaaaggtaagataagagggaaacagcaaagactcccaagtctttgggattattgtgtactacatttggaaattaagttttcatttcttaagtaagttattgaaagagggaagtcctggccgggcacggtggctcacgcctgtaatcccagcattttgagaagccgaagcgggcagatcacgatgccaagagatcgagaccatcctggccgacatggtgaaaccccatctctactaaaaatacaaaaaattagttgggcgtggtggctcccgcctgtagtcccagctacttgagaggctgaggcaagagaatcacttgaacctgggaggcagaggttgcagtgagctgagatcgcgccactgcactccagcctggcaacagagcaagactctgtctcaaaaaaaaagagtgaagtcctaaatcagtgggttaatccatctgttcttccaggacagatgatattgaataatgaaatgtttgtcaagcagagagaggactgaggataattcagtcaaaacaaacatttggagcaaaaattttgaggtgtgaaagagcctggcctgttccccaggaaagaggtcaaatctggctaaagcagtgagtccaggggaagagctaaggcagttgagaagtaggaggggtagctttgtgtgacaggtaaagaagatgtcattttctgagccagtgtgcatcaaacttcactaccagatgaatgcagaatagaattatgtacactctgcaaagcagcgggggaggagagttagtctcaagcctcacttgtttttccacttctttgttttatctttgacctgtgcaaattttacattctattcctgagtgaatgtttggtatgacatgaaagagatatttcaaattacctaacattttataaatgcaatgctattcatacatactgctttgaaccctggggctatggctgtaggcggtaaagagcctgtgaagtattttcagcaaggaaagtcatgtcattatattgccgtactacagacgggtggagtgaaggggaaaaactggaaggagggaacagcttttgccaggagctcaatacaacttacctcagtgacctgtggatgggtagacaatgaggaaatagaagcccacaaggactgcactgctagtaccttatgaaggcaggaatttactcctggactttctgaccttaaggcctgtactctgtccatatgcttccctgcctccaggaggcagaaccagaaggctcttgccataatccaggtaagaagtaaagaggacccgaccagggcagaggtgagaggagaggcaaggagagaacattctagagagatgaaagagaattgagtgacttcccagatatagtagggagaaggaaaaacaaggaaaattccaggtccgtggcttggatgactggatggatgatgttcatcattaaccgacttaggatacttcagaggaagagcaggtttaaggtggagatgggaaaagaatggtgtagatcctctgattgcataagaaaacaagacagcagaagcaaaggcatggcttgtaatgcccaagatagacattatgggtgggcctcagagcccccgaagactgcattgtagcagccaaaacagcaaagagctcatcagggcttggggactgtcttttaggtttgtttgaagagactgtaccagagggccagggaggaggagaaaggaattgagctggcctatctagagcagctgcatggccaacacgaagcctggcttattcacaagacaacgaagtaagtggggagaaaagaatgtatcagagacagagacctggctcccaacagccagttgttaaaaacaagttcagcatgcagccccctgtaggaaggttcagaatatactggaaatggttggaaatgtcaagcattttccaactcagaagtttaatattgctggacaccgtggctcacgcctgtaatcccagcactttgggaggctgaggcagtcacctgaggtcaggattcaagaccagcctggccaacatggtgaaaccctgtctctactaaaaatagaaaaattagccaggtgtggtgtcaggcgcctgtaataccagctactcgggaggctgaggcaggagaatcgcttgaacctgggaggcaaagattgcggtgagccgagatcgcaccactgtactccagcctgggcgacagagtgagatgcccagaagaagtttaatattgaatataatctttacattccaagggcctttttattagattgtatttctccagctttttctttgtttcttaacatttccctagactgaacattgtgattgatggtgatagttggctcagcatgaagggctgaaaatgttagagaaattgtcagtattactaagttggcattcctggtttctgcctgtcctccctttaggcttggtttgttgtccacttaaaatgtttggtgctctgactgtttgttagtatcactctcaagaatgaagagaaacctcaacctttctgtttccggccaactttattgaatttgtttttttaaatgcagtttacatgcagtttctttgaaaagtcatgttgaatttagatctgttctctgagtaagacttggcgagtatgtgaaacttgactcaagttacatttctttttttctgtcccccaaacgttcacgcttcttataggctccactttgaggctctgatgaacattccagtgctggtgttggatgtcaatgatgatttttctgaggaagtaaccaaacaagaagacctcatgagagaggtgggaaggactttaactcctgttttctggtggtttcctttgttgtacttttatctttctggcctttgcttcaaagttcaatatcatgggtcttgtgctttgcatctcacattgcatttcacactccaaggcctatggaatcttgtgcagattacaaatatccctattctctaaagtatgctggactaataattgttaaataattgacttgtaacatgtgcttgccagctgactttcttctctaaggcatcctaaaactagggaaatgagactactggattctattcccagctctgccacttgatgctatatgaccctgggctgcccacatttcttctccatgcctattattttcctttcctcacaaaaacctcatgggcttggctgcatatgcattgggggtggaccattgaaaattctgttaaaaatgtgaaattaaacttctgattttctccttcccacaggtaaacacctttgtaaagaatctgtaaccaataccatgaagttcaggctgtgatctgggctccctgactttctgaagctagaaaaatgttgtgtctcccaaccacctttccatccccagcccctctcatccctggagcactctgccgctcaagagctggtttgttaattattgttagactttgccattgttttcttttgtacctgaagcattttgaaaataaagtttacttaagttatgcttgtttttctaattcagttgctcatttatttcagcatgtatctcttggtgcttgctctaaattcacctctagactagtgtattagtccgttttcacactgctataaagatactacctgaggctgggtaatttctaaaggaaagaggtttaatcgattcacagtttcgcatggtgggggaggcctcaggaaacttacaatcatggcagaggggaaacaggcacatctcacatggtggcaggtgaatgagcgagtgcaagaaagagcagggaaacctgccttataaaaccattagatcttttgagagctcactgccatgagaacagcatgggggaaactgtcccggtgatacagtcgcctcccaccaagtctctcccttgacacctggggattacaattcaagatgagatttggctggggacacaaagcctaaccatatcaactagcaattttcaaattgctcccagaactctaacccaagccctacctgccatgcatgaagaagggaaataaagtggctcaagagtgggtgggatcttaaatgtgagccccccagagcaggaaatggagcatgaactccaggaagcttctttatctcttcccatctgccactcttgacataggggacaggtgtggggaacttaaacccttgtcctagagctaaagaacctggccaaaagaaaaaggtagaaaacagcaagaacccaaaagttaagcatctgacatttaagattggccagcccggcactctatctttgtctaaataccttacccaatgacttccagataacgttaatggagtggatctctctgtgcaggaaaaaaaaaaaaaaaattttttgttgtgctctttacccttcaaatagaatttattgttaagggaagaaaaatacatggctctataggattgaagtgctccattgccagaagcctgcaggtccatgattcacaggagcagatctgcactgaacccttgacggttctgcaggtacacaggaagatgaatgatctggggacgtaagagtgccccagaagacagaaatctgtgtttctgtcctttatgctttggggaaatgaatgtgagattggtttctaacaaatacataggccaggcaaggtggcttacacctgtaatgccagcactttgggagaccaaggcaggtggatcacctgaggtcagcagttcaagaccagtctgggcaacatggcaaaaccccatctctaccaaaaatacaaaatttatccgggcgtggtggtgtatgcctgtaatcccagctacttgagaggctgaggcaggaaaatcgcttgaacccaggaggcggaggttgcagtgagctgagatcacatcactgcactctagcctgggcgacaagaacgaaactctgtctcaaaaaaaaaaaaaaaaaaagtaatgttttaatataaaagtatggcaatttccttatcctacttatttaaaacattttaatagctttattgatacataattcacatattatacaattcactcatctaaactgtacgattcaggccacacacagtggctcacacctgtaatcccagagatttgagaggccaaagtaagagaattgcttgaggccaggagtttgagaccagcctaggtaacataatgagaggccagctctccaaaaaagtaaaaattaaaaaaataagccaggtgtggtggagtgagcctgtagtcctagctacttgggaggctgaggtgggaggatcgcttgaacccaggaggctgcagtgagctatgatcctgccactgcacttgtaggtgacagagcgagactctatctcttaaaaataaagtgtacaggccaggcgtggtggctcacgcctgtaatcccagcattttgggaggctgaggcaggtggatcaactgaggtcaggagtttgagaccagcctggccaacatggtgaaaccccgtctccaataaaaatacaaaaaattagccgggtgtggtggtgtgtgcctgtaatcccagctactcagg

SEQ ID NO: 14191 - DNA, 15379 bp, Human
tatattctcttacattactgcatgcgattagctaacactgataaaatgctattagctagttgcagactttattcatattttgccaattgtcctataatgtcatctatagcaaaagagagaaaaaaagaagcaagaaagagaaaaaaagaaagacaaaaagttttgggtccagaatccaatccagaatcaaacagcatttagctgtcatgcctaggctcctttaatggagaacagtttctcattctttgtctttcatggccttggagctgtcaagagtacaagcaatttatcttgtagaatatctctcactttgggcttgtctgatatttccttgtgaatagattaagatctactagtgtgttccaaagctttacaactgttttttttcctggacagttttaacattctaggtctgtgatctttcttctcaatgtgaaatgaggaatctgtaaccgtttttaggagactcattggtttaggaaaatcaccttattaaatttacagacttgttaagagctacgaagtgatgtgtctcctcaatggatcctatcagaaggcatatatgtgtgttcccttactgggtggtgctaactttgatcacgtggttgaagcagtaactgtcatgtttcttcactgtaaatttaccattttcctttccttcctggaggctagaagtaaaggtcaaggtgttgacaggattggtttcccctgttctttgtttgtttgttttgttttttgagacagagtctttttgttgcccaggctgaagtgcagtggcacagtctcggctccctgcaacctctgcctcccagattcaagcgattctcatgcctcagtctccccagtagctgggattacagcgtccgccacgatgctcagataattttttgtgtttttagtagagacgggggtttcaacacattggccaggctggtctcgaactcctggcctcaggtgatccgtccgccttggcctcccaaagagctggggattacagaagtgagccaccgcgccctgccctccttaagtttccttgcgggagagatactttgagactatgcaaaaagtttgcgggaaaaaatacaggaagcccagttgaatctgaattccagataagccataaataaagtataaatatgacctcccaaagtgtttatctaaaattctgatttgattgggcatcttgtgtttttatttgctagatctggcaaccctatatgtaaatatcttgctcctcatccaactttcacccagttgttttgacatctattgctgcttctgaatcagggttgcacatgcaaccctgacgtctgtctctgaatatcttttatgattttactttttttgttgttgttttgagatatggtctcactctcgtcgcccaggctggagtgcagtggcgcgccttcagctcactgcagcctcaacctcctgaactcaggtgatccttccacctcagcctccccagtagctggtactgtagtcacgcgccaccatgtactgattttggaaaatggtgattttctaactccatcattccttttacttctgttcgttggcattctatcagcttgtcttttcatccaccctttacagtgcttggcacacagtaggcgctcatataattgttcaacgaatgaatgaatgaacttttctcttgtgttgtccggccttcggtgacactagcggcgtcaggcaggagtttgacttcctcagcctatcatggcacgttgccgaggcttcagcgccttacaggacctcgctccaggctcttctggctccaatcaaaagcagggctctttcggacttcgcttacgtttaataaagaaaaccggttggccccttcggctccacctggctcaacagacagccagtggcatgcggcagggaccaatgggtggcggagggaggcggggcctgccacgaggccgcagtataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcggtaagagggtcacagagctcggtcagcgcggaaagctgaggggaacggagggcgaggggcacgccgggcccccgagggacaccgagggaagtccttcccgaacatctccgccccggcggtggtggccgctgaggggtgtggcggggcgacgtggcaccgagcgccgccgcagctctcgactggggcgcttcctcggcgcggagggctggtacccgaagcccgcctttcggagggagccgctctcctgcgactcggggcgtcgccggggcccgtggccagtcggcgggcgggacgggggtggcgtgcggaacgcgaaggcatcagtttacgcggagccttccgacagcgccggccgcctctggctgggatgctgagagtcgtctgggggagaacaggcgagggttccaaaagagcagccctcggcgagttgtccttgcggggaccctagcggcggagggcgctgctgcagctgatgaaatcgcggagccgacttgctcggggtccccgcgccgccctcctccctccgccggtgggagtggcccgcgctgcctccgctctgccaggaacatgaacggactctgggcaccctagctttggctgcagcccaccagagcctgtcagtgccgggctgcgtacatagaggtggcaaacatccgggaggctcccagggccttagggaaagggggaatggagagtgacaagtacccatatttcagcggtacttgcagaatttcagttttacaagatgaagagttctgaagatggatggtggtgatggttgcacaacatatgaacgtatttaataccactgaactgcacttaaaaatggttaagatgggccgggcgtggtgacacgcgccgaggctgaggcacgagaatcgcttgagcccaggagttcgaggctgcagtgagccgtgattgcaccactgccctccagtctgggcgacagagcgagaccctgtctcaaaaaaaaaaaaaaaaaaaaaagttgataaggtttatgttatgtgaattttaccacaataacaaaattgggaaaaatatacaggggaggaggaaaggaaaagctctgtttgcatttttgggtttccttgggaaggtgatttggtcggtcattagagcgctggcattgttggcattgttagagccctgcaccttacaacatcagccccttctttttttcatctaacgttcactgtgtaccagacactatgccaagctgtgcgaattcaaagatgagaaaaactgttcttaatggagctcatgttcctgacaaggggcagaacacgcgtgtaatttccagtcagtgcggaaatgctgttagaaatatttcaaaggcgctgcttgttggagcaatgagttcttgaaggaaaacgtgggaggggactttcagggttttccctggtctgactcttgacctcccccatgtttcgttactgtgtgttttctccccttctccctcttcctgagtgctggcctcatgtgactgtggaccagacctttcctaggcttccatggtccaaaagagatttataaagatgctctcattcattacctaaagaactgggccagtttgtctacactctccaataacaaatgctcttttcactacctttctgaaagaacaagtaagcttcatccacatctctgaaagcaatccatattatctgtactgcacatttgctatttacaattcccacatattgctttcttactgctgcttattttttaaaatactgtttatttttaaatactgcttatttttaaaaagttgtatccttttaaaaatatgagtctgcattctttttttttttttctttgttggatggtatgagagtttcaggaacataaacctatggttggagaaatagtagcctaggagacagtgggattaggaagtcaatggactttagaggcagaagtttgcctttgaatcttgtttctactatcctcagtttcatcttctgtattacagtgttattataatagtcccaaggtaacagagtaatatatgttaaagtgtaagcaaaacacctagtgtttaatagatgtttgttcctttctccattatgtcttccttcactcattatttttcccattaataattgataacaactcttccctaaatcacttgattatgaattgtaaaatgtcctgatactaatttctcatggaaaattacagtactgtaagctattgaattaaaaggaaagtgaagatgctactcacttggattttagttttgaattttattttattttttgagacggagtcttactttgttgcccaggctggagtgcaatggtgcaatcttggctcactgcaacctctgcctcctgggttcaagctgttctcctacctcagcctcccaaacagctgggactataggcgcacaccaccatgccctgctaatttttgtatttttagtagagacagggtttcaccatgttggccaggctggtctcgacctcctgacctcaaatgatccacccaccttgacctcccaaaatgcagggattacaggcatgagccacagttttggattttatttgaacagtcctcttgacttcttcctattctgttgattacctatcttaatgggatttttttctttcctttttttttttcttttttggcaggggaatctctccctaggtcaggttggagtgcagtgctgcaatcacggcttactgcagccttgacctcctgggctcaagtgatcctcccacctcagcttgtgagtaactgggaccacaggagcataccaccatgcctggctaatttttttttttttttaacttttagtagagatggggtctcaccatgttgcccacgctagtcttgaacttggcctcccaaaatgctgggattacaaggcctgtgccaccatgcccagccctgggaattttttctaaacacatctgtgaatgcatttaattctgggataaatgttagctaatatagttacaattttggattccccgtgggacttagctgactctccatttccctgtttattttggggtagcagttaatctgccccttggcaaaagagatgatgctaaattagttaatgactcactcccaaggctgtatttcacattttgcagagttgtgggaagcagaggagggctgacagttatactatgaaagatattcattgcatgtgactttgtttttggttcttgttactctttgactgtttttctttcttttctttttttttttttaagcaaattggcataacatccagaacctgcttttggaagcaaagtttgggacttggaacactggcttttcccagaaccctgtgtccttaacttcagtatatgattttatctgaatgtgctaataccattttctctaagtttactgctttcaaaagaaactttttatgaggtgcaagctaagtcattctcactgactagatatacatatagtgtatatacttatatatatctccttatgtgtaagtgtatctattttaaggatacatgtgtatgtgtgtgtatatatacatatatatataaaaccaagagaaaagagtaagaaattagttttattgaacatatatgcctggcacattatatatgtttgttatttcattcaacataaatgactgttctaagccgttttaaagtagtctttcactctgtagtgttccaggattaggaatgtatttttggcctgcggtgggcattccaggtactaatacaaatcaggaatgaggaatgttgccaggtgtatttgtatcagcaaaacccccctattttaattttttttttttgagatggagtctgactctgttgcccaggctggagtgcagtggcacgatctccgctcacggcagtctctgctcactgcaacctctgcctcccgggttcaatcgattctcctgcctcagcctcccaagtagctgggtctacaggtgcgtgccaccatgcccggctaattttttgtatttttagtagagacggggtttcaccatatgagccaggatggtctcaatctcctgacctcatgatctgcctaccttggcttcccgaagtgttgggattacagatgtgagccaccatgcccggcctgcaaaacccttttaatgaagtcctcttcgactctaattctgaaatggaattgtgaatattaatatgttttcaatttcttcatataccatgggtataattaaatgctattatatgttgtgccatgctagtattatataaaatcagggtaaaagtatttgatttgctgtaagattgtaacttttttctttttttgagatggagtcttgccctgttacacagtctggagtgcagtggcgtgatcttggctcactgcaacctatgcctcctgggttcgagatattctcctacctcagctcccgagtagctgagattacaattacagggtcctgccaccatgcctggcaaatttttgtatttttagtagaggcggggttttgccatgttggccaggctggtctcaaacccctgacctcaagtgatctgcccaccttggcctcccaaaatgctaggattacaggcatgagccaccgtgcctggccagattataataatttaatacttcacaagatgcaatacagattaagataaagtttatatataagattattgcattatatctaagatgttgagatttggtttaaagttggtatttaatcataatgcaataaaaaacacttattgaaggcctaaagattgtgaaagctttaaaatcccatttaaattagcagttactggccgggtgcagtggtgggtgcctgtattctcagctatggaggcaaaagctggagaattgcatgaacttgggaggctgcagtgagctgagattgctccagcctgggcaacagagcaagactctgtctcaaaaaaaataaataaataaattagcagttatcttgagaattaattttatctgaccctacaggatattcagtaccttgatgttaggttttagaatataagaggagattacttcattggtcttgaggttagagcagtcttcatgacaccaaggacagagatctaaagggaaaggctttttttaatgggatcattttacttaaggaagagatgctcatctattttattttagtttagtttagtttagtttagtttagtttagtttagtttagtttagttttttgagatgcagtctttctctgtcgcccaggctagagtgcagtggggtgatatcagctcactgtaacctctgcctcctgggttcaagcaattctcctgcctcagcctcctgagtagctgggattataggcgcgcaccaccatgcctggctaatttttgtatttttagcagagacggggttttgccatgttgaccaggctggtctggaactcctgacctcaagcaatccaccctcctcggcctcctaaagtgctgggattacaggcttgagctaccacgctgggccagatgctcatctttaagtaatgggcactttactgtaaggacatgtgtgaaaataggaaaactgggactcttccacatttgggtttcatggaacccaggaagagttgcataagcagttctctttgggaagagacagcctttcgggcagctgaacatggttttgggaactggaggttcttctagatcctgatttttcttcttgctccccacctcagcaacagttttctgatttcttgccctgttgtctcccattggtgtgactattattctgcctattctttctgtctttgttctgtggttctagtttgaactgcctcagggacgagctcttactggttcaactaactctcactgctctgttgagctaagcttttgcgccaactggaccactggccagcctagagattgttgcccttggcgtcacatactcactcctggtctgtcagctttggatgatatggtggggtccctgggaagagcacattgccaactgtgagaaggagcttcctccagtcccctgccctgcccctattcttaccaggaaagtcttccccagaagggactgtggggagtggtggtcattttgatgtttgacctgtccagtatgttgtttgtttgtttgtttatttttgagacggagtctagctctgtcaccgaggctggagtgcagtggcacaatctcagctcaccgcaacctctgcctcctggtttcaagtgattctcctgcctcagccacctgagtagctgggattacaggagcccaccactacgcccagctaatttttgtatttttagtagagacagggtttcatgtgttggccaggctggtctcgaactccttaccttgtgatctgccctcctcggcctcccaaagtgctgggattacaaacgtgagccatcgtgcccggcctatattgtttgtttattcaactacagaatataatttatcgatttaaaccaccataaaaatgaagtcagttgactgggaaatgatttgaaatacatgcctggctgctaacaacagggacaaaacacgaactacaaatggcatataagcagataagaaaaactatttaacctcatggtgaggggtcaaacaattgcaaattgaaactgtaaaacacttagtaatgatcagggcgcagggtggtgtagcagttaagagcccagactgatgtgagactcagcttgaccaagcgctgtcagtcacttaaactccctgagcttcaaattaatgataataatgatttctatcaactttatccccctccatatgtagctggatatattcattcatttatttatttatttagcagagacagggttttgccatgttgcccaggccagtctcaaactcctgggctcaagccatcctcctgccccggcctcccgaagtgctgggattacaggcataagccactacacctggcagagttttagtttttataaaaattcaagttatttggttttgtgactctgttgccttctgcagaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggtatgtgtccttctgagacctcgactgcggttcagttgaggtttatatgaggcaaagtccattctaatttatgatttcttttttctgattaggaaacccaagcagaggaggctaatgtgattgaactgtatcccaaaactttgtcataggaaatcagactatatctttcggggtttatacagtaggacaggagatactggttggtattctctgtggcttctggaaagaatataagctacattctgttcttagtctttatatttgataggtgaccctgaatgcattttacatttgctttccttgagcaataatgggtctccagtggaggtgtttgagtgtttgcagcttaaagccttagaggcttagggggcatgattgagcaatacagtattaggtgacctcagtgatgaggtcaggaacacagtcgtagatttgaaggaaatgactctgacttctgggaaatagctttcaagttcttcaccgattggttctaaagccaaacatgcagtttagaagcagttcaggtctggatgatggggtttgtgttctaggtctcacggtaccacagattactgtgtctctgtggacaagaggtgggtgggcaggctcagatatgcctctgcctgcccatctgtgggcctgtggtctgagcagcaggtggcctttccttcgaagggctgtgaaaccactcgcgtggctgggtggggttactggcctgtaagcctgtggttttctctgttctttattattgaggagtgaggcctcctgctcttttaattgaaagcctttagaaacctctagataatggcaagccatggcattttgttttgttttttgagacggcatttcgctcttgttgcccaggctggagtgcaacggcgtgatctcggctctccgcaacctccgcctcccgggttcaagtaattctcctgcctcagcctaccgagtagctgggattataggcatgggccaccatgcctggcgaattttgtatttttagtagagatggggtttctccatgttggtcaggctggtgtcgaactcccgaccttaggtgatccacctgcctcaggtgatctgcgcctgcctcagcctcccaaagtgctgggattacaggcgtgagccactgtgcctggccaagccatggcattttaagacattgggaggtagtgtggtgcagaaaaaaagaacatggattttggaaccagaaagactggctgtattattagctcgcttatttatttatttatttatttagagacggagtctcgctctgttgcgcaggctggaatgcagtggtgcgatctcagctcactgcaacccccgcctcccaggttcaagcgattctcctgcctcagcctcccaagtagctgggactacaggcgcgttccaccaagcctggctaattttttgtatttttagtagagacgggttttcaccgtgttagccaggatggtctccatctcctgacctcgtgatccgctggccttggcctcccaaagtgctgggattacaggcgtgagctactgtgcctggcctagctcgcttatttttaaacctctctgagcctcagtctgtctgtaaaataaggttaatgaagattgcatagaatgaggtatacaggatgtgttaagctagtattctctggtgtatatatttgtgaagttacttttttaggttccttgagctacttcagcttttagggatgagtgtgatgatacaaaacccgtatggtagccaagtatggtaggcaacatagcagtgctcattaaatgcctcaaaaatttttttaacctcaaaatttcttataataggaatcaacagtgagacaattatgaaaccagcttcaatttcagaggaagaattgttgaatttaatcaataaactgaataatgatgataatgtagatggcctccttgttcagttgcctcttccaggtgagttttggactccatttaacatgattgctgctgcttctgctcctttccctctccctccctctctctctccctccccatccccctcctcctccctctcctttccttgtctcactctgtcacccaggctagagtgcaatggtacaatcatagctcattgcatgctcaagctcctgggttcaagggatcctcctgccttagcctcccaaatagctaggactataggcatgtccaccatgcccagctaatttttacatttttcctagaaatgaaagtctgtctgtgttgcctgggctggtcttggactctgtgcttcccaaagtgctgggattacaggcatgaactaccatgccctacctaaaatggtttctgaggggtaaaaaggccttgttactttatacacctggttcttcatgtggatttggcttaaaggcaaaataaactcaaaagagtgaatattttattagaaatgggacagaccaactcagaataccaattacgccttgatttagtattgtggtcttgatacaaaggacagtggagggaagcagctgtgatagacgatattggctttgctattggtgtttggctttgcttatgcgagttccttccatgcagatgaagtacatctcagaggcaagctgtagaagaatagatttccttgcgaagcagataagctggagtcaggcagtgctgactatgcggtggtgatttaaggcaactgtgccaatttctttttcagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggtaggtatatcccagaattgcatgtctgtgttaatattataaaagtagtactggcaaatggtaaaaactcatacagtcccaaagagtggaaaccctactgcatatcctctagtcttactccccaaagtttacctctcttaacagttttttttttgttttttgttttttttgagacagggtcttgctctgtcacccaggctggagtgcagtggcgcgatcttggctcactgcagcctctgcctcctgagttcaagcgattctcatgcctcagcctcctgagtagctgggattacaggcacgtgccaccatgcccagctaatttttttatttctagtagagacaggtttcaccatattgaccaagctggtctcgaactaggcctcaggtgatccgccccctcagcctcccagagtgctgggattataggcatgagccatcgtgcctgcccttaacagttgcctatgacagtttttgctttttaatccagaagtctcagtgaaggaaattttctatttttctttttctttttttttgtttttgagacggagtcttgctctgttgcccaggctggagtgcagtggcgtgatctcgactcactgcaagctccacctcctgagttcatgccattctcctgcctcagcctcctgagtagctgggactacaggtgcccaccaccatgcctggctaactttttttttttctcgtatttttagtacagacggggtttcaccgtgttagccaggatggtcttgatctcctgaccttgtgatccacctgccttggcctcccaaagtgctgggattacaggtgtgagccatcgcgcgtggcctctatttttctttttaattttttctttaagagtcagaggtttcatcatgctgcccaggctggtctcaaactcctggcctcaagcaattctcctaccttagcctccctggcctcaagcaatcctccctcctgctgggattacaggtgtgagccaccgccccagccctcagtgaaggaaatttaagatttgatagtggtgacagtgcacattcctgtaacattttgtagcctgtagtatgctttctcctgttttcttttagcccttattatgtgtagcaagttacagctccagttgactgatgaggcaaaattgggttcatgttctaggccatctgactttgttttcctttggactggcactacttttaatgtcaatacatatatttttataggcattccaaccctagggaagaatgtggttgtggctggaaggtcaaaaaacgttggaatgcccattgcaatgttactgcacacagatggggcgcatgaacgtcccggaggtaaggaaattgctttcagggaacactgtccttttttccccatgtaagaactttcagaagccatcctgtgcatgtttggaagtattaactctgttatactttgtatttgttgaaattttgttaacagacaattcagggagtaacctttgtagagaagctgcacccagtgtcacctgagtttctttattattcatttatcatgtaactagcttcagaaataaatttaagttttgagtataagcatggttgtaggcaattagaaaatttcagctatagctttgatagctggagctaaggagcaattcttattcaaagatactgtgtcatttagtggaaaaaaatctttagccgttgcaaaggattggattggtatgactgtaatgtgtcctgtcaggttctgttaattggttctaaggtaaagcctcgtcaatcagttatcacataattattgtaataatgaccttacatgattatatcagaaataaaggcaaaactatatactttcaactatctttcaacatacttaaaacaaccttgagtaattttagtgatattttgcttagaaaaggtaaaattcttgaaaggctttaaaaataggatgaataaatttaattatatgactcaaaacagtcgagctgggaccaatgggttaaagctatatgatattaggtattaattttaaaaaagtaaatgacaattagctgttcagaaaacatggcacaagccattaagtcagtttttttttttttttttttcctggagatggagtcttgccctgttgcccaggctagtgcagtggcacaatcttggctcactgcaacctccaccttccaggttcaagtgattctcatgcctcagcctcccaagtagctgggattacaggcatgcgccaccacgcccagctaatttttgtatttttagtagagacggggtttcaccatgttggccaggttggcctcgaactcctgacctggtgatctgcccacctcggcctcccaaagtgctgggattacaggcgtgagccactgcacctggccgtaagtcaattatttttcagagatgttgagtttctacaatgacttgactagttgagacctaatccaatcccagctttgtgtcagaaatcaagacatctatttttttctttctaggtgatgccactgttacaatatctcatcgatatactcccaaagagcagttgaagaaacatacaattcttgcagatattgtaatatctgctgcaggtaagaacacaagggggatggagggaaggacttcacctcagaagaggaggttgtacccctcatcttagaattcgcctgcctagctgctattcatcattccccttgtaatgattctttgagctgcctacaaagatgaggatagagttgtgattggaataccggtttctggcagtccattatagtctagatgggtgaatgttattcctaaagcttcaaaatatttatattaatatttactgtataaagtttaaatggttccttttgtttcctgtcaggagccaaaataaaaaaataataaaagtaaatagttccttagttaatatttttaacaggttttaataaaacatgttgattagttcttcagggtctcttgaaattgaagttagacaagaatctgacaggtagactgttttcagtactaagttgatctttcctttctccatttccaggtattccaaatctgatcacagcagatatgatcaaggaaggagcagcagtcattgatgtgggaataaatagagttcacgatcctgtaactgccaaacccaagttggttggagatgtggattttgaaggtaaatggtgaaattttatttttaaaaatgaaatcaataaatactacctttcatggacatttaggatagattatttacttttttttttttttttttttttgagatgggagtctcactctgttgcccaggctggagtgcagtggcgcgatctcggctcactgcaacctctgcctcctgggttcaa

SEQ ID NO: 14192 - DNA, 7515 bp, Human
gggaggctgaggcagaattgcttgaatccaggaggcagaggttgcagtgagccaagatcgcaccactgcactctagcctgggcaaaaagaccaaaactgttgtctcaaaaaagaaaaggaaattaggttcttaaaggcatcttcccagacgtgagagtgtctgcttttgcctggtatagtagtgcctgcaaatgttcaaggaaataaacaggtacccctgttaagcctataggtaacttctcattgctccccatcttctctgtactcagcactttttttttttgttttgtttttgagacagcacctctctgttgcccaggctggagtgcagtggctgaatcatgggtcactgcaatctcaaacctatgggttcaggcaatcctcctgcctccgaagtagctgggactgcaggtgcgcaccaccacacctggatagttcaaaataaaacttttttttgtagagacagggtctcactatgtcttccaggctggtcgtgaattcctgacctcaagtaatcctccctctttgaccttccaaagtgctgggattacaagtgtgaaccactgcacccgccgtggcactttttttttttttttttttttttgagatggagtctcactctgtcacccaggctgggtgcagtggcgtgaactcagctcactgcaacctccacctcccggattcaagcgattctcctgcctcagcctcctgagtagctgggattacaggcacccgccaccacacctgaaaaatttttgtaattttttttttcttttttgagacggagttttgctcttgttgcccaggctgtagtgcaatggcactctctcggctaattgcaacctctgcctcccgggttcaagcgattctcctgcctcagcctcctgagtagctgggattacaggcatgcgccaccacgcccagctaattttgtatttttagtagagatgcggtttctccatgttggtcaggctcgtctcgaactcccgacctcaggtgatccgcacatctcggcctcccaaagtgcaggcgtgagtcaccggacccaggtcccgccctggcactttttaaccacccacaaatctggatcctacactgaaaagagacactgcagtggctcacgtctgtaatcccagcactttgggaggccaaggcgggcggatcacctgaggtcgcgagtttgagaccagcctgaccaacatggagaaaccccgtctctactaaaaatacaaaagtggccaggcatggtgtcgcacacttgtaatcgcagctactcgggaggctgaggcaggagaattgcttgaacccaggaggcggaggttgcggtgagccgagatcgcgccattgcactacagcctgggcaacgagagcgaaactccgtctcaaaaaaaaaaaaaaaaaaaatcctgagtcccgcttgacaccttttgtcaggcaccaccacctttctgggcgaatgcggtagtaccgtctgctctccctgctgctgtcctgaaatccattcaggcacagcggccgagagctttataataaccgattccaggtgttaggtgctttcccagccccgactcctgcgtcctggacccgcagtcctctgcttaatacctttgctttattagaaaacattctcctctactccgttcagctattcgctgagggcccgccaaccgccagcggttgtcagtggcctagaggcagcggacgcaaacacggggagaggtgcaatcgtctcaagtgactcggcgggcggggcccacaaccggaagcgggtgggcgaccttcacccacgtgcgctgcggcttcgttcgccagcatccaagatggcggcagggcggggcccaaggcgcggcgcgaattgtgacgcaggcgtccggcgtgctccgtgcgcaagcgctttcggcggcgattaggtggtttccggttccgctatcttctttttcttcagcgaggcggccgagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagaggtcctcggggcagatccgagttaatgagagaggggtattgagcgtgtagcgttaactctgccagtcactgcgtcagtcgctttggaaatactaaatttctcgagctgagtcttcatacctggctccattactacgtctgtaaggaggagctggtggtagtgtctgctttttagacttttctttagactatttgtatttttttcagatggagtcttgctctgtcgcctaagctggagttcagtggtgcggtctcggctcactgcaatctccacctcccgggctcgagcgattcttctgcctcagcctcccgagtagctgggattataggcgcctgccaccacgcccagttgatttttgtagttttagtagagacggagtttcaccatgttagccaggctcatcttgaactcttgacctcaaatgatccgtctgcctcggccttccaaagtgctgggattacaggcatgagcccctgcgcccggtcgattctttgtctttttaagtcaacttttatatgtgaacaatgcttggcaggtggttggtagatactaagtgatgttcgtggtttggggtcaaggcaagaagtggggtctggagagttttggtgtaattgagaaggaagctaagagtgttgggtgctccagcttggagttagagaggagagaggctgcgacaggaaggcatgtgtgttgtaggggatggcttcccatccaggctggcagcaggagcagcctgtgcagatcaggacctggctgccgtggaagagggtgggaccgccttcagggaagatggatctagcaagatgatgccaaagggtacttattccatcaggagatactgacgagtccttccgccgctaaacctaaggagaataaccacagtctgtgttcctgaagagcacccgtgcggtcaggagggtggaggacatgtggtctttagttccaggacatgtttagactacaggccagggtgtgtgagaagcctagcagggccaggcttggaggagtgaaaggaagacaggtactggggcaggaccagttggacttggtgcaggcaaagggatagcaactgtggtgtaggcacctgagcttgtgctactcaggcatgcattgctcaccagtctatcctgcctcccttcctcctgcagacgcaaacatgcagatctttgtgaagaccctcactggcaaaaccatcacccttgaggtcgagcccagtgacaccattgagaatgtcaaagccaaaattcaagacaaggagggtgagtagggctgggtgtgggggctctggctgtgaactgggagtccctctctgcccaggggagtctcagtcctgtgtgggttgtgctgactttagatctgttttgcccttgcttctccatgtgatctgaagaacgtttgttatcttctacctcagttggccttttgagaaactgggggtagtgctggagctcccctgcagaggacactgccagtaatatggtccgcagagcctctaactgagcctccctccccctcaggtatcccacctgaccagcagcgtctgatatttgccggcaaacagctggaggatggccgcactctctcagactacaacatccagaaaggtaccggggttggggttgctgggcagggacccaagatccccaggtcctaggaaaggagcattgatggcctcaggggttggggagcagttcaaatgacttgtgttttgtttaaaataatgggactgggcacagtggctcatgcctgtaatcccggcactttgggaggcttaggcgggtggatcacctgaggtcaggagttcaagaccagcctggacaacgtggtgaaatcccgtttctattaaaaatacaaaaatcagctgggtgcagtggctcaggcctgtaatcccagcacttcgggaggctgaggcgggcagatcacaaggtcaagagattgagatcatcatgaccaacatggtgaaatcccatctctactaaaaatacaaaaattagctaggcatggtggtgcgtgcctgtagtcccagctactcaggaggctgaggaaggagaattgcttgaactcgggagacaaaaaaaaaaagtcataatgtgaatttttttatcactgcaataaggaaattagtgtcacttgtgggagcgacaagaattcagtgtcctttttttgtgagacagagtcttactctgtcacccaggctggagtgcagtgacgcgatctcactgtgacctccgtctcccgggttcaagcgattcccctgcctcagcctcccgagtagctgggattacaggcacccgccaccacgcccagctaattttttttgtatttttagtagagacagggtttcactacgttggccaggctggtctcttaaagtgctaggattacaggcgtgagccatggtgccccgcctagacttcagtgtctgaccttgcctgaaccacttagaggtcggcttccatgttagaaacccagatggatgcctcagttggcatgtgtcagtctcagactccccccagggctcgtggtcagtgctgagatggagatttcctggggcaggctggctgggacagtgtatcttccacacgtagaacactcgggggatcccgacttggtgtccccatcacacttgagaaagcagcagactataggccctggagggtcctgcccctgtgactgaggagccagggctgggctcagtcgccgtccttctggctgtctcctgcagagtccaccctgcacctggtgttgcgcctgcgaggtggcattattgagccttctctccgccagcttgcccagaaatacaactgcgacaagatgatctgccgcaagtatgtgtgctccgatgcttggggggctgtgggggctgccggagtcggggtatgccctcacccacccctcctgtctctgtgcaggtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattacaagcaagaactgccatgcctgacccagttctcagttttttgtttgtttgtttgtttgtttgttttgagacggagtcttgctctgtcgcccaggctggagtgcagtggcgcagtctcggcttactacaacctctgcctccggggttcacatccttctcctgcctcagcctcccgagtagctgggactacaggtgcccgccacaactcctggctaattttttgtatttttagtagagacggggtttcactgggttagccaggttggtctcgatctcctgaccttgtgatccattcgccttggcctcccagaatgctggtattacaggcgtgagccagcacgcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttaaaagcctcctgtttagttttggttttttatcactttttttttttttttttgagatggagccttgctcccatcgtgcaggctggagtgcggtggcgcagtctcggctcactgcagcttctgcctctcgggttcaagcgattctcctttctcagcctcttgagtagctggaattaccagtgtgcgccaccaccaccacgcctggctagtttttctgtttttagtagagacagggttttgctatgttggccaggctggtcttgaactactgacctcttgtgatctacctgtcttggccttccaaagtgctaggattacaagcgtaagccacagcgcctggccttgctacatttttttttttttttttttttttacagacatggtctcgctatgttgcccagaatggttttgcactgggtccaagcagttctgccgcagcctcccaaagtgctgggattacaggggtgaggcaccttgctggcccctgttttgattagggtgcagtgctggtgaagccggtgcacgaggccagtgatgcatcctaatgaggggtggagttggcgggacttcctgggccagtttggggactttcacaaaagacccccatgactcagggttttgagttcttaactgatcgaatgaaggattcaaaattaaccactccaaggggggattgaaggaagaaccactcttaatggacaaaaagaaagaaaggggagggagtaacagggatatgagctctagccgcccaagctagcaatggcaacccttctgggtccccttccagcatgtggaagctttcctttcgcttcattc

SEQ ID NO: 14193 - DNA, 247781 bp, Human
  misc_feature (1)...(247781): n = A,T,C or G
tgagtgggtggatgtatagatgggtggttggatggtgggtgggtatatatatgtatgtatgtgtgtgggtgggtggatggatggatggatggatgggtggatggataggtgggtgggtggatggatgagtgggtggttggatggatagaagaatgggtgagtgggtgggtgggtgggtggactgacggatgggtgcgtcagtgggtggatggatggatggatggacaggtaggtgaatgggtagatgaatggatgagtgggtggtgcataggtgggtgaatggatggatggatgaatgggtgggtggctggctggataggtggtgagtgggtgggtaggtggatagatgaatggatgggtgatgggtagaaagatagatgaatggatgggtgaatgggtggatagatggattgatgggtggatggacaggtgggtgaatggatggatgaatggatgagtagtgagtgggtgggtgggtgaatggatgaatggatgggtgagtgcatgaaaagatggatgaatagatgggtgaatgggtacatggatggatgaatggatgaattggtgggtgggtggatggatggatgggtgggcaggtgatggtgaatggaagtgtgaaagcaactagcacatatgaaagcacctgacacctaatggatacccaacttgtgtgtttccctttcctgtgctttctttcccatctcagcttcacctttctgggaatatagaaagaggtgaccctgtcatctagtggcagacatgaaagctctgaaccatcatgggttggggataaggagatgggctaaggggctgtgtgacagctccactattcccactcccacaaacatcctcaggttcccctgtgctgtgttgtctcatgttttcttcttcaacattgccctgatgtacattttaacccaacatcacctgactttaaaagattggagcttcccacgtcctgtgatttgtttgtggttcacaaccccaaggcagctgcctccctaaaccaattttatggcacaaaaatgggcaggaagggaaggacgaatctgcctctgagatgctgatgaaatctgacccctgcactcctttcccacgccgcggcgtgatctgggccttcatccacacgtgagctggtggttcttccgggtacctcagaaacacctggaaattgtctacgatgcacatttccaagcttcatagccagatgatctgtttcagtaggtctgggtagggcccagaattctacagtttttaattttgcatcctcaaactgcttcacagtgaggctggcactccctacatgcccaggggattgtgatggaatgaatgggagcccagggtactgatatggcctgatggctccctgcagagcttcccatctggccctgctcccgatggccctgccttggaggaaccttccagctggctaggcaggaggaggtgggcctttgtgggcaacatccctcctccagaatgtgggtgagcctggaacaccccctcaccactgctcccacatgcacacaccagagctccctctgactcgcagaggaggggaaaatgggtctaggggttctgagccgagtgcccacttgggggctgtggacaggcccgccgcactctggagggcctatgcccgaatgcaatgtggatgggtgtttcgtggctccagtgagggatggctgaggcttctgcagaggcgagcagtggagcatgaaggcatccaggcagcctttgcctggtgggggccattaaggctctgcacttgggatgggggtgtgggagaaagcaattagtggcgagggacgtgcatgaatcagcacagagtcggctggctctaattgagccaacaagtttgtcctgttcgctctgggctcccagggatgggagctgcatccttaaatgcaaagcccttcttcaaggtggcaggggaggaagaagattgtcttctgccccttgaggaaagagaggggctctttccattctccactcccacccagtgcctgcctccatccgcaaagtgctgattttctctgctgaaatgttcgacgtctttggacagaaggttttattttctcaagaaagagatttcacatttctggatcggtgtatgtgagcaggttgcctctgtctgggctgctcttaagggatcttcaccgtctccatttctttgtggctgcatttttgctctgtcttttggaggaactcggctagtaccctccccaagaccaagtctgctgtcttcagggcttgttcctgcagaatcggagcgcggttttccaggagctgtgctttatccccttctcttttggccctgacattgtttccctttagatggagacactatgaattctcttctgggagagcacaataaaatgtcaactgattaactaaataaaatgtttcaaaaaatatgaaatttttccactagtctaatatttacatgttcatgggggaactttgatgcagaaaaaaaaaaatcctgtaatccccagtagcttggtgctgtcgcggtagagcaggtcgtggagttgctaatttggcctgggtgtccccacttggttccaccacagagggggcagcattatcttccacctacttgtgagatctactggttccaaactttccaaatccccaaaccaatgacttatttttctctcttttctatttctgtttcctaggaacgagtggaatatctctttctcataatttttacggtggaagcgtttttaaaagtaatcgcctatggactcctctttcaccccaatgcctacctccgcaacggctggaacctactagattttataattgtggttgtggggtaagtatcactgtctgtttctttccctttatcttaccagtgttgcgggacttttccttaagtcagctgaagacagggtcgttgtcagacggccacaaagatttaggctcgcagatgatctagagtgagaaaaatgagatttattttgctaaaaggaacagaaagggaaagagagactcagcaaagtgagagagtgcgcttcctgcccatgggcttcccgcctcgcaggttgaatccaaggttctacccaggaaaaggaggggtcaggcttctccctgctgcagttggtggcgtgaacttccgtggttccaccctagtgtgcactcctcccagtgcgcaggctggctggagtttctctggggacccctccccacctggctgtctcaccagtacatccctcttcttccttctgtgttatctcttttcaatttggtcctaactatgctgggcttcaggcaagaagaaaggatctgtgaaaatcactttgaattcagacttccccagagggacaggggctatgacccaagagcacccctctccaccactcccacacagcatgcacacacggttggacctgagtgctcctgatggaacccaggctgctctgtgccgctgtaggatatccccctgcttaaggactttcgtttcatctcagaccacatctggccccgcagttcctctgatagtttccctgctgtatcactgagcacatttggggcagctcgtccgtgagcatgcagtctgcaggtgtggggtgagggtggggcgcacacaggctgtgcctgtgctctggacttgtacagaggcctcttccccattctcactctacagggggcctggttctgtggccccagaaaaccagactgctcaagacaggtggatgagaaggaaacagggaactatgaaaggcgaagatgacaggtaaccaaaccccaatcaaatgcagcttcccccagacaccctgctccactgtagcataagataaggtagagtcagtctaggctttcaaaacagcaatgcaaagaatcttaaataaaatgtagaagagatctccttataaataagttattaacctcacaaaaagaatctccataaaatatttgtacctaacaggcctacctacactggtgaagtgtaagttattaaaatgcaggtgaggtcaggcgcggtggctcacacctgtaatcccagcactttgggaggccaaggcgggcggatcacgaggtcaggagatcgagaccatcctggctaacacggtgaaaccccgtctctactaaaaatacaaaaacttagccgggcgaggtggcgggcgcctgtagtcccagctactcgggaggctgaggcaggagaatggcgtgaacccgggaggcggagcttacagtgagccgagatcatgccactgcactccagcctgggcaacagagcgagactccatctcaaaaaaaaaaaaaaaaaaaaaaaaacgcaggtgatgaagttccatcaacacatctgtcttgtaataggagggagcccattgcagcagattttaccttgagaagaagccggttcctttgggctaatcccttgttactctgagcccagtgagtgctcaagtggctgccaccttggactctccctctcttgaagtcctggcagtctgcagagtcaaggtcagaatgtcaggagctctttatcccagaggcctatttttggaggatccttttgtgccatcccggaggagacacagccattgtggacgtctccagagcacccgccgttcaccatcttgtgagagtgcctggtctttactgcaggaaatgacgcaggaggacgtcgagatcatttgcaagttatttccttgtctctggccatctggatggctcataaggttgcttggaaccacgttagggtttttgttgttgttgttgttgccttattttgcctggccaatgaatgacgcactttggccacatgaacctcaggaatatttgggtgatacgaggtgcactaaggttattagcatcattagccaggtctagctctggctcatagcactcggggtgtgcatgcagctataggagagattttgctgcttctgctcatgccagaataaacaaagagtggctaaacgcatgccttgaatgactcagtaaaccatagcaaaagtccttaaggtgggttgttccaaatgcccctaaatcctttttagaatttggcatctttctcaaggcctcagtctcctgggagtcttttgcacatgcatagaaaagagccttgggaatgatgagagcagatgcttctgggaccagtggagggatgagggtgacttgcagggacgaattttgtttaggcaaaattttggaattttgaagtgagttggagttgattatatgtgctttgccccatatgtggtcttaatgaaatcatgagtcgggggagcagagacaagaaatacagggtgagtaggcaccgaacaggagccctgggagggaggggccctgcctgggttgacagggaggcagtgcagtggtgcatctctggcccacacctggtgcctcacctgcggtctgtctggacccgcttcatcccttagactcctccacacaaccacaaggggccaggctttttctggggtcagcccagattccagtcacatctccctagggcctaggccatgaggctggtgaagagagggaggcatccagttgtgtgctcctgtttctaagccacagaggttaagatgccagcagttgcccagctcgtggttggtcttgcactgggacatatttggcacctagtctctcttctcctaagggctcttcatcctgtctaaatcagcccattcttgtaacaatcccccatcgctgcagggtgcagcttaccacctctcttcagctcatctcctttttctgcttcctttgcaatattaaatgggtagccctttgcttccctgtgtctcttggaaaatatctgctatccttggcccctcttctgtagctgtaggggaaggtttctcctggcctcccacaaagctgggggagcctaactcaccctagagaaaggtggacctgcctgcctactgcctgagtgccaggctgagagcctcatctctgcattgctattctggtggcacaagacacgtggcatttctttccttcctaaagcagaggcctcttggtggtgggattgctgaataaacacagagggactgtggcggcctcagatccacgtgcccctaccgagggaccgtggaatcctcagtggatcctcaggaggttccacgccagccagtgaggctttgttgcatccctacctccctagcagggtggaggccctgcctttcccattctctgggcctcacgatcattccacagcctcacggtccttttcttctaaaagctccactgccggactacagatctgccagacacagctcccagagcagtccttcggccaggcgtccacaccagagcccaaccctcagggaccagtgggcaccaagcagtggttttgcctttagaatgtctcattgaggagaaatacaccagccactcctacacccatgtttgaattttctaccctttcagaattaaaagcggatacttaataaagagtctcaacttgaggcaggagttaaaggcaagttgtctaatctccactcccttcaccgaatagtattttgtgaacctcttttactccgatcagcatattactttcctgcaggaaatactgggaacaaaatctggtttgcatttggaatgttgtttgacaaatttgcaaactggtctccatttcctcaggtttcagtgatctaggcttcagtggaaagaacatttcccttgtggagaaagaagcccactcccccatcctggcaacttctgcctgggattcaaggcctcaccagctaacataggaagccatcaagttgccaggctgagagacactgcagatacggcctggacagggttctcaaacttcgttcggctgcagaacccactgttgagagtctcgctcagaggtccaagacacagaccagatagaagggaagctcctctggactagaggagccagaacgccagtcacgcagccagtctgtgcctgggggcctccatggagcgtttctagaccaatcccctcatcgctcagccctgcctggccctgaacttctgctaatgcatctggctaatcccccagctgcagcttcccatttctagatccagatacctggggcataagtcacttaagagctcaagcctattgctcctgaatgaaagctgccctggttcatagtttagatctgatatggagacccactcctaatacctgggctccctccttgatcccacgcccctctgttgaagaaacacgacccagcgtgtagtgcactctgtggcaatgaatctgtagcatcctctctgggtataaaggacagaaatcaccctgcacgcccttttccctatttttcttggttgccacgaaaagcccaaaattattgagtcatccctcatcacccggactcctgttcccatggggctttgtgcatcctctgatctaatccctcctttctcaccaccccgctgcagaaaccttcccactgtgccctcccatccccatagtccctcgcctgttcagggtcagccaacttttctgtaagggccggatgctggttttcatctttgcaagccatgcagtctctgttccagctactccaccctgcccagcagcaggacaagagtggcatctccatgagtgggtgtaactgaattccaacaaaactttgcaaaacaggtggcccagttctcagcttcctttctggtcacttcctgattctccctgagggtgcagctttctctgctgtctctcagcaggcagccacttcctctcccagaagcctccttccactgcaccaggttgccaggtctaagggggccctgccagctcctgatttctgctccactgcacccccacctccctggagccctccagttttgacatttgtgtcatcagatcctctatgccttacttctctttactgcagccttctgcagacctttgagtcacccctccttgtgccttgaggacaagggctcttggttcgctctacttcactccgacactcacttctccaccttcctgcagtagcttcttggttcttggatatctggcttctggggaacctatctcagtagtcccaatcccatggctatagccaatatccctgtcaccactgattaacacctcccccataatcccaaatctaacatcctaccctctaaccagcaccaccgtctttccggtcccctccctctctcaccctgactcccacgatcccttcgtcccaccgcactcttcatccctgccaccatgtccaccctccttccagccagctcagacgccatgtgccactgctgccctcactcacttgcatttatgctcagcattcttagtcttctgtctgtttatcttgcacacctggaaaaacaccaaccctaatcaagtccaaccagagatctgcttggtacctggaaagggtcaagaaatctgcaaagttgagcagactctcactttacactcatgacctccaacctcaaggaggccctcggtgacacctgagggccctcctgctttgtccgcactccattcacccttctgctttctgagctaattctttcagcacccgtgcctctctcgtcacacttcccgtctccttcccctttcacgttttcagctgatggcctcgttccccagttcccttagaaagatgcaatcagaagaaactttcatgtattcccacaaccacgcgtctatgctgacaatgcgccttctcactgaaccacgacccacggcgctgcccctgcacaggtggacgcccttcgcatgcacccatccccttcttgccagtgaaggagctccgtcccacacggccctgcccctgcacgggtggcaccctttctgtgcacccatccccttcttgccagtgaaggagctccgtccttccagcaatggttccctctcgcttctatgtcatcacattttctgcctctgttagatgattcccatcacatagaaaactgctgtcatatctcccattcagaaacaaaaccctcttgactccacgcccacttctagtaaccccctttttttctctgctcatttagagcaaaatttcccaaaagacttgtctatacggtagccacacgtggccattcagcacttgaaatgtggctaatctgcattgcaataataataattataagtataaaacatacagcatatttcaaagatttagtacaaaacaaggaatgacaaatgtctcatgaatgattttttatatttattacatgttgagatgataatattttggctatgtcgggtgaaataaaatctatgatcactgttaatttcacctgtttttactttttaatgtggctcctagcaaaggtaaattacacatgcagcccacacttgtggcttgcatcagatttctgttggccagggctgtctatcctcacggcctcccactcctcccatgctctcttgaacctatgtctgctgggtgtttgtccacatcactccaccaacacagatgccttcaaggtctggatggtcttggtgttgctaaacccagcggtcggtgtccagccatgtctctgcagcacgtgacaccaccgcctgttcactgaccgctctcttcatggggcgccgttctctccatgtccctgctctgcaagccatccctcatcagtctgttttgttgctttctcctctcttgacccctcaatgtgggagcactgcagggttgagtgctttcacatcctcaccttctgcactggcctcctaggtagtcacatacaatttgactttaaatatgaactatacaactgctgcgcttttgtctccagcttggacctccccactgacctccagacacagtagaaccaactcaagacatgcattcgatgtccaagcaacaactcaaacttcaagaagttctcagcagaacgcttaatgtccattccgccatatctcatcattcctgttgctcatgcccaaactgttggaatcttctctgattcccctctctttctcacacctcacatctagtccatcagccagtcccactaactttatcttaaggtaaatctggtatctaacttttcctcactacctctaacaccaccacttgttctgagccacccagtgtctcgcgcctggatgactgccgcagctggtctctggcctcgcccccgacaggggagtctcccacaacagcagaatgattcttttagacctgtagttagatcatgtcactctcctgctcaaagtcccccaatggcttctgtctcagagaggataccagcacccggtggggttccctatttcctctccgacttcctctcccacagttctcccctttccctgccctgctccagccacactggtcgctgctgttcctctaacgcacaccctgcccctcccttgggcccctggcttacctgcttcctctgcctggaacagtctccagatagtgaagtgggtcccgccctcacttcccataggcctctgctcaagtgtcacctgcagggagttctttgtgcagatttctcaggtgggaaggaaggcggccctcaccctgtctctgcagagcccctccccgctcctcctcctcagcactcatcactctaagctgcagtgtctgtttactgattgctcagtttattgtctgtctccctgctagaatgcaagttccatgaggggaagggctttgtccattttgctatagccccagtgtctggaacagtgcccggcacaccgcaggtgttcttgtttgttggaggagtgaatatgccagctcagacctaaagtggcagggctgaaagccctgtgtctcagttacgtgcacgtgtggttctaccccacttgagaccttcttgtttaaccactcaaccattcattcatttgcgcagcacgcacctcctgagcagccaccaaggccagcacaaaggagatttccatgggccaggaacaagtcaaagagggggggtatctagaaggaaggaggtggggaaacagagcacatggttgctggcacacctgggaggggcgctaggataccatggagaagccggagggctcctcaaggagataaggactggcaacagacttcacctgcttcccacgtttgtccagcgcttgtccagctcctgcctttatgacggcagagggcctgcccctcagctcgctcaggcctccctgggccatggtggcaccctgggcatggccaccacccacactgaggggatgtcagcttacaaccacccacagactccacgcacacccacaacgcccgcccctgggctggagacgcctgcgcaatctgcttttccgggctgtatccagaggtcagagccccagctgggcaaaagaaaacccagtcctgacagtccttctctctttcctctcttctaggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtaagtgaagcccgttcttgtgtacagtgttatctcctcaccaccttctgctgtcctttgctgaattgccaagaacactctgcaaagggacctgattccatataaatggaggggtttttgtttttgttttaaaatgagttcctttgatctgaagagcccaactcggatgtaagtgccttaaaacacactgtggtcccagcgcctggaaactcctggagaaagttcacagcagtcactcagccacatgaatcctacataaaggaagtggccatctgagccaccctggaggccctgggatggggatttaaatacattttgtagcagaagagccaggtggctaatctccgaggctccagagcactttagccaatgagattatctctactttctgtgtttttccaaagaacaatcaggaaagcatcagtggatgttctaaaagttctgttttgacctttctcccagccctctcctcccttcctgtcaaatggggcagcccaggcctcaggagccctactggaaataccacgcctgtcattgtgagaacttatttttcccaaagagaggaggatattccgctctctgaatcaggggaagggtttggagaggtattgcctatccggatgtcagtcacatggacaatgcctcttctgccacttctccagaagcctggcccattatgggtgcaccccaggtactgaacacagtggcttcaggccccctgggaaggcgcaagcaaaccccagcccaaggtgctcctgggagctcagtccactttagaactcctttctactcttccctcttcagtttgtggtatctgagaacaattctggactcatttgcttaaattttgctttcagttcagctccagtagatttggcccatgactcaagacataggagacccctcagactaggctaggaccagatgagtttggagatggtgtaagggacaggaagacagaggacctccgaatgcacagcctctcctacccatggcatgcactgagcacttggttaccggtgtgctgctgggtggtatcatctggagtcatgaaaccgtggaaatgtgagggactttatattaaccagtttactttttgttcatgcacggaatagtgaaaagatcttcctgtgactttaattaactagcaatagagccaagactagaatcatgtctcctgatttctagaccagctctttcctgccatacagcactgcctcttttaaagaattaagtggtatatctctcttgattgtcttggattctttttctttcttttttttttttttttttttgagacagagtcacactctgtccccaggctggagtacagtggcacaatctcagctcactgcaacctccgcctcccaggttcaagcgattctcctgcctcagcctcctgagtacctgggactacaggtgcttgccaccatgcccagctaatttttgtttttttgtgtgtgtttttttttttttttttttgtatttttagtagagacggtgtttcaccatgttagctaggatggtttcaatctcctgacctcatgatctgcctgccttggcctcccaaagtgctgagattaccggcatgagccactgcgcccggccaattgtcttggatttttacacatatatcctgtctcttaaactacactataagccccttgaaacccagaactgtgccttctattgcctctgattcccacacaacataagcaaagggaacttactgaataagcaaaagaaagagtttgttttctttgcagtgggactccctgggcaaagcttgtggcctgtcttaggctcaaaaggcacgcagagctgagcacacaagcacaattaaagcagactttctctactcggccttaactgtctgggggtacttaggtatagaaactgcatatatcgtggccaggacccacttctttttgaagcctaaattatttgggttttcctggtcaatcagccagaactcaatagccaaaatcaggaagtaggaagggaggatgacagtgactttgaacatgactttaaggagcttgtaatggtaccgccagtgtgtcagtgatagcaactgggagttaattccagatgccagccaaccaagcgaaatggacacaatgaccccgacctgttatctatgtatttattaggggcctgcaatttttattaggggtattaggacgtatcataaagaacaagcatggtcctttcactagagaaatttgacagtctaagaaaagagtataacagtcagcttttgctgtggaaataaaccatctcaaactctgcatggcttacaaccagcaacatttacacctggctcatggcacctgagggtggtggtcagctgcagctcttctgcactcagctggactctgggcttgaccacattctgcgtgccatccaattctggagcccaggtcgaaggagccctcaccttcggtggtaggccttgtggttgtcatggctgggggaggtgctcacaaaatggggcttagagccaaaccgcactagcaacttaaggcttatgcttagatgtggcttctgtcttagctgttcacattccactggccaaagcgagtcacatggccaccctcaaagataatggggccaagaagtgtgctgtacctgcagagaagcatgggtgaacgattgagaacacatagcagcctaccacaaagagactgaggagatgattgttatcaacagctgtagctacagtaattgctctagtacagagattcttaattagagatgaatatggttgagagccactcatgctacagtgcattaaaaggaagaattagattagatcgggtcacttggtttccactacagaggaaatttcccgaggacggagccctgtctccatctgcacttaagtaaggtagacgtgtcttgtagtggtcaggaagcagtaacactcctaggaattctctcaagaggatgcaggcctcaaatgcaaggccctcatgttacctgccgtgcagtccaggaaaatattttcgccattagagatgatgacactgagatggatttgctgttgtgggtgccttgtaggtagctccatgcttatgcataggagcagcaacggtgtctggtttcctttgggtcaccagtaaaatggtggctcttcctcagctcatccagccttctgccctttcttgctggaatagtgtctgtgcagcttttgaaacagggaaccatgcagaccatggtggatcagtgcactgtaccagtgtggttggtgtcatctacaaagatgtcagcagtatctcccctgactacaaacctagacaaatgcctccgtcttctacttctcatagccataggttatctctttctgtatttcagcaaaactcctcaagagttgcctctacctgttgtctgtgattcttgtcctcccattctctcttgaatccactctgatggggctttcttccccactgctgcaccaaaacatctcctgtccagaccatcagtgatcaccgttaccgcacccagtgctctgtcctccagggccatgttacatgatctgttggcagctttggatacagctgatcgctccttgtctttgaaccaccgttgcccttggcccttggcacactgctctttcttagctctgcccttcattcacttgtttcttcttcttggaatcctttgctgacttctgtctcatcttctcaccctcttaacattgggaagctccaggggtagatcctgagacctctcctctgtctgtactcactccctagttatcacgtccagcctcctggtgttaaatataatctatgtatcttccagtaaccagcagctgtgtgtcaccagcccagaccttttttccaaacctcagacttgtatccctacctgccgactccgttcctctcctgtctgaatagataataagtatcttgcacttagcaagactcatggcagaactcacagtcttcccagagtctttctcagcttggtaaatgctagcctcatccttctagcttctcaggccttattggacttatttctttttctcactctttgattacaatccatcagaaaatcctatgagctttaccttccaaacatgtcaagaatttgtctcttaccacctgcacactcagctcagcgctggccgccctcgcctccgtcctggatgatggcgacagcctcctgcaggagtctctgcctcaacccctatcatggcccggacctaacacggcattcaaacggccctctgaacagccaagtcggatcatgttcctgccctgctcaggaccctccacggcttccctgacttgcccagagtgagcgccaaagtcccataggccctgcgatctcacgcctccttcctccctaagctcacccccttcaccctcccctcctctccctcctcaccagccctccacagtgactcccttgctattcctccaacattccaagctcaccccactgtggggtggtggccggcacttgctccttctgtctgaacgccctcggctcagctctctgcacaggcctgcgcacctccttggcccccacctcggctcagctctccatacaggcctgcacacttcctcggcaccccctcggctcagctctcatacaggcctgcgcacctcctcggcccgccccttggctcagctctctgcacaggcctgcgtacctcctcggcccccgctgatgccatcccctcactccccgttcatccacccttccctgctccatttccccacatcacctctcaccatctgccattctgtatgtgtatgtgttcatttgcttatcaccccttacctcatgagaatgtaacctacgtgaggctaacaatttttgttagttgtgttcacagctgtgtcctcagcaccgacaataaaggtgataaatatctgtagaatgagcaaacatggttacacggacgcccatggcggctggcatagcttcacatcacaggccctaagagccaccccacccactaaaatgatgtgagtggtgccagcttcctggacatgtgcctttgctggcttttccaaagggtctttacttcttctgtctcatttgatcttcatgacaattgggtgatattaagaaatgtacataggcaatatatagatatgtagggtttttcttacaacaaataggttcattgggccatttttgacatctgcaattctagaccaatagtgttagaggccccaaaagttgcattttttttttttttttttttgagacggagtcttgctctgtcgcccaggctggagtgcagtggtgtgatctcggctcactgtaagctccgcctcctgggttcacgccattctcctgcttcagcctcccgagtagctgggactataggcacccgccaccacgcccggctaatttttgtatttttagtagagacggggtttcaccggttagccaggatggtctcgatctcctgacctcgtgatctgcccgcctcagcctcccaaagtgctgggattacaggcgtgagccaccgcacccggcctaaaagttgcattttttaaatgcacatatatgtactaaatgtcattgaaatcttatgatcacaggttatggaaatagatgattgcgagggtacaagtccatgagtcatttatcaatttgttcaacaaaatcgactgagtacttactttatgtaagattttgttagccattatagcagatacagaagtgagtcagatgctaagtgtgttctagagagcttgaagtgtagtagaagaaaaaatattcataaaaatgattatataaataaaaattggagctgtcaaaaaggaaagtttaggtaagatgtgcaatgtgatgaattctgtgacaagccatgcattggggacaccatactttggggagtggtgatagagaatcaggagagccttcttggagaaggtagcatttgggatggaacttgaaggatgagtgaggagaggcattccaggaaatcacacaaaggaaggagagtggccgtggccctggagatgcacactgtgaggctgcaaggctaacggcttgattacactgcagaggtgaaaatcagattggctcttccaatggggttctgtgtagttgaaagatttggccatttggcttcatagagactcttctacagtaacagaatcagttctctctgctgtgagcatccactctcccactgcagccgtgctgtggagcatgcgtattacaccaaagactaagccatatggaggaatcaacgttatacagccagatgaaccatagggagagttgtggttaaatatttgcaatgtatatgcaaggagtacatttgcttgtgaagcagtaagcaaggggtcgtttcctgctttccatttcatctcatatgccttctggagaagaactttcaggagggacttgataaagggagaagtcaaatggagatgagaaagatgtgtagggtctttgacgaaaactcagagcaacctagacttgatctgatgatgaaaggaactgaaaaatcacctttctgtaagaccagcactagccttggaagacactcatcatgaatgtttattgagcactctctgtgagccaagcacaaagctaggtgcggggacagaggtagatagtgcactcccatcagtcaaatcagaacacctgtccagttttcataaggaccatccggttttagatctggacctcccagtccagacttgataagagaacatctttctagagcagatagtcaaaatcatgtaacttagtccctgaaactgacatattttggagttcagagaatatctccgaatcagagcagaggctcaagcccacactgcttcactctttatcctttgctttttccactgcctgtgtcctcatcgtcccagacttccctttaatcctggttaatgtgattttgatttagtcctaatggaatgctttaaggacttttcgtgggatacgtttttcctagtatgtgagtctttacaagattagatctttcaggatgtcccttttgtcagtaaaatgttatatctggaagcacacagaatagaaaacagctcgctattaaacggaagtttactttcatcctgagaggtgagaaggagcactgaggaccatgtgtggatagaggtcagaagcttcaatttttccttgctcaggtgaggactgtttcctgaaagcaaatcagcaccagttagtagacaaatatctgtggagtggataccatatagaaggcaaggaaagccttacaacatgctggttttgaacatgagttcttgaatcagactacttactggcttctgccacttactgactctgtacccttagggaagttgctaagcctctctgtgccttagtttcctcctatgtaaaatgggaattgtaatcgaacgtattacatatgctgttggaaagactaaatgagttaaggcacgcaaagcactttaatggtgtcctgcttatagtaagtgctcagttaagtggtagctgttacattatattatattacatatgtagactgaaatagaggacaagatcattctcaagagacaacaaatatactttaaaagataaggaatattcaagagttaaatagcagtttgagaccaaaaatcaccagagaggcatgtgtatgattatttgacttgcatagtgtagatgatgaaatggattcaaggggagagtttaccagggactgtggcagtctgaaaagttttatgaaggaggacataccggagataagccctgaggtttatgtggaacaggcagggatggggatggaaggacatctgagggtgaaaaccttgtttgtttaggtcaccaatgtgggccagtctcggccagcacataggtgtggggtgcccaaacccattaccgaaaaggaagtatgggtcgtgagagccaggagacaaaagtccgcagtgagcagactgagctgggtcttggatggcacaccaagaggcagttttctaaacagccactgctgttcactctccatacaaaacgttcaaaaaaaccgcactgcagagacagctaagtgtcttggaaatctacaaaagaaggtcagaactgaccatgaatcttgaattccagggaggttcacgaacccacccgggctggtggcagagctgaggtcagagccataccgaagctgtcaccgctctctcccaccctgcatgacctccatcccagaggccaggtctgggccatcctgctctgtcctgagcgccctgccagaagatcctatgctgcttgacaccaaacactcttttttaaaacattcttactgatacgatgaatattgacttaaaaattgctgctgcagaagttgaaaactcacctgagtgccaagtccccaggtgaaccacacgcatcccgagatgtagttttcctcccaggatgggttctcccctcctggggattagtcaccgtgaaactggccacactgattagcaagcggtgccagttaatcagacccactgagggcacattagggctgctaaaagcggcttttctgagtgttttcacactttgatggtttaaagccactcatgctgtcctgtctgaaatttgctgttggtaaattgagccacagcagatttgcaatcccatcgtggctcccaggaaagtgttttctggcccagttggtgccgcattgtgcaagagaggaggctaggcagcaggcatggtccctgcaaacagctcctgaacctcgcttgcagttaaggacacctcccagtctggactgataagagaacatctttctggagcagatattcaaaatcctgtaactcagcccctgaaactgacatatcttggagtcccagagaagatcccagagtcagggaagaggctcaaaccacagtgcttcactccccatcccttgctttttccactgcctgtgtcctcatgttcccagacttcctttaattctggttgatgtgatttaacactgaagtacccacaggatgctgctggtgcagctgagcacaagcctgggtaggcagaggacccagcctccagccctgcattcacccggacaagcctggagaccttgggcaggtctgccctccctctggactttgtcctgcatctggggcttgaagggcctggactggctggcctctgcatccccttccctctcccacatgctcatccccaccgcaccaggctgtaccctcactgcttgcagaccttcagcctctccacccctgttctcaccccctctcatgtccttggacttggccctcattctcccctcactttctattttgcttcctcttgctttttatcccctttgtcttataggggtcttacaggccacatacccttaaacaacatgaggggacacttacaaagctacttatgaggacaggggcatgtgcagggggccacccctgaggccgtccctcattctccttcacacagcgctggaggctgcctggtccccctgcccgcccatcggagatggtccctacaacatcttctaagccctttccctcccacttctttcactgccacaggaagtactcaaaccttgtccgctgtatgtgtctcatggcactgttcctgaatccgaatgtctgggtgggaggggactaggctagtacaactgagcttccattctgcagagaggagccctgaggccagagggccacatggcttccttaaggtcacagagtgacctggtggcaggtgggcaggacccttgcttcctgcacggtctgcaaggggactctgatggcaatggtgagggaaccctcagggctgctgatctttgctgcccccaggtctcccagcctccccagaagggaggaagccccaggacccgctccccgccttcccacccaggcagcctggggttgtgctctgcagatggggcagagcaccctggagggcagccagagacagcagggggtggcggggggcccttcacactgcaggaggcttgcctctaagaaacagaatttagaacagggtgggtcccacgcccagccccgccctgccccttagcacctgccaggcccaccctctcccccggtgtctcctgatctcccagtgtggacggtctttccccttgactgctgcatccccagttaagcaactctcttcccggcatcctcccaggtgcccctgaaagacgcctgggccagcagctcaaggcccactcagagtcccgaccctgctgcgacttctctgttgccctgccaggtgctttgcctcggtttctcaatctacaaagagtgagtgatgggggtgccatggataaggaggagattctacctgtgcagccctgtgagctcccagcatccgagacctcttggagagggaccctgtgggttggcaggagccaccgcaccagataggaagggaagaggcccgccatgcggcaaagtgagctgatggacacagtaagcacactcacaggttcccgcctctgctatagtggagtttcactgagaggttactgagtatcaacaacagtatgtggctgaactgggaacatctctattatttagtgttctagatacagcaggtaaaaagtcctcatggcaaagaatgcctgcagtcacacaggaacgtcacatgtgtgctaaggcacacacacattcctccagtcacgaactggtctctttttgatttgagaacaaaatgtaggaggcagtgataaatgttagggttacctccaactacaagcaatattcagcatccgttcaaggccttcagactcaaagagcttgattagctgatgaatcggcccagtggtctagaaacacagggacgttatccctaatttagagataggcaaatccaggctatctagttcagactgttttccagtcgggataactccctccaggacttggtttctgttgtttggaagagaacacagcttcctgagccgaggggaatcacattgcttctgggctgtagggcgccctgcctggctctagagattgagagtagttcatagtttgcctgttgccttatttatgtttcaagagttgtgagccccttgggtggcaggacctgatggcaaatagtattgttgtcacctcaggaattgtgatggggtgggaggcactccggcctgccggtgaggagaccagggatctaagtctggccagctgtgtgaccttgtcatttaacctctgaccctcagcctcctcacctgcaaaatgggagggtacaactgtattcgccctagagtattagcctttagatgcctgccgtgctcacctttcaccatggcagttgccctctgaatcatgcgtaattttcagtcagctgacttcttgagcaccctcttgcatgttagttagtttagttttgttttgttttgttttttaatatttggcttgggaacgtttcagagccaccaaggttgttgccatttctgttgggggtaccccagtagactatgtggtgtatgaccccaaggatatacagaatcacatcgggaggggaaaaacttgttggtatatatatacatatatacaaacattagccaggagaaatggttctgtgcctctcacaaaaagctcacaaaacactgtggtctgtggcagcagcagatgatattgatgatgatagaaaagttctgtcttcactcagacatgccattgatcaagagcatttattcagagactactatctgccaggcatcgagccacgcgacacgagccaccagtccgtttcttcatctatgccgcattgtgttgatactggcaaaggactgaaataggaaatacactcatgtcataggaggtgtcaagctgtttgtcagggcagagaagaggagagtaacgtggcacaagttgtagacatcttccttctgaagacatgggtgattggaacagcatgtcatcaggtgagttttcagtgttgcttccagttctaagctgggataattctgagtattcttaaaatgtactgctgttggaggataatggaaaagcgctgaactcagaaaaagccttgggactgtgagcaccatcaactgcattgaggagacatccaaaagtataatgccttcttcaggctgtttttactagaccatatagtcctactaataaatacttgtgcaaaacagaaatacttttaaaaaaataatatatttattcacttaattttcccagaaataatgccttgatcatatgttttccccagaaattgttagacttaccttctatggtcaacaagagctttcctgaatttcttgagatttagtgaaagcaggtagatgtaaactatattaattacattgcattttccagaaataaaaaaaagcttgaatacccctgaaattcctctgagtattatcatcctgtgctttgttgatagagaatagcagtgacctaataatttcttttttaaccactaattctagacctgaggtgtcatgacagagtatgaccctgggcaaatgccactctttcagctcccaatatagtaagcaatcacacagcccagaggtgggagagtaggtcctaaaataagagcaggtatttattaagcactcatcttgagcccaggactgtggcaggtggtataatcatcacaagagacaagagggcttcttaaactcaggaagctccataatggattcctttttgtgtctggagacctccaaacatgaaatcacagacaaggtgatgactgattaaaaataatggcaataataaaggccacttaggcttataagtgacccaggctttctaaatgttggaaagaaaaatgaggggggaatgaaatgaagatccagtgaggccagcgtcctgtgaagtgatcaatacgcagaacgtgagccccatgtgcctgttattattggttgattctctcgtgctgattcatgacacttagtggttaaagactcagatggtggaatcccactacctaggttcaaattcccagagccaccatttattagctgtgtgcctcgatttcctgatctataaaatgggggctaaaattacacctgcctgcttcctggagttgttgtgaggattaaataagtaaatgcttttaaagcaatagaattgtgtgaaacacacaggaagcactcagcaaatactagctactagtactctgtgggtccaactccctatctgtctacctcaggctccaagttggactgatcagagaaggggaccttctatacttgatcttttttttttttgagaccgagtctcgatctgtctcccaggctgcattgtcaagatctcggctcactgcaaccaccccctcccgggttcaaatgattctcgtgcctcatcttccaagtagctgggattataggcatgtgccaccacgcctggctaatttttgtattttttggaaagacaggatttcaccatgttggccaggcaggtcttgaattcctgacctcaggttatctgctctcctcggccttccaaaatgctaggattacagttgtgagccactgtgcctgacgtacacatcattttaaaaataactttattgaagcgtaatttatattcaataaaattcacatattttaagtgtacacttaagtgtaataaccttaaaatcatagaatttcacttacccaaccccttgtcctgtgtgattactatatgtcttctatttacacatactttataagttccactcaacaatgtttttatttttactttagtcaattgtcttttaagtaaattatgggaaaaaataaaacatagtattttatatttacctacttatttactgtttctgatgcttctactacacattctatagatccaagttcccttctggtatcatttccccttatcttgaagcaacccaatggcatttctataatgtaggtctgctgctggagaattagctaagcttttgtttatctgaacatgtcttttgccatcctcttttgacgaatatttttgctggtatagagttcttgattgacaggtttttttttctttcagaactttaaagatgttccattttctcctggtttccactgtctctgatgagaagtcattgatttttttttttctttctgagacggagtctcgctctgtcgcccagactggagtgcagtggcacaatcttggctcactgtaacctccgcctcctgggttcaagcaattctctgcctcagctcccgagtagctgggattacaggcacctgctaccacacctggctaatttttgtatttttaatagagacggggtttcaccatcttggccaggctggccttgaactcctgacctcgtgatccacctgcctaggcctcccagagtgctgggattacaggcgtgagccaccatgcccggcctgatattattgttattatttccctgcacataatgtttcttcctttgctgactgcttttaaaattttctctctcagttttcagcagtttgactatgatgtgcatcattattatattcattatatttgttctgcttggagttttctgagcttctcagatacactcataaatgagaagttttcaagttcgggacttttggggccatcatttcttcaaatatttttttgtactccattctcactcttctcttgctgggactcctgttatacatggtgtttggccatgttatagtatctcattggtccccggggctttgttcagttttcttcagtcttttattctctgtgttccacagatcagttcatttctgttgattattctttcagttgactcatgtttcctctaatgtctccatcttcattaagcctattcataatttttcatttcagttacttttcaattatggaatttccattctgttcctttttatagttcccatttatttgtggaattctctatatttctccctttaagatcatatactcatttatttcctttaatcagtttttcttccatcctttaaatatatgtatctatatatggatacatatgtagcactctctctatatatatatatctctctacacacccacatatatatagctgttttcaaatcgttgtctgccaagtccaacatctgaacaatctcattttttgtttcctattgactgcttttttccttgactatcacattttatatttctttatatgtctagtgatttctttttaccgaatattagaatcatggataatatgttgttgtgactctggatcttttcatattcctaagagtattggttcatcagcagacagtttaccatgaacgtgtgtaggcttggttttatgcttgttggtgctgagacattgaaagcccaaacccctcaacctccacatttaattttcccctcctgatgttgtcagggcaatgattttggctttgccaggatggatctagagtgggtctcactgtagacaaagggccttactcccaggaggtgcccttgcagtgtcagagtcatctgtccagggtggtaatgagatgttaactaggtctctccacaatttcagggccgtaagtccaacctcctgacactgctttttccccagcactgattaacctgtaccatctcttttctgctgtcaaccctaaaccagctgctatctgatatgcctcattggtttcaccttgtacctgtacaacccagccctaagccacagacacacaggcaacccctacacaaacttctagggccctgtatctacctcgctgtctcttctggatgtcccaccacagccacttcagcttcccacattccaacctgatttctgccttctcaattccatggggctgcagtgttgtgcttgaactgtagctctttgtgctgtcctcgggaaactgttcttaattatagtatattagataatataatgttatatgttatattttactttatatgtcacacatttactgaggacttattgtgtataaggcacagtagtaattggaagaaggaaaggtactagaatcttgctttatttggaaaataacaacttagaaaattttagagccagattgcattttctcatccaatgtccaccttttaaagatgttgaaacctggacccaaaaggtgacatgacttgtcaaggtcacacagttattgatagcagaagaggaaatagcctggcattttcccccactaaatccctccaaaaatatattttaaaagaaaatctaagcatgatgtttagaaatttttaccactatagaaaatttggttagtgccaaagtccctattgatgcaatagtgatttgagccagaattagaaaataagtaagtatgtgaccctaagagcattttgttcgagttacatagaaagattagcttatggcgtagagttaccgtaagttggcagcaatgaacaaatttggttctttgttacactccatctcaagaacatccagggaagagaaagctgttgcctgggtataatggtatttgccagaaaaaaaaatcattagagaggtataattaagactagtttagtaactcattcaactagataactctataatgagtacatctcatttaccaccaaaaccatagagatattttgaagttttccccaaaagtataccttttttacatttctaaaggaaggagtgaggatttgcagtgagtgcaaccaagccaccttttcctcctgtttggccttattatcaagtatgttgctcagcaaacagccagtcctcagaaacttcactccaagaggctctgtcaagggtttggcacaaagagaatgtcgcaaagattttccagtgctctagaatatatccttgtattcaaaacccagttgtctggttctgggagtgagtgtggcaggaaaagctacaggtggatcccgtaggtagtttctcccataagaagtacaggccaggccaggcgcagtagctcacgcctataatcccagcactttgggaggccgaggcaggcagatcacttgaggccaggagtttgagaccagcctggccaacatggcgaaaccccgtctctactaaaaatacaaaaacttagccagacatggtggcacacgccggtaatcccagttgctcgggaggctgaggcaagagaatcacttgaacctgggaggcgcaggttgcagtgagctgagatcacgccattgcgctccagcctgggcaacaacagcgaaactccatctcaaaaaaaaaaaaaaaagaaagaaagaaaaagaaaaaaagaaatgcaggccactttttctttcagaattggcagttgagatgattcagatcaactgtcctgccgaggacaattagaaatgctggacaaaatattctaaatcttctttctggagcttggaaaagatgcctgatagaaacaaatgtgaatcctctgtggagaaagataacatcatcaacattttcaaattactttgaaaaccaattgtgtgaaaataaggttttggctgggcgcggtggctcacgcttgtaatcccagcactttggtgggccgaggcaggcggatcacgaggtcaggagatcgagaccatcctggctaacacagtgaaaccccgtctctactaaaaatacaaaaaattagccgggcgcagtagtgggcgcctgtagtcccagctactcgggaggctgaggcaggagaatggcgtgaacccggtaggtggagcttgcagtgagccgagatcacgccactgcactccagcctgggcaacagagtgagactccatctcaaaaaaaaaaagaaaagaaaagaaaagaaggtttcattcatgataccaaataactatatacacaaggagacaaagtaacctgagtgaaaacggggagaaactatagaccatagaaatagacccacagggaattgagatattggaattgtcagatatagacttgaaaataactgtatttaccacattcagagatatcaaagacaggactggtaattttccaaagaaccagatatggaaaagaaccaaatgtaaattttagaaatgaagaatacaatcactgaaatgaaaaaggcagtgaatggatttaaaagaagacttggcacagctgaaaacagttattgaactagagagagggcagggaaaaatactgataatcaaacacagaaactgaaaagaattgggaatgcagagaagagtacagaatatcagggaataagtggatgctcacatttatgaaatgtttttttcctacatctgacagaatcgttatttttaagttaatgtgaattacatattaacttgttatggaagtataatatagtggttatcttggtgtaggaggggtgagtggggctgctgtatagctggtggggttttatttcttggtctgagtaatagttgcatggctgtttgttttgtgataaatcatacattgtaacatccccctttcttgcatcttttgtatgtatatttcacagttttttccaaaaaaagatgtaagaagaagcaaaagtacaggtccaggtagctatatcattggcagatgccgaaggagatctgctccttactctgcctggagcacaaaactacagtttgccaccaatagggaggcagcacagagggacggccatcgtgatgcaatcacttccaatggattagagctgtcatgagagatgcactgttgagaaggattgtgaggccccatctggaccagagggaaggagcagcatctgccatgacgcgggccaacaagtggcacatgtgtgcagtgtagttgtcattttgcctggataatggctaaggaatggaagtggtagcttcaagttggcttggcttctaactccaactctgccatttaccaagtgtgtaatctgggacaatttatctgtcttacctaagcctcatttcttttatctgtattaagacggctggggaattaaatgaaacaatgtatgtaaagcacttatgtggtacccagcaggtgccgagtcctcgggaaatggtagttaatactattattgttgttgtttgctttagatcatcttgtctgcctttcaccatatgcagttttcttctaacacagggtttcttttatatctttttctctgaatttctcttttcaatccacattggtaatataaaaaattaattcaacttgaaggctgatattttaattactcctaaagttttaatttattggggaaccagttacccaccatccctttgctaagacaagaaccctcctttagtgttcctcataccatgtgtgggatgcagaatttattaatctggaaaggctaaattaaaaataaatgaaaatctctaatgaataaggacactctaatgagaacatgcaaaaatcataaaacttgaggctgtaggaaagctatccaggcaatagttctttccccgtttataggaagcttcttttcccagtaagaaaatgcattagtcacttttgaagctcagcttgataaacttactcctttccccaagagagaactatctgccttcctagttctagacctattttcttttgaaagccattaagcctgtgagaccattaaaagtgtctgttacttcatcagccaaatgaaggcagaaaacatgatctgtgagattcatcacgtctccagcttctagccagtgcaacatgattcatggagatcagaagtaagcgtgggctagtagtcacaacctgatgatgacagtggtgattgtcaccaccacaaatgctgaaaggagcactcatttttagaagcagtcaggtatgactttggaagatgaggacccagagttggctagtgagttatagtaagaggatatttatctgatcactatccctgggagggaacttgttggctcacaaaacttagaagccctccaggtggaatacctcctcctggcttaatggaaaggtgatggtggcacatagaaagccactctgtcttatctgcgagtcatcctacagttgcgctaccacatctgctctccacccttccccactctgctctctggctggggagtcgaccagatggcctccatcaacaggctgcctcatctccagtctgtagttgggttcagtcgatggggagccgagcaagagatcagcaggtgggagtagggtgaggtcaggttcttctgtccccagatccttccctgcaggtctgggctggcattgtcacagcctctccgagtggtcctttatacagaatgctgtccttcccactttctgtaaccactctttccacttgcttcttcagcctagtggtgctaatagatcactgttgttgccacttccaggccacccttgtggttctctttaccccatcataaaaagcaccagtcatctcaaattatcttaatttgagtgtgaggagatggtgggacaacctcgtagaaatatctagtaggcttatgaagcatgtcttgaactcagaagagaggacaaagaaaataaatgtaagtacaggtgtggatgcatgtacttagtggtgactattggactcttaggaaggagtgaagtgcatgaattttctgagagagagtttagagagagccacacaaagggcagaagactaacagaataaaagggcagagagaagctccacccatggacacagctcacaggtctagtcttctgggaactgttttcatattttcctaggtgaagatagtctctccctctcctctatgcttccaccgtcctttgggcataattcttaggaatattatcactgaggataacccccatgcaggcaaaactccagtcactgcttgagagcatctgataacaccaaaaagactggatgaggttgctgcagcctcccaggatggccagcgtgccctagggcctggctgctggttggtggggcagcagctgcagtgtcacttgagacccggttagaaatgcaaactcattccccacccatgatggagaattacaatccacattttgacaagatcctaggggacctatgtgctcatttaccctaaagggtcccactgagacctgtgtcacgcttctaagaccacacttcaaataacaatggctgtcactgatatggcctttactatgggcctgatgttgttctgggcactttgcttaaattaacttgtttaatcctcacagcaactttatgggataggtaaacgatcatcctctctttaagatgaggtcaatagttggtacaaggacacatggatgagatgtggtgggattgggattcattggagtcatttggctccaagggtccctcttcttcaaccactgcactctcctccttctcccacctcccatggcaatcagcagggtgcttcataggttctccgtaggtgcttggaagatgcacaagtgaatgatggcatagctgtctgtggtagcctcaagaaagggaaccttgatcatctggggaaaactttctacagcctgggtacgcctgtctctctcattacagaagggagagactctccgatagtattttctcagatagaggatgtagctgaggatggaaaacttcattctagattcccctgtgggagaagctggtgtttgatctacattttcttagaatctgcatcgcaaatccaaggatagtgaggttcaagggcagttatggggctcggtgggcacagtaaggacagtgcccttcacttgaacacctgttttttttaagtttttaaaaattgttttaaattttctttttgttttttagagacagggtcttgttctgtcacccaggctggagtgcagtagtatgatcatagttcactgtaaacttgaactcctgggctcaagtgatctgcccacttctgcctcctgaagtgctgggattacaagcctaaagccactgtgcctggccttgaacacctgtcttaagagaaatctatttctttcagatgacatccaattctaagaggaaggacttgtagcgaagcttagaatttgcccaccatctagtgactctttttgtttggatttggctaaagtttatttggaaatacagaaggcataacttgctttggtagggccagcctctcagtcagccatcattcagctaatcagacatctggattaagcagtatggctttctcttccattctgcaaggacagccagttcaagttaaggagcagctttctaaaactccatgtcctgactcctgccccagtcttgaaagtgggctgtcgccttaatgctggcttgaagcacagcagaatccagagtcagccccactcctgggaagccctgactacatcgggattggggatatcacatgtagaaggggttttcccaggcttgaggttgactcgccatttcttttcatccaggctttccgtattggcagaatctcacatggtgccgcagccctctcttctgttggattgggtcgctgagaagttgtggttaagattgccccagtaaagccagcagagtagaggacccctggcctaatgctgtccttcccctgcccctctgtggcaccagatggggattatttcctccactttaccagcgaggacgttatcaggagggccttcctcgtgtgcttcctgaatttgttttcctgaaagtaaaagtgatatctgcttcctctgatttcacacacaagcaacaaactggttcctcaaacctctttccagggatttctttgagagacagaacaaagccaggaggagcatggggctgacagacggagagccctgggtgtcctatagctatccaggctacgtcgcagtctggaccccacagccctggcgccgggaccctctacctgcacatacctgaccaggtcctctccccattcagccttcagcttaagcaccacttcctggaaagcctttctgcagcctccatgccaaaggaggaccctcgtggtaccctattctgcttctttaaggctcttcacagagtttattatacatcagttgcatgattatttgactaatgtttggctgcctacaagctctgtgagggcaaggcctgcagggcttgtagtcaccaccgtattcccatctctagcacgcaagcatggctcatggcctgtagagcttagctcagtaaatagtctttgagtgaaatgaaggtattgggttaggtgatcccaaagtcctcttcctgtcatggcaaactctgagtccacctatgagaaacttgtacccaccaaccccctaaacccaaacttctcttttcctagttcagtgattctcagcactgtcttctgatgaattctgtcatcaagcctccttgatcgttttcatactttcctaaggcttggctggaatctttgagtttgaataattgggaatgtgaaatgttcatgcctaaacaccaacagaaaagcagagcgtcaatgtggaatccaaacaatggaatctaacgttggcaatgatctccaattctagggtcttcaacagtttctccctgtgccctcccatctcatgtgaaatgactcaaaatatgaattcaaaagagggaagtatgggttgaagattacatgaaaagaatagagtccttaagaggagccttgaatcaggcacattaccttccagccccaggaagttctcattttcctctgctcataaaggcattttcatactcttttgtgatagtatctctggggccctgagcagaacacttcatcccaaaagtagggcttggtgagatgctgttttataaagcaaaagaggatgtgatctgttgtcagccctcgtcagtcatggtggacaatatggaccaggtaatggaagcaccaactttggccaatctgggcatctccaggctaacctcaaaaccaccgtagagaaaggtgccagacattgctttctgcaatggacggcttctcttgactttttaaggagaaacagtgtgatttatagatgcaggtcctctaagcctttcctaaccggaattgtcaagttgcaccccagagggaatgcgggcagcactgtaagaggaagaaaggaaatccatgtctgccggctaaactccatcctccccttttcccgagcccagcactgaatgatgccactgcccaaggccccatctccctggaaggtcttcctggtaccttgagagtctttccacccgccaagaggcagtcacttgacatgaactccaaactagcgagactgaatttctaggttatgtgctgtttgatctttgcatggaaccgtatgttccaaattttccagtagagctctcctgtcacatactcagtcctattggtcccataagtacacatgtgtttgtcagatcttaccctgatgtagggctagaaaaacaggctcatcacatgcgtgggccaatagtgatcttgtgttcacagaacgtttgtcagcagttgcttcaccaggcttgtctagggcccattttctttcaccaacatgagcagccagccctgaagaaggcccgacactcgcttatcagcggtgagcatggcctatctgagaacacttgggtggagaaatgtcgtgtattttccaaattagaacttgagttggaggagctgtttctggggcagctgtgagccaatcccaagaagctgttaaacatccaggccctgagagccaaactctacatggcagggtagagaggaggatgtctggccgcacgccttcacaagccagcctggctctgccaccccaggcaggccgcgaggaaagcagatggaagcgagagcctttcctggaccagccttggaaacatctgggctctcctggaagcagggactccactagactcccccgccttcccagcagatgctgcaagcacgtgtcactgctttatagactcaggtcgtggaggctgagagctgctgtctaagcgtgtggggggcatttgcacagtcgtgaagccatgggctaggagccagaccacctggcactgagccctgtgccaccacttcccagctgtgcgaccctgggtagatcactccactgctctggacccactcttctcatcagaaacatatggttacaaatagtgcctacttcctaggttgttgccgggaggagatggaatgatccaatagagtgctgagggctgctgtcgcccatggcaagtcttcagaacgcgctcatcaagttggagggcctttggtgttccagggcagtccttcacccagtgacagaatccccagtcaggcacttcctcaagtcactgcttggatacctctgaggatggggaatcactacctcttaaagcaccctattccaccttcagataagcctgtttctcggacagataagtgtttatctgtgctgaacctaagtctttcccggacacttcgcagttggtcgtagttccatcctgtggtcagacagaactcatctaacccctcttcctcaaatagcagttgagatcctctgaaaatcactgacgttaccctcctgcctgtgccttttcaccattcctgacaaaacaccttcaatttcttctaatgattattgaatgatgttatttccaattctttcattcttgtggtttctgtcttctgaaggcaccccgtgctcacgcacgtgacttggctccatgtgcatggagtccctccccacgtgcctgagacacaaagataagaagatgtgatgagactcaaggagctctcagcgaggcagggaatggctttccaggcaggggagccgcgtgcgctgggattggaggcacgaagccagagaactgcggggtgtattgctcaagcctagggtaaaaactgggagtcatttgagaccaaactggggaaggaggcaggttagtttacctgcaggtgacagggagtcactgggtgactttcagctacaaagtgacatgttccagtgtgtactttaggaagagcattttaagtgtagcttgaagactgggcaacactggaacccgggagaccagttgacaaaatgacgagcaccaaggggacagagaggaggaaaacgagtcatggatggaaaagctaacagtggctcttctcctgggggcaggacaatgagtcattgcttttttcttcttccctgtgttctgcaatttctctataataagtattttctgttttctctataattagcatgtattatttatacagtaagaaaaatgtattcatgtctaaagatacttttaaaccaaaccagcaggacttggttactgagtggaagaaggagcctaggagatcagttttctggtctgggtgctcaggtgagtggcgtgacccccagcctggacggggatgtgaggaacagggcatttggcaggaattcttatggcatctctgacagctgaaatgacgcccacaagctgctttcactccacttggcctctctccagcctgttcagtggcctctgtcccctgcaggccctgaaactcacctgtcccttagacacctatctggaaagcaggtgtctgtgcagcaatactcaccagcgctccaggacagcagtagcatttatttagatgataagttttgtcactccttcagtaaatatttactgagtgcccacatatgctcagcaccaagccaggccttagcaacaaaatggaaaagaacaggcacagtccctctcacaaaactcagcctaatgtgagagacagatataaatgttttaaaatcccgttaaggaacataacatttcaaactgaggtgcactctccagaggatagaaaatagttccaagaagacataaaggaaacgtttctggtctgggagttgcgtgatgatccctggggaaacagatgcttgggctgagagtgaaggataagtgggagggaagtggggaaaagcattccaggttgagggaacagcatatgtggtggccctgtggtgggaggaacagtagcatattcaactctctaaaagaagagctgttttactggagtgggttggggagaggcagtgggtggagaggtgggtgtagccagacccgacagggccctgtagggcacaggaaggatcttgtcttcatcctaagagcagaggaaggcattcaaagttccagcaggcctgaggcagcctgctgagcagccctccagctgtggcctggaggggagcctcccgatgggtgtccctttatgtcccacacccaccgttctcttgccattggaggcggtggcactgaggcccgtcgagacaccccttcatgcctgggtagcccagatttggggttcccaccacctcgagtagcacttggaagacgtcccccaccccccacccccagcagatgccctgaaagccgctttgcagttcagttttcaactttcttcgcggctctgcatactccaacactaatgtgtatacaacttgctaattaatggaatcatttcaatctgaaaacatcttgttctaatgggaggctgcaagcactcttattaattcacaggtaaaatcattccagcttttctcttctttctttttttttttttatcttcccagcttggcttaatagctgggaagaatcattctaatcagccttgcgagaatcacatcaccagaatgaaaagcaccaacaacggccttggggtttgggaaaggggtgaccagccttagtttacccaggggcaagcgcggtggatgaatgtgagggtgagatgccccacacagaaggtaaagacacaaaaagtgacctgtgtagtgcgacttggaggggggtttcctgtcctgtgtgtcagaggtggcactcagggtgactttctgcaccactggctctgctggagggaaggaggagctgcctccacattctcacctggcatgtgagactcactgcactcacctgggcaggaatctcacacgtgactttctcggggctgggtgtcatctgggggtgacttgctgataaccaccttcctgtcatttgcaaatgatttgcagtgtccctttaaatgaatgccatccccagtgtgttatttctggtataaccgagcttagtaaggggggccttctccccatagaccgcggtgcaagccccagacctcaccgacaacacccatgtccccaggcgggcttttcctttactcttttttaccagagggatctgggtgctttttagagtttcttttcttgtggtaataagaacataacaaaattgatcatttcaatgattttcaagtgtacattcagtggcactaagtatcttcacactgttgtacaactgtcatcaccatccagctctgggactttttccaatcccaccatgggaaaaacctcgaggataaatgagtccctgcagggccgtcttgagtccacatgagctctcactgtcctgagatgctgctctaggagaaaaagatgctcagttgtctgtaagatggggtattacacaatttgacagttatggatggaaacaacatgttcttccccttggaagtacagcagctgccagtcctttgctttggatgagtctccaagacagatttggagtgaggccaacctggatttagacccctgcaccatcagtccttggcgtgtggctctgagcctcagtcttctcatctaaacaacagggctggcagttccttccttgcagagttgctggaagattgcatgagatggcgtcagcacggtaccgcggtgatgcttggttcagtgagtggctctgtccccgcaggtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcaggtaagaggggcaggcggctgcgctcccaaggccctgccctctatcgctcccagcacctttcccgctgctggctacaccaacatgaccagcagagcccagggaaggccccattcattcagacacacactgggcatggttaagtgagaggcagagacccgtatcctttttttctcagttccaatttttgttttaatctctgttaaaccggcctaacgcaaacttcgttcagcacttttcaataagctacacaatttgagaaacatttgaataacttagaacctatcttttgtcaatctacgacttttcaagccaaccctgagtattttaagaatcagagctgacctggggtcgtcagtctctgctccttccatgcttcagtgtggttggccattgggagccctttcacggggccgcttagccctgagcaacaggttctcccagcaccactctaagatttttctaccttcatggtgctgattccagatcctctgtaattattgtttctgcttctccattcacaggcagatgccccagagcccctattccaggtgggggaggagggcaggtgggaatcacccccttgccggcagccaaacttcctcccttcaaggagaaggcttagttctaccccatgactcccagtcccttcctttttgagccttcccacttcacgttccttccataaatcaatatatttaacagcaatgctggctcattaggcgcttccctgcgtggcactggagttttggcttgcaggatatgctgcaagctgctgctaaagctactaacatcgcagcttggccttttaaagaaacatttaaacagaaattgacaaggcttttaaacagacatatacagtggcttaacacaaagaacttgttgaaaaaataacacccaccccaaaggggctagctgtgttaaatatatatgatttttttcacacagcaagatccatcatcttagtttttagcatcttggtggaaaaaggggagcatcatctgccggaaacagtgaaggatacctaattttctccatcgacactgcacctcattcccactcagtcccagcactcagttaaatgggacctctcgcttcattggggtgaggagggatagcttccaaacaacagggagtgaaattcgtagcagaaaccaaaacagaatactttctatgtatgatctagtatgaccggatggattaactgcatatttgagggcatttctagtttatttctacatagccacagtcctaaaaacaaaacaaaacaaaaaaccacacacacaaaacgtatactcctatagacacagaatcacacaaatgttttcactttttggatggaagtctgtttaacaggagactgttttttcactctagagagaatttccaaattacttgggtcataattgtataaaataaactatcctgttttcaaaaatggaatccttgttaagttggaagaagcaggtcttgcctgtagctaaaattctgagactttttagccttgcttaaagaaatgcgaaaccatatatgaataatattttcccctttaattaaaatccttccttttattcaggttgatttatagctagctcagaaccaataaatttatatgaattgtgtggccctgtgagagctcattttaagactccttaaaaactgactgtggtatgtctgaagttcatgcagttgtattgaaattatcaatgacccatttgacccaaactcctcaggaagtctcagacatgtggagtctcaaagattccccatcagttcagcagtgaatgatggtgaggccctcactaacaaaatgggggagagcgaaatggtagaattcagccatcgagccaaagatggcggccctgctgtgcaatcagaggtctgtgcaccacagagtaaggagaggggctccaaagctgcaggcaatttccatcatcctaacgagaaagcagtccaagagtgttttctgccggtggtgggctcctgcaagggcgggtgaggataagcggccctgaatactggttggaagcccaaggctttgttaccaggcctcagaggccctggatagtcagaaaatggtgagcatggtagacaaagaaagcatggcacggggagggagccgtcctgaaggccatagccgtagggcccagtgaagaggtcgccccaacgccccaagtaccgaacctgtcatggcctcctcttctcttaggacaaagataagacttggcctccccaattggaatggccaatttaggatcacattgtccacccttgatagtaaacaggaccaggaaaagtgcctgagaagttgcctcctaccaagagactcatcagattgtttatgtgatgggtttatctttgcctgcaagttcagaagagaagtaggctcccatcacagaaatggccatgagccaagggggccaggacaacagcagaagtgctccagagagaagggccctgccaggctccatgagaaggtggcctcactcattcgctggagtcagagtccctgctgggaagaggggcccaggacacagctgcagaagcctgtcctctcaaatactctgcaatcaggagcttgctgtcccttcgttcccaaacctgccgtctgatcacaagccaggacccactctgtcactcttagcacaacacgatgccgctgctatcaagcccttgtccacccacagagtgggcagtgcagacaaggagggaaaatacgcgagaacccagacatgtctgtgcagccgtggagtagaagaccaaatacttgcaggctttgaaaccaacccctgagtgttttggagagttttatataaactttggaatgggtggtttaatttttttctttctttctttctttctttttttaaaatttcagactttggattgaattaccctattttccgcaaatttagattacacaaaagtgctttgtgagcctttgttgtaatttttgatgagatttacatcaaattctttttatagtccaatattatttcacagactgtgaattttatgtatctctagatttcaaaatacgtttgattttgagccatgtttccaataaaatccataaagaaagttatggaattgtccaggtgagccatgttctacctctagactgcccttccagggagcagccccggtgaaggcggtctcagaagaggcggcgtttccctaatcccggaggcatctgcaaggcgccttctcagctcctcaacagacacatcaccatatgccgataccttttgtttccggttgtcccatctgtttgatggtgcactgagccaggtcactctgaatagcttcccaatcacagtaattacccctgagactggcacagagctggttggctaaaacctagaaatgaaatcatcttcattctatttactccttaaagttgagttttaaaaaagtaattgatttttgtcttcagtgatttctccttggaatcactaactggagctctcccaggattgcatgtttgtgttggtattaactgcgtttctaactctctcctaatcgtcacctccattattttaccgaaaacttaatttggactttccagaatgactctacctctcttcatttctgtcttaaaatgtagaacctgcattgctttgtttctgtctcccacttcatgttcccactttcctccccaggacttcatgactctgcaaaagaaaactaacacatttttacatttaagcaaatttctcctcaccctagagtgtgtgttgctaggacctgctgatttgtgtgtgttcacattttttcaagtgttcgctttagcgctttttatagatacctatttttaccagatcatcactgcttcttaattgttctcaaatctttttcattattgttcaaatcggattttaaatagcagagtggcactaaacctttagataatgtttctgaatctcatccctttctctcttattagtgagatcacttccccttgatgccattttctttttcgcagatattcgtaaaatccccagagatgttttcctttctcgaggacactcagaattccctttggcagccttctcctcttccctgtttgtgatgtttcaggaactgagagtgcagggaatgctgtcagatgagtggtcccaatgtaaagattaacttcatctttattctgcgaaaaagcaaaacatgagaaaaagatgcaagaaaaagatgcaagcttccccttcactttttcaccctttctctttgtcccgtctctgctgtcattccagtacttttatcacagtgactgaacacatctccctagaaagctatgactagaatgggtgacaacccaacataattaatgatctaattggctcttggttttccagtctctcagctcccaaatttttcggtgcttattatccactttttcatgtattatttaggcttaggatttacattttagcctcccccttttttgtagcatcacatccaaatctctaaagatttcacatttttaaaagtcataaaaagttgtagttagaggactgcttgtttcagctgcgttaatggagccctcctgggagctggaccctgaaataaggaaatggtgtggatactgtctctctagcagttcagggaccagcagtgcagacctttgcaccttgatcaacgaacacaggactcacacacaactttaagcactggcccaagaataagccaggaagcagcattattcataatagcccaaacctggaaataatccagacgtccatcagctggtgaatggataaacatacaatgaaatacactgctcagcaataaagaggaacagagcctactgatatatgcagcagcacggatgaaactcaaaacattatgctaagtgaaagaagatggacataaaaagcctcatagtgtgtgattccatttatatgaaatttctagaggaggcaaagcaatggagacacaaagcagatcaggttgccagggactggggatgggaggaaggattgactgcaagcaggcgaggggggtttcagggagtgatggccgtgctttaaaatggattgtggttatggctgcatgactatataaacttactaaaaataattaagatgtacatttacattgataaattctgaggcatgtaaattataagtcaataaagctgatggggtcagtgggagagaaagagaggagaggagaagaaggaggaggaggaaaaggaggaggaggaggaaatgacagaggaggaagaggaaatgaaattgacagagaacaaggaggaggaggaggccacaaagatgaccacgaaggtgatgatgacaatgaagaggaggaggcatgtaaattataagtcaataaagctgatggggtcagtgggagagaaagagaggagaggagaagaaggaggaggaggaggaggaagaggaggaggaggaggagctgccactgctgctgggaagacacaatcgggcatatattttcaagtagactctattctcctaagaattatctcttacttaaggattaatatttctcttctggtcttcctcttgggagtgaacagtttcagatttaaagccaccgactgagaatcagcccaccggccagtcctgttcaatgcacagcctaacgtaggcaaagtaatcacacttacgattgttttgatatatatgaaaccagaaaataatcctgggttatctgttgtctctaaatgaagaactataagcaaattctctctctctctctctctctctctctctctctttggaagtgtattttcattgttataggcaatcatttatttgttggaactggggtctcttctgtctgttattgtcattactttgtctaaggacaggacaatgtccttgatttcacaaacttttgtgaattccacaccgttaccttccatagccagagccaagactttctcagtgttttcccataatggaaattcttagatcagtcaggtcttgtttaaatttaccatcaatctccacactcaaaatataagtcacatcttcattcattaatttgctgggagctattcccagcacgtgaaattagtccaactgctgcatttagccacagacactgtgttctactgtttcctgacaaagccccgtccgtactgaggaagcacactccctattattcactgccgctctatcttgatagaggtcagaaaatgattcttctcttctgaaaagtattcatgctgcagagcaaagggcagagctgtgaagtcccacatgacatgcatgaaatacagtcagtagcgtgtactcacaggctgtaaggaaaacggctgcaggtgatccctctccccggcagtcagagtccgttttccgtctttcgcctatgtaaggcttcactgtaaagtgacttgcgtccctggcaatgtatcctctaatacatagtggacccatatagttagaaagctttattggatgggatcggttggctaactatgtgaaggagtctttgcattggtattgtccttaccctaaattctggtattccaatacaagtgtctatagaactctaccaccagaaaaagaaaatatggacttctaatcgctttctgggtcagtttccacttgcagtggtggcatcatcattattttttgattggccatttgattttgaggctgacatgttgcagcagaatgggcaatagaaatcaattactaagattaaaatacagcttttacaacagtgagtggaaaggactgaccttctaaattaacagcagcctaaatggaaagcctactttcttgtgttgcttaattcacatctggggacctgatttaaacatgtcttgcgctgttgttgccatggttgctttgcccatcccatcaacctcatcctgtcacttttctctctgacttctttctctgcccacatctctccctccctgctgctcccgtctcctgtcttcttctggccatttgagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtacgtagcatgagtgggcagtcagagggtgggggaacagcggccgtgaacccttccctgacacctccctttctcctcctccccatggtcttggggtcacatacgcatcttgatggaatggttgatgaagagcgtctttgatttcttccaggtcttgcctgagaaacaaggcatgagcttttcaccctaacgagtcccctcccccacccgccagccttaggggaaggtcatttttccagtgcgtcccacagtgcaaaaccctggtgtgcaggcatggatgagctggccaggctggcacaagggttccgttcaactcctcctcccatgcagagttccttctgccctcatccttttcttgcctctttcctcaaaagggagctagaaggcagaattatgtattcttagggcagaagagaagaagtcctgatcttctaaaaagaagttatataaagaaaccatttttattgaattgtgtagcattgtgacatgctattcaatttttactttttattttactcttaccttaacatattagaatagtccatcagacaaatgcattggcagcatttttactattccccaaacatgctgctggtcatgtgatgcctatttagaaatacactttttttttttaatttttattttactttaggttctgggatacatgtgtagaacgtgcaggtttgctgcataggtatacatgagacatggtggtttgttgcacccatccacccgtcatctattaagccccacatacattaggtagagaaataccacttctcgagagccacccaatcaatagcaaatcttcgtttaccttaaagttgccccttttattacccagtagccaacactactttgctgcgctttgagcctctgaagtgccagatttttgtacagcctaccccacaggcaaatccacactccatatttgagctgtctcgattctggcaaagtccattattaggaaaaactccagaaaatttattcttcatagtgtctccaacttcagcctgagaaatgacttgccagaatccagtgttgttctccagaatttgggcgaataaagcatgctgccagtcttaaaaataccatctccttcagagttttgcaaataggcaaatttatttggccatcgtgaaaacaatctaagagcctgctcagggaacatgtctacaaaccaaagcagggaagagtgagaggggagcaaatgcttcccgttgagcagagctgccagatcaaaaggaaatcatgccaagagaggcgttgacttcttcctgaatcggaaggaagagttttgtaactgtacggagatttggtgcacagtattctgtcatatgatttctttaaaagcaccatgtcctgttgattcagaatccctctttctcagtttttacatgatagtcaatatgccaaaccccagtgttgctatgacatgtgtccctccctctgtaagtgacaacttgaaacttgcccgaggaccttgtacccagcaaacatttcctgagtgtccttgcctgccaggggtgctcctaggctctgaggattcagtcataaataagatccagtccagtccaattatctcagtctaggaagccaactaaactctaaactgagtaatggcagtatggctggacccatgccgcggcaaagctgctgtgttgtgatactttcaaaaagaagacaaaggtcagaacccctctgcctcaaactaaaatgaaacactggaaaacatttctgagattcatgctcaataagaccttggttttgaataatttgtaagacagaaggaattgaacttattacacttagggaaacttattttgtttagcaaagcagacaaaattcccaagtggacctagctggtccttcttcctggggtgggtccctctgaccagccaaggacagaaacatccttctgccaacaggcagtttctgcctacaggccacataggataaatgattgtgtgggactgtgctttggggcctcatcccataagcttcaggcccatgcattccatggcatcaaactgagggcaggtggcagtggagggtgggtggagggtaggaatagatatgactgcctttgctgatgtatttttgtgttcttccttcaccactcccttcttctcccaccaccacaagtcattgatgccccaccagccagatgtgatccaaagaaatactgtcataatgacagccggggcggggagcagaagcagcaacaactgcaaccaccaattttcagcagctgtgttgtgccttctcccctggggagcgtgtgatagtgctcaggctgggaatggaaacagtgtcagaggtgaagaaacaatcccaggctcatgggacatgcctctctctgattttcccagcaccttcccaaaatggccatgttgtgtgtgtgtgcatttgtatgtgtgtgcacgcctgcaagtgtgtatacacacacgtgcacatacacacacctaaaactgaaacttgggtattcatgatagaagccctgcctagcccagtgctcctgctttcaatttctctaattgctttgacctttctacggctgtttcttccttcttcctccctctccctcttcctttctctccagtgtccctcctccttagcttctaggccagtatctctaaagcacagactctcaaatctcaaaatgttctagcatcaaacatagagctttgtaaatataaaaatacccaaacctccctcagagccattgaattagaagctctaaagtcggggccccagtatctgcattttgaaaaagctctccaggtgattctgatttccaggctggagtttgaaaacgctggaaatctaacctgttgaacctcatggtgctggtatgatgctgctggctttgaacccttctaaggagatagtttccacagggaggagggggaaataaggcctttcactcagaagaatgaattgtccttcaggcacaagggcaagtctaaaggacttgagaaggagcagccaagattttcaaatatagtaatgcatggaaaccccagagctccattcattctaaatcaccaaacagctggaaaagagtaagtcactaaagcatcaaagaagcgattggtcagccgctggttatggcctgagatagaagggatcagggaaggcacctagcagatggcagcacttgcttccagttgtggatgatacagtatctttctcttttcctctaacatccgttattgcattccattgttagattttaaagagtggactaaaaataaaatcagacttggtcgagtaatacttgaacattgcttcagctatgaaagccattggccatgcattgcattgaggctccaacaagccgagcaatttgctgaaaacatttcttctacctaatatcctgtttgaggagtgtgcagatgacagaataaggaagggtggataccggggatttggaaatgaaacaaaactcgggtttggtgtatagtttccttaggaaattacttcttaagccaaaggctcatcctttactctcagaatgtccaagactcttaaaaacagatgggtaggtgtggggagtgtgatcagataaaaagcgctggccttcttcagaggcagtgaagcaccaaggagggaagaacctaatgtgtaacgttaccattgttttccattcttagtttcacgttttgtttttttcaaaaatctaaacatccctagccttttgcacatcattcaaggctgcttgtctcccatggtctacgcatgagccatctcaaagatgtaaagtctgctgggtcagcctcctttgcaggaccttgtcgataggattcataggcatgctctgagaattccagttggtttgaaactctgagcatgacctcttacacactgtgggcagtcacaatcaggtaacagaaatatccatcaattaaacatcttttcagtgctgactttgtgttcagcacttgagatgaggcccctgctcatgggaaacagaatgacatggccactgataggggttggggacacacgcagaacgttgcaggtgagaattgtggaaggggggcagcagctagactaggcatcacactagaggatgtgtttctagctctttaggaatctcaatgcctggataattcatcaggagcattctgttgacttctgtccaccccatgcccttctgggatccccaagaatgttgcacactgtgaaccacagtaaagagcctctggcccgcgttatcctgggttcatgccccttcccatcctattgggaccaccctcttcctgacaccacccattgcccctgcattagtttctccgtgatcagttcttcgactgatttttttttacaagttaaaaattaaacttaaaaattaggttataaaaaatacttaatgagaaatcatctaaaagaaagatttttttagagtcacaaatagtgtgttctctagaacctggaatttgttttggttcagccaacaggagactcttggaacaaaaatctaatgagttaacttttcataagtcacttgtcagctccacccttcatcttgccatcccactatgtgtctggatgtgcggagaaggtatttctattaaattcacacacacacacacacacacacacacacacacaacagctattaatctcttggtattggtgctgctgaaatatccctcgtttatgacaaagaccttttgcatccaagcaggttgaattgggtgttttaccctatttttgtctactccatcttcacaaagccacctcctttcactgcagaatatagagttgctgaaggcttcataaaagttagagctgaattctgctgatgacctaggagtcattctaagtgaggagctgagaaaccctcaagtaacccagaaacagtgtccagggccctttctcaggtatcggagtagagaccgtgttaggacctctgtggtccctgacttttcacctgcctccgtgctacccccagggtgcacctgttgcctaaaatggagaatccctgatctaaacagtaaactggctgttcagaagcatatcaaggaagagagtcagcatctctcaaagccattctttatttatttattgggtttcattttatttattttgctggtattagatgagtccttatgattctgtaatttaatttagcaaacatttattgagcatttgctgtttcctgggacgagggatgtgggagcacagagaagaataaggcctgcccaggcagttcaggtctaactaaagagttgcaggacatgcggaggaacacagctgagccatgggggtcagtgccctctgtgggagcaggacagccctgaggggcacagagcactccaggaccaagtggggctttactggaccaggagagaaggctcttctgcctggggaaagcaagctttgtctcagtttgggaggccgcagagacctgggttttaggttctctcaacattgctatggctgtcagccagttgtctcctgcacaggtcttcacacactggggcccactactctctatgacagctcccaacctcccacatgatgtcagcacatgagtccatctgattccagggagtttgaaatgcatggaggagcttattttgttggcttgccttggtgttaggagcttgttgttttcttcccccatgtaaactaagcttttacctgggctctgaggcactcccgggttttcagcactcaataagcaggtgcaggggtggggagcagccaggtggagcctgttccacaacttcctgctcacttggtgctccgtgaggtagctgcccgtgtcccagcaagcaaggtgacatagattctgaaagccgcaggttgatggagctattgccctgagctgactggtgttcactggcagcagcagatcctgtcccccagtgacagtgtaaagcaccgtggctttcacagatttacacctcctgcctttcgatggcaggtgtcagcctctctctcgacatttgctgaaacgattcagcctttttggatccacagtgcctgtgccaagaaccttacaggaaaggtacacacagcttgagaacccgtggaagtctgctgggctggggagttggcctcgaggagaggggctagggaagcttattcccctgtttatctttttggggaaagataaaaagtggacttgagggtttaaatctggggttcccttcaaggaattagatgctggttgccgaaaggtctttgatagtgttcattcaatgctccctccctttgtagtgaggctgtttcagccaaggcaggggccgtcctgccagtacttgggcctggaggccctcaaggctacagacaatgagctgactttccttaggaaagtcaggagacctgaggaacacggcttaatggctctagaagacctatcccttatttcacctctaaataagggtgtcagcaatctgggtcatttttttttttaaatctgactttattctttgtcttcttaatagctccatttcagctgctttaggacatcaatctcatgactccaggcatcgccctacttcagagccacccagctttgtgtgctctctactcagctgtccccccaaagtaggtggaccagaataaagaggagaaagtaagagggaagtgaaaggagaactttcctttcagaccagagccaggcaggccagagaatcaccttctgtggcagccgagcattgctcacccaggcagtggggttctgaggaccaccctggcctcgtccgtctccatctctcatctgtcctcctgcttcctgccctcgcctgctgttccccatctcgaacctctaaaaaaccagcccacagcccaggggggaccaaagcagcagtgtgggacggcgagggggacccatgagtttcctcttatggtcctggctgtctgtggggccatgaccttgaggtctgtagctccccctttgaagtccttcatatgctggaagcctctcaccttgtgtgtggcgcagaagaaaggattcccagactaagctcgggccttaggaaatctccaaggcgcgtgggtttgtgtggcctccaaggctgcattttctgtgaggttaaatgttcacaaaatttaaggggtgtgaggaactagtgaggaaagatttcattttgaggaagttgcctgggcgccatcgagcccaactcccactcgccatctgcccaggctccagaggcagctttgggaggggaactgtggtgagcacgtcgtggcctcctggaactggctgctcccacgtgtcctgaagaaggtggggtctgtgacccagagaggagcaaggggagtttgccaagaacagacatcctctgccactcttgatcccctgacgcacacggggcaagctcctttggggtcgaacagaacagaccagttgtttggagtaggtcagtaccatggggttctgcacgcgcttcagggtgccggcgtgccctcgaggctgtctgcaggatgctgtgtgtgtgcagtgcacattactgctggtgggagtccatagttctcaaaagcttttcctgactgccccaccctctcaaaaaagtaaagcaggccgggggcagtggctcatgcctgtaatcccagcactttgggaggccgaggtgggcggatcacgaggtcaggagatcgagaccatcctggctaacacggtgaaaccccgtctctactttaaaaaaaaaaaaaaattagccaggtgtggtggcgggtgcctgtagtccctgctactcgggaggctgaggcaggagaatggcatgaacccaggaggtggagcttgctgtgagccaagatcacgccactgcacctccagcctgggcgacagagtgagactccacctcaaaaaaaaaaaaaaaaaaaaaaaaagtaaagcaatactcatttagaggaaaagaaagggactgcttctgaccctccttagcaggacttactctgagagaggaaaagctacaaggacacccacaggctccccctgaccttggatccaggtttccctcttcctcagcaggtgcctgggactcccattccagggctgtctcaaccccattgccttccctgtatcagagagtccgatacacaacagaacccttacacaagtaggcgctcagtaaatacttgttgaacaaacgtggactctgatgtgaccactgctaagaatagtcaaagaatgacctcacggttcccatcgtcaaatgggacctgcagaccacagcccatcgtggccagcacggctgtcagtgtggcctgtggtcaggcagctcatgtggctctcatgcctttctctccctaatctcatgtcaccaatcccacccatcctgtattggctcgggtttgtttttcttctcctggtgctgaagtctggtgtggtttcctttgcactgttggttcagacagttaccttatcgctaaaggaaagctcccaggctccctgggatggggacagtgtctgacacacaaggacctttcaccccgcctctcctaacagatgctcttttgctggatattttagtagttcagccactgggagaatctttgcagccaggatggcctcacagccataggctctatttttaacaattgccgacttctgcaaacctccattgctatcataggaccacatggactctggggcttccttcctgctctttatctccgttgccttcagtggctgtgcagtgcaaggttgacacaggcctgctgagcctggcccttgcccccctcagcctcacgcagacactcttccactggtggaagccttctgggaccctgcgtgcttccttctgcagttgcagctgccagcctgcactgtagctgcctggtcatttcctgtctcccctccagcaaggatttcgtgtttacagcacagtacctagcacatatcaggttcactcattcactcaaagagcgttagctgaggacctactatgtgcgaggcatcgttgtaggcacctggggtacacccgtgaacaaagcaggccagaaccaactgtcctcggggagctcacattctagcatggaagacaaacagcaaataatacacgtaataaataggtaatgatacagttaccaagtgagaagtgctctgggaaagcaaaccagatgtgagaaaatgggcatgctcagtaaacccacgttcaattgaatttcacgatggcatggccaagtgggcacacactgggaatcttcttgccccagacacgatatttgcactatgcacaatgattatgttgggtgaattttcctaaccaaaatttagtaatatcagatacatctcaatggatctgtaaagaacatattgggatgtaacacttcataccagtcagactagctaggtgtctcggtacttctcagtcttttattcccggcatgcagagaacatgtttatccagcgtacttagacaaatgcatgtggctgctgaagctgcaaagcccaagggctgagggtattactatcccacctgcctgaactcctttgaggcccctgggtggaaatcgtggggtggttatcaaacttgagcatagcctagaatcacctgggatggttaatatgcagactgtgggccaccctgagatcttgggggcatggggcaggaatctgctttgttcataactctcccagatgtttctgatgctggtggtccttggaccacactttgaggaacactgctatgcaaccttgtggaggtacatggagagccacacacttgtgttgttacatttgaaattgggagctatggagagaacaatgtgatcagtggtgctcaagcatgcatcagaatcacctgtagggccgtcaaaacgtgggttgctgggccttccccacagtgtcagggtgaggtctaggtatgtgcatttctgaacaggtccccaggtgacgctgaagctgttcgtccgtgggccacactttgagagccattgatgtgaatcattcaggacacttgtgtgccttggaagtttgggtttctatgagctagtttcacaaggacaaagttgggtgcatttttaggaagccagaacttaaccctgtttagtcagaaggcatcagaagagatagctttgagaaactaaatcagaataaatttcctctgatggaagcacagctctgcaatttatcttcacgtccaccctccagccagtggtgagctaataaatgtttaagcatctcttcttagggtcagcgggtacagggggctgatttattgcttgcctatctctgtggtgtaaatacttccaccatggtcagtttcaagctgccagtgtggtcaacgaacacggagctgggaagagatgtgcacggtgagctcccctcagcccccaggagccagctccggcgcaccactccctctggctgccgtaggggtttgtgacctttcagggcgttctccaccattcagtagttacagtcagtttccacattaaggaccatttacccctaagctgtggttgcagtcacaggacccttctctgaatacataaaccaaaatgattgcctctcccagccggtggcccgcagtacgtgtgaagcactggggtttagcctctaacttccgggcttggcccacggtccaggtggccaaggttatcttctgaggaaggttatctttcctcacacctcctctgtggtttcagttctccaggcctgtcagcaggagctgacgcacttcatacaccaaggtcaggggcctccgggtgcaacagaaggcttaatgtccaggcaaacccaagtgagttaaaccatcccatgctgaagaaattattttttgaggtgacccattttctcagacaagtgaatagaaaacattggagaaatgtttctttttcagaaaataaaaccacagagagacagagtgattcctcttgaggcagagcgggccgaggtccccttcggtcacaggagttcctttgaacatgggcgatgccctgggtaacacgggtaacctggtgcacatgaacaaagcccacgttcagccccgtctgtcccctcccaatctgctcacacctgctgcctgcctctttgctgtaacccaattctgcttcttctttcctaactttccttcgtctttccagatgcaggacgctatgggctatgagttaccctgggtgtattttgtcagtctggtcatctttggatcctttttcgttctaaatctggttctcggtgtgttgagcgggtaagctgaccgtttctatgtcctctccacaacgcagccgagcaaggtctcaggttccactccgtacatgcccggggtcctcagggatgggaccctgacaggcccaggaaaaccacaacaaagcctctgttcaaccacagattctgacccattggccaggcaggctgtttggcctctgatttgcacctagagggtccccggatcctggcgctgcgtgggtcagtgtctcgggagccggggaccggcactggccgtgctcggttgctgagtgtgcctcactaactatcattccgttcttccaggtcaatgatgccgtaggaagggactggccctggatctattttgttacactaatcatcatagggtcattttttgtacttaacttggttctcggtgtgcttagcgggtaagcaggaccaaggaaaaaggtcttgatttttccatttatttttatttattctttctgctattcctggctgtattctttttctggctctgatgaacctgggataaggggtcaccacaggagccttgaagtggatgtccttgtcctggctgggtaaagggtcagatgtgccactggtcttggtggtggacaatggaggagagctggcttcaccacaaaaagtgggtccagctggcccctcccagcctcaagtagctgtccaggcaggcagggcacttctccttgtgccttcgtggcctctggtgaacaggcctgggtaagaaaagactggtttaaaacataaacaaagacagactcaaaatctaattctcattttacttcatagactgagcagtctatctctgagtttccttttctgaatggaaaggacccttaactgtttaaagccatatattatttaagaatagaggagatgggatgcaatttcctctaactttatatctagttggctgcaagtatcacatctacctaatttcagcccttgctcagatgaagttagaagtggtagaagtaaccgggcatggtggtgcacacctgtagacccagcaactcagaaggctgagacaggaggatcacttgagcccaggagttcaaggctgcagtgagctatgatcgtgccactgcactgcagcctgggcaacatagcgagaccccatggtagaagtagcacgtggttggaaggaagcacctgaggatggccaccttttcaccatggaaacgcataggatatttcctcaacccactttcttcttcagaagtccacaccagccatgccaaggcctaacacctaaatgctcctggtgacctgctcatgggtaacccactctgctgcctttgccacttgggggaggggggtaatctacttctactctgcttgagactggtcagctgctttgcagagtcttccctaaatgtctagagaggttaatgctgggagaaatttaagcataaagacaaagattgctctccactttcccccagtacctaaactgggaatcgctactcccagctcctacagctgccctaatgcagttcagagcagtgggcttggccttcagagctgcgtagaggaaagaatctcctcccagctcttccacctcccatggagaatggcccagtagagaccttgatgacaaaatgccttttgctaaggtgaggccacacaggagactagtgccttccatcagggataacagtgatgagcagaacaacgtaagtccctgattcattgcctggaaggtagagaggttttcagttttatgttcaaacacaagaaaatgcccatgtgtttatatgtgaatctctaaggaaaagattgaaaaaatcaacctcatcaccctgaatcaaagcagaaattgaggcatcccagctctgcccttgctgggtacataatgttgggtggtttcacctttttaaatcttagtttccccatctgaaaaagtgaagctgataattccagtgcataggtggctgtgatgatagaataagatcattttcagaatacttaacacagtggtatataataagtgcccaataatggtgctatcattacaatgattattatttacttggtgcctgttataactagaagtatagaatcatcaaatattagacatgctccagcctttcctcttaaagatgaggagcgtgagcccagagatgttaagtgatttgtacaacgtcacttccctggtaagtagcagaaccagagccagccctcaaggcaccgcctcccatgagatctatgatgaatgagcttgaactgcaacacaagccacagctcaagacttttaaaagaatgtaactccactttcttcccctggagactgggaaccaaatctgagcaagtaaccccccaccaagagcctgaagtggagaatgagggctgggccctgagggtcctccctgagcagagcgtctgcccaggaatcaaagcagtgaagtcaagtgacagaaactgctgatgttggggaagaagccactttgaaggccatatcttggctgactcagcctaaaagcgctagggtgtatttagacccctcaccccaaacctggagcttagtaatattcaaaaatgttggttgactcagaacaagaacattaaggctatctgacctctgaacttaggagtctttgagtcgatacgctggtctttcctggagaccttcgccagcctctgtttcctgacctgttctgagagctgccgtctgctccttgcagctcctgaatcactgatagaacatctgccaaggcttccttggccaaaggtctgccctaaagagcaaagatgtgtgtatgggcgagcacctcccctttctggtttaaggaggcctctcctcatgtgtcaagggctggccactctgaattggttgcccccgccccatgcagtgccaaagctggaatcagcttctgttggctgaccactcagaggcaacggtttccagtcagtgtcttgattagccaggaccgtagaatagtcacacacttactgggtgcagatgtagttgaccatgcagtcaaacacccacttattcatcagacttctgattaagctacacttccagaagcattcaaaaaggtctcactgctccatgaaattgactgtcacattaacagtcactagcattctctgtgtcaggctccgtgctcggcgtgttcgctagattcgctcagttaatgctcatggcaactcagtgagctggtgctattcctgtgtccattctacagagaaggcaagtgaagctcaccaggcaaaatgacctcaatcccagcaggtgagaaatgcaggatgcagagctgagcccaagcgatgtgaatccatcacttctatccctgacctctgtggtgtactctccccaaacccataggacgggttcatcccatgcttttaaatgacaggcgagaaatggagaggggaagagcagaagctgcagtaggaagggtgagaggagcgagcaggcaggcacagaagcaatcagcacagactgcgggaaacagccagcaggcacacagaatcccagcaggaagctgcgaaggcaaccgcccagaggcctgcagcagggctgggctgcttagcagagggaccggcagccctgcagatcttcatggcccttgaaagagagcaaagccactaactgaatagcactgcagtcttggagccttctgggactgggagaagtgggtgtgaaaccctgcattccaacaattaaggataatatgattttatagccctgcacagtaactcatcctcataaattatgtccttcagtcactaaggaaagattgaacggtgcttggtgtgttgtgcttgtgaaggtagagaagatgactccataaagcttccatttaaagtgtggaaattcagggctgcgcatggtggctcatgcctataatcccagtgttgggagactgaagcaagagaatcatgcgaagctaggagtttgagatcagcctgggcgacatagtgagaccctttctctacaaagaaaatattttttaattagctgggcttggtggcagcacctatagtcccaggtattcgggaagccgaggtgggaggatcacttgagtccaggagtttgaggctgcagtgagccatagtcatgccactgcactccagcctgggtgacagagcgagactctgtctctaaaagtaaaaaagaaaaaatttttaatggaaattcaaagacttttggccctgagagggttagacctcttctatctggatcatgcacacatccagaacacctatttctgatgaggccagataaagtcaatataaagaatagatattaaaggattttttcaaaatactttattatctgatggtcctcacattaaccctatgcaagacataggactggtgctcttatggataataatcagattatgattacttcccctcagaaagctcaatctccagtcgactagaataaagacaacggtgatgatgacattcttgaaattgcacttgaagctgtaatgaggtggaagcctctggactctggttgctttttgttttaagcgactgcaaacagagggcttgggaagtgcgcctccagttggcaagaggcccacgatttcttacataggtagtcatcccatcccttttcccactgggagatgggcatgtcttgtccccaaaaagcagaggacccgggaggtaggcattttacagccaggaagtatcgctggaccatggcccacagttaagacacagtatctgggaccagaagaaagcaataaaaggtcaggacacacgtgccttgtgggtgggagcagaagagatggcccaacatacacagtcatgttatggaatgtaacccttacatgttatggaatgtaacccttattcatgacggttacattccataaagtcaccacaaacatgaagtagtggacactgagacgttggtcctgaggaactacagagttgtttcctgtgagcctctgcccacattttgtcaaccaatcaatacataaccttgttttaagtgtgtttctatttaaagacaccttatttaatatatatgattgattcatgaacattaaactcctggccactagcaccgtaactcgcacctgcgtgaagcttatttaatgcacgtgttttctctgtgcagcacatcatagccctcctacgcatagtgacacaggacggcacttcagcattatgcttggggccattttaaacagcaaaatcaccaacaaaaagcacaaaaatgagaaaacatggcactaagtggacggtgaaaaggacacctcacagtatgagagctgaattgggaaggcagaactctacatgccccttgtttggcctcagcgggaacatgtagagtttttgtcatctgcacatgtccacagatgactgaaagtgccacgagtattgattctggagttacaaacacattttagtgagtaggcgcatttgtagatgtgggatccacaaataaggagcctgggtggtatcgatgatcaaagggcctagcacacctcaggctattggttggattccacacacaccgccctgtgcatgcttcacatcgctgagccctggcccctggctctccacaccacccctcatttttcatgttggccattgctggcgagagatgcagtcctgtctcgtgacaaatcccacagctgtgactgattgtcttgccggcttcagtccctgggcccagtgcagactgtcaggctggggctccatgtcttcattagctcagtccccagagcaggaacatggctggcatccaggcaaggagataaagagagccaggcactgccaccagcagatcctttaccgtgggaaaccttggctcatcttccatccagcctcaagcctgtctgtgcctcatactccatgggatccagccatgctccagatctgactaaagcccttctccatccctctcacactcccaaaacacatccttcctctatgaggaaaattatcttcaagccaggcagaatcaccagcatacctcgtgttctgtttctccccctgtaatgtttattttagatccccagaggccttggggtatagatggtgagcttcattccatgggactgttgctgtaaaacaggattgggccaattgtccctattccagttgagtcccagtcctattctcccaattccaaaagaaggatgggaaggtgttttgtaaccagaacttgaaccctctgcaaagtcactcaaaagagctgaagtgagcccttacaagggactgtgaagttcagccccttgcaactccaaacccaccccagaggggtgcaaatggaggtagacagaaagacagtcaagagaggaggccttgaaacatagtttttggagttgatttgcatagggagaaaaatgctatatgaggttactgtctccaggagcaagactaaggccccgaaggcttaaccaggtacaggggataagaggttaggaggagaggggatggcatctctctatgatcatccccagaagggaaggagcaaagtttccctcgccattgtgagctgtcaatctgtcccttttccctagcataaaagtccttgggaaaaaaatgaaggtacccactggttggcaggaagcccaagaaacagcaagtacaatccaattagaattggattcaatcaaatttaagaagaaaattcaatccaaaccagagcatcattaaggcagcagttgaagagaactggttagcttgacagcccccacattctcccaattaaaaagttccctaggccccaccccagccccaactccatctcaccataaagacggtgcatgctgaaattagtgctctcccaagtggcacaggccaaatgcaagcactaggcagtgcaggtagtgatggagctgccccacatgacagtagactcagaagcagagccctttgccctcttatggtttgtggtgctgtccctccttccatggtgcctttcctagagtgtggcttcagcaaaaaattctccaaggtgcttccagcagcctcgtgccctgaactgggccttcatgggtgagagaggaagacatcatggctccaagaattaaccaagatgtcctatgcatgtacacacacacacacacacacaaatacacacatacatgcaccaccaagggcctcattccccaaagactgcatatcaaaaccaaaaatactcccctatgcctattttgcaagaaaaggcacagacttgctttgagggttgagaattcactttgttgatgattgccttctcctgccagcctcctccttgctcagaaagtgaattcgaagtcagagagaaaattaggacagaatcatagaaaagaaatagttattgtgtcagaaatttttcaataggccattcttccagcaaatcccaccccagtttcaatttctactcattattactttaaatcaaatgcatcatttaacttttatatcatcttgattttatgtatttttctattctgattggatttctttaaaccaaaagggcagcccccaggacattttcttgtgtttggaatcttcatttgtcttcatgtgggagagaaccttctctagattagaaatccttccaggaatgctgagtggcaggttgagctcgtcataagaatagagattgaggacattaaatctcctgggtcccaaatcagtggtatactggtaaatatttaacaattggctctctatggggaaagccctggttttcagcatttgccagttaccatggtgtaaatattcccactgtggccgatctcaagctaccagcgagacatccctgaagccagagttgggaagagacatgaatgattggctctcaggacctggggcgagtgagtgggctttggtacactgccggtcctaaaaccttgtgtcacctggagacccttgggagaattttaaactaccactcaatactgggtgggatggaaatgcatgttctggaatggtggtggaggtttttagttactgcttggaacgagttcccaggtcttcggagaacagttattaaaaagcaaagcctgtgatcatgatccaggaaaagagggagatggacttcatccatccccttaagcctctcctggccagtgtcaggaatgtccccttactgacgcttcccatcgaggtgatagtagacctaacctaggctgactagcggagctgtctgtggaaagtaggggcgtgtgggcaggtttctccctgcaaagcaattaagactcttgtttctccttatctccatctctccttccatcctcgacccttctcggtgctccctccttctctgtgctctcctgccctgcccctcctctcactctcaccagagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacagtgagcagccgtcttcttctgtgtttgggctgggttctgggggagaggagacagcatcggggtcagcacagaactttgaccgccaccctttcttagaagcccacggggtgccttcctggagcagcagttatctcactgatggcagtcacttgctgcacacagacatcggtcacatgtgggaaatcatagctgtcgatctagaaaacctcatgctccttttagaatatttcaccttgaaagactgttgagattttgctaaggcagaggcttttttaaaatcagagatccttctcctccaggttccacctctttgggcaggggcacaggcttcccgtttgaaagcgcaggcttgtttaaaaggaacaatgtgtgccaagcagctgcctggaaaactttatacctgctcaggattccttccccctttgcagatttccatgcaccactgagctttctcataggaaaggtagtgaaaggttttccttaagggggttagattcaaagacctggggaagtgctaagtgggagtgttgggggaagcccagaggaattcggcagaatgcaattaggtgatggaagttgagccaattcccttccttgggggttcacgtggccccttgttggataggctgtggctgagatagaaatgaaagtgatggatgacattgactcacaaatacgtaaaaaatgacggatcatgaaaattcaggctcttaccagactagctccatggttctcaaagcatggccgctgaccagcagcgtcagcattacctggaaacttgttagaaatgcaaagtcttgggccccactccagatctattgacccagaaactgtgggaatggggcccaggaatctctgttttgacaactcccccaggtgatcaagatgcatagtaaatttgagaagctttgggttaactctaaccactctctatatctcatttggccttgatctctgtgactcgaatcatactctttctttctttttctgtgtgtgatatctttctctttcactatacatgtttgaataggtgcatttttgtcctctcaagcagccttacttaaaaacagtttcctaaacactgagcatctagagtactccacgaagcaaacaggttaaagagccatccagggcatttgctgcgtggagtcatgctggtaaagacagggaactggaacttcaccctgagcagagaggatgatgagaagagctgccaggagcagaaacaggtgcaggaagaaaggacgaagatagccaaagatgttcacgggagcagaatctctgctccctcatttcaaagatagctttaataaatctatcaactgctccctttctgataacgctgctcaaggagcaaatacaaaattaaagcacacaaacaacaagggactgttaacaacataatgtagtaacctaaggaggcctttgtgctccattaagtggttttgcaagttggaatacagggcctttgatggattataacaatgagggtcttcctggaaaaatgcctgacaccttctattacactgttgatggaactgaggagtagttgattagtttgtggcactgagtggtatggtaaataaataagttggcctgtgagccacggagaagcctacctctaaaatgcaggaatttgtatgctggctcctggctccaccctaagtcagagcactggtgctaccttgtgactgacggtgatgagcatttctgtagcgcgtgttattgaaaacctgcagtagccactacacgcttagcagccagtggttatccaccgagataacagaacgttgctattctgttctccgcctaaaacaggagcttccaagggagagtgtgctgcttctccatctaacccattaaatgaataaattgttaggagagttcccagcatggagtattatttgctgctggagcagatcacactgacaaggcccatctacccaaatttcttgacaaactttgagaagagcataatgagctgcctaacccaatagacagtctcgctaagattttcctaagcctagataaggatggccttagactctggagactggtttctctcaccttgcactgcttccttacggctggaggagccctgggggtctgtttcttgtcctaagaggactggagtgggagcctggctccttcattagtggaaatgctaattagtgggacagttccaggggatgaggcaggggaatgaatattttaaaaagcaagatgtagagagtaagatagacacatgcaatgaagtggaacgtgagagacaggagtggagctgggaagagactgtgtctgttggggaagtccaattaaaagtagaattgatgtgatgaaatgattaaggaatcagaggcctaattcacttgcaaaaaaggtaagacagtggctcagaaactatcttcctgtcttgagaatttcatagattgctctttgaaacaaatacaaggggagaaatcctgctacgtttgaagcatgtgtgtttcaattaccgtaatatcttagcctttgaaatttctaaaagactatagtatggtatgtttgccaattctcttcagctcaaaagccaagtcatcttttaagagaaaaggccgatcactcttcatcagcagctgtggtgactccgcttctcccctgggcagcatctggatgcccgtggtgtgaggctggggaggtggggctgagtgcagtgcaggagctgcttggtgacacccagcatatcttaggggagcccagggattctgtttccttagggaaagctgcaaaagccaccaaggagtagaaaaaatgggctggaaggacaacagaaagaaagcgtgcagttggggacatttctctaaatattagtgtaagtgaagtggcccgtaagttatatacaaaaatatgttccagttcattcattcattagtccacccatccacacatgaaaggtctgctctctgccaggcactgccatagacactggtgatagagcagtgaacaagggagtcaaaagtccctgccctcgtggaacttagattctagtagagagacaggtggtaaattaaatagcatgccagagaggggggaagcagtgaagggggaagagtgttgagaggttgtgattttaaggggtcagccaaggaatgtctcacgatcgaggcagcattggaataaagacgtggaggctggaaggaaaagcaccatgcagatagttgggaaaggagccttctagaggctagcgagaaggggccaatgagaaggggccacgctgatgaatccggagctgaggaggcttgtgcagctggagaggagggagtaagggggtgaatggtgtaaggtgaggctgtgggacccaaggagtagggtatataaactattgtgagaacttggctcttactgggagtgaaccaaagagcctctgggtatttaattgctattgagcagagaagcaacacgatctgacagacacttatcaggatccgtctgcctgccatgtgcagaatggaatgaaggtgggccagggagaggcaggggtcccgtcaggtgcctgctgcctcaggagatgctgggcctggtcttgacacccatggaagtgataaggtcagacttcaggatgatgtcatttgcagacgcgtcagatatgggatgtgagagagagaggtagggcattttccaaggcaattgtcctaaacgatggcaagaggggaattgtcatttatggatatggggaagtctgtgagaggaacgggtgtcagggcaggaggatcaggaaagccatctgagacctttaagtttgaagtgcctattaaacatccaggtggagatgttgagtatgtaataaggaatgaacctctccaggagagagatctgtggctgaactgtaatttgggaagtcaacaacatatagaagatacttaacccctggatctctggataagatcactggggtgtgagtgtagacagaagtgagatgctgtccaagaactgagtcctagccctactgatgtttggagattgggatacagggaaagaaccagcaaacaggactcctaaaggcatggccagagagacaggagggaatgcaaaggaaggggtgtgagcgttgctgctgtgactggaaactgaccattgggcttagcaatgtggggctcacttgctggtgccttaacacaggctgttggatgaaatgctggggagaaagcttcctggcaaatcagccttaccctgtgcatctctcgagtctgcatgcctcctgcaatggcatggagcgttgctctgcaggcttcttgcttctttggcatggcccagcttccagccatctgaagagtctggccatcaggaaaccagaaagaggagaggaggagactcacacagactctagcatgcccatggcctcaagacagtcagtgtctaaagcttagcccatcacgatgttcccttctacagcaatgccaatactagccactgcctctgcaatgggttacagtcttggaaaaaagaggacgtgatactcaagagccatttcagagccaaaaaggcaaaaaaggggcaagaaaggggcatgtttatgtactgttgccctggatgtggcttcctaagtggggcagccaagagccaagccccttttctctctgggtaaagactaggataatgttgaggtctccccactctagtgactgcttctcccctccctctgagcagcagtgagaagcccctgtgaagggacccattgcagaactgtcattagtgcagggttattgtcatcagcagagatgcactgctcaaagggacagggctcatcttccagctccgacgttaaatctaatagaaggtcagacactacagggagaagccataaagaaaaagagacagattctcttctttttcctcttcaagatgaaaaaacacatctattaaatatccatccttacaggaatctctctttcatgtcattaagacaacttaaatgcaccctggctctctaaagcttgcagttcaatacagacattgatgtggatgagcacgtaaacagacagacagacagtggaaccaaaatattgaatttccatgcagataagcaggattaaatatttaccccatggtatcgagttatgtgactcgggagccacttttgcagtcatcaccagctagcagagccacgtgcctgctgcctgcccaacagagtctaggatcacatattactgagacaggaaattggaaggcttgtaagagctgcaggttgcccacgatagggccccatgtggcttgagagcagtaacctgaatatcgctgatttacattattttatatgtgtcaagggcatgtacatagttatttgatctttaaaaaaaaatcagggccgggcgtggtggctcacgcctgtaatcccaacactttgggaggccgaggcgggtggatcatgaggtcaggagattgagaccatcctggctaacacagtgaaaccccgtctctactaaaaatacaaaaaattagccaggagcggtggcgggctcctgtagtcccagctacttgagaggctgaggcaggagaatggcgtgaacccaggaggcggagcttgcagtgagccgagatcgcgccactgcactccagcctgggcgacagagccagacgctgtctcaaaaaaaaaaaaaaaaatcagtacgatcagtatttatctagatctctcgatacctacaacacaatcccatgtcatggcacatacgagtcacacaaacacatgtgaagcatctggctcagattacatgagaagacatgccaatatttgtttttgtccttgattctgttcataccttgcactgttgagtgatcatgctgccaggccatgaagtgagagcagatccttaaggcagagcctggaagtagctcctgggccttcacgttaactcttagctggtcctaatcagagccctggaaactttagtgctggaaagttgctggagagatcaggtgaggaaactggagcccaaggtgggaaacagccacctgcctaaatgttactgaagtcagcactcaaacccagggctccagattccccatgcaggaccctgcccagcagaccacagtgctccttacagaaggcttcttggatacccaggcagcagcactccctaactgtccctctgtccccctagctcttggggcacatccccatttatcttgtggaattacatccacctctttacacttgcttgctgggctacactgagaggtccttcttggggctgcctttaattcaccgttgtgtccccatgacctgacacaggccagagcatgggaatgtcatggcacatatgagtcacacgaacacacgcaaacgcgagtgcatgccatatgccagttttggcaaagcaccttctgccatgctctaagctgttggaacaggtgagctcacactgcccctggactgagttggctcattgttctgtctgctcagaattgacttccttgtggcatcaccgatgacatcctttcaaagtcatttcctttcatgaacacggttgctttccaatagccctcagtcactctcaactcttggaaggcaccatttggaaacaggcgaataagcacagagccccccatacgtgtggacagtggcgatgacagggaaattgaagtgccgtgggaaagcattgggagttcttaagcaacgagattttgctgttccctgaagaccatggtggctagtggggctgtgtactggggctctgcagtgaaaccactgatggatatttctggttctggtagtcatgaatacccatgggcgaggtcctgtggacttggtgttgtgagaggcatctcacccaaagcggggcgtgggggccatgttgtagtaaggatccagaaggggtctgttcattggtagcacattacctttggagcacagcctggctgctgtgctatctggccccgtaagtgtacaaatgccattttcccagccaggggagcagtggaagagctatggaaaggctgtattgtgtatacagtgcgaagtaggcacgtcagcctgtttcagtgagctgtcggacacttcccaaagcaaaaccaccagctctgggcaaggcttgctaggttaagctgttgggaagccatgacagtcttctcattgcccaatggccgtgtgcttcagaggagggaagccgtgacagtcttctcattgaccaatggccgtgtgcttcagaggagggaagccatgacagtcttctcattgaccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgaccaatggccgtgtgcttcataggagggaagccatgacagtcttctcattgaccaatggccgtgtgcttcataggagggaagccatgacagtcttctcattgcccaatggccgtgtgcttcagaggagggaagccatgacagtcttctcattgaccaatggccgtgtgcttcagaggagtgggaaggtgacagccacataacattttgacaggagacattcatagcttcctgggcctggcattagatcagcataaaggtgcctggcagctctgccaagccatcagctaataaaggctctgctccccttggggagacgcctacttgactttaggggagtgtccaggccaaaacgataaccttgataagccaacaaactccagaatccagatggctaggtttatggtggagaatattgtcaataccagctgagaaagacaccagaagaaggattcccacaccctttttagatacctgcctttgtattggtctacctttcactgtgtaacagctatggtaggaacagaggctgtgtggaggggcctatgagcagcaggggctgggtcgggtgttgtggaggccacactgtggttttggagggacaagagttaccagggagccaccgggacctctcctgcagtttaaagtggatgtggatagagagcagctgtgttcctgggatcgctggctagccagccaccctgcaggggcagagcaaacaggctgttagctcttgaactgccaggcacactgggggtccttggcagggtgtggagcatgaaggccctcttcctctccagggcctggaggacagcatcctctgcctgcccgccagggtcccagcccaaaccagcatcttccgagcccacttctctctccagaggcttcttcatcttcccagttccccaggatacaaagccgccttcctctttcctctcctgtgcccttccacagttatcagtgcctgcgttcagtcagtcaagtcgtatgggctgtcctcttcgcttcttcgcttggacttctcactccttccctcctctcccctcacctctctccgcctggactcgcagccaccttgctgccctgccttccagccccgttcccacgcaacctgtgtaatgcagccaagttcatatttctgcagccgactgtgtcactcccttgttcaaaagctttgaatgtgtctccatgggtacagaataaagcctgaacatctctcagtatttcaggcatctccaacctgtcccagccaatagcttgaaccttatcactccctactgccctgccgcaaagccagactgcatcttgttttccagaaacgcctgctgctgtcctgtttctgcacctttacccatctcccatccctctgcctacagcacctgtttcctcccctgctcctccgtggcctcctagcccaggtcgaagagcacgtcttggctcaggcctcccagagcccccatctcaggacaggcactgtcagcactcaaccctcacctacccaccagtcggtgggggtggcccagccgtcttgttatatagaaagctcttgggaggcagcagcgtgcattggtaacttcttattcactctcccactcagtatgtagggcaatgatttctatttcacagacttcccccaaaaacacataatgaattgaattgaattctcttcggatcagagaattaaggtctgatagccctatattcatacctagttggccaaataccatttttccagtcttagccatgctcatggtagcccccagagagtgtattgtggttgacagaatgggcagaaatgatttggcgttgagaaagtgggccgagaggaaagtttggaaggagttagaattatatagtcccaggagaagagaaagccgggagtcgacagaacagggacaaagctgcctcatgcccacatactccccgtaggaggggtcattgtttcactgtatggcgtcaacttttagattctgagtttggatcatggatacatttcagccctctggggctctcctgggctggggggcagaggaaggacaggggcagaggcatgagaggggatgtctttttcttgcatggaaggtgaagaaggcctggatggtctcctttcatcttgcccaagatcatctcacatgggtattgtttgccccattttgcagatgggaaaagtgaggctcggaaaagttaacgtattcacattgttcagcttgtaagttgcacagttatgtggccgttgctccctccgtaccatgctggtctctaccacaagccccctcacgaatgcccttctcttccaaccaggggaaccagaagtgggccctccagtcccccagccggaacagcctgtgaattttccttggttgttgcatttatcgcttcagcctaatatgcaaagcaggtggacggagaaaggaggaaaagagcggagatggggcgggagggcgggggcggtggtgctggtagtagggcatgggtttgatttttttttaagttgaactttatgattctgagaactctgtttgaagcatggaaagaagttatggcattatcttgctcacggaaagaaaaagcgaactgaggtcaagcgccatccctttggaatggtttaagaggcagttttgtttggaaggagatgtgtcaattccgtgacctatccgatttccttcagttcagggttccttgggactggcttagaggagggtgttgatcagccacaatgctctggggatgggagttctagcttaccactttcctgccttggcaagtacggtgtgaggaatgtcatggaaccgcctctgatgattctgggctgtgcagtgctacagcgtcatcacttctgagtctctgatcccaggaacctcagcactatggggccccgggggggatcactgacacgtggtgtctttggagaagtcctgtcacctacctaaagccacgggtcgctttaagaatggatctgcctgtgtccacttggccttgcccagagtaggcactcagtaaagagctgatttgactttaatttggtgctttgcaaatcgatctatacacttgggcgttaaagtagctcagcagagggatggaaggggagatgaatcatcctgagtttccctttgatccattttctccaataaccagtgctcagccccgaaacagagctgcctacactacagttacccttgcctccctcacccactccacgcttccttctctgtaaacagtgggggtaagaagctcatgccgcatcaagatatcttaactgtcagaggctatcagtggaggggagagtgacagctccagcctttctcactacttgctgatgtggaaaattatcatccagtaatggagggagattagccacgtattgtatttccatcgtcgggtgcatggcatgggaggatgatttatagaactggaaccctgaagctagtggaaaggtcacagaaagtggaatcattggcctcaacacagtggctagtgtctgagggaacctcctagagccacatgcatgccaggccatcctgagtgcttgagagagacatgggcacattaacacacatttaagtcccaacagggcacccagaatactaagataaatagacaccgtctctgtcctaaggggaattacagcctagttcaggagacagatgcaccaacagacaggtgacagtgatgaattgcagtcatgaaccaggggctggagaaacacagaagacagagagcagagtttggaagagggtgggagggactgcctgccccaagaaggattcatgaaggtgccatgtcagtcagggttggtggaccattgtaataagcagcccccaaatgaaatctcagttgcttagtacagtaaaggttacttttcaccccacggtggagtgtgagctggggatgggagggaggagagttccaccacaccggtcttcaggccccaaggctgcaccccttttgtggctttgccacccccggggcctcacagtctcccctgtctgctctgcatcgggccagcagaagagggagcagagggcctgctggaggcttcagcagccaggcctgggagtgtgggcattgctcgcgacacaccatcggccggaacacagctcccacttccgcctgacttccaggggactggcgaagagcagctaactaagtgctcgggggcagaaggactggggctgggtgggcacaggacagtgttcctgctgcagtttggcagcaggtcacacggccaaaagatcgcaaccggaccttctaagctgagggggctacatttgcaaagttgtagaagcaaaataatttttaaaagaaggaaaggaaatggaattgcacatgtttcatggtgatttgagttcagggtgcacaggggagaagccaaaaagaaagatcaggacagaaagactgggacctggtcccaaagggcctcggagtgggactctatcctgtggttaaggaggagccaccgaagagatttaagcagagggatgacaaggtaccagtttaccatcgaaaggtcactgtgcagccgagtgtggacaatgggctggaaggagagagaagctggaggcggagtgggggtcagtcagaggctgataaggcctgagtgggagtggacaggcggggaaggattggaaagagcctgcatccactgggatagggtcctaagggctggcaggccctgaacacctatcctggaggctccaggataaacaccttgtgcttttcagcctcaggaatgatggaggaggttgtgcagtgccatgcccctctgaggggctcttcctgggagttggtttgtcctgcctgctccttggtgggatccctgccatgaccctctgccccttggcattccaaggcctgtttaatacccatgaccataaacacacccacaagcagtccccttaccctaaaaggtgccacatggagaattccaagcaactcagcctattaaatccttgcctgcatgattaaatgcctcctggggaaaaagtcgagtaacaaccccaaacataggctttgatggctccatccttcaggattacttcaccaaatggaaatactcatgcctctggtgacagctgcagtgtttccagaagagatttctaccctcatataataggagagactttgtcctcttaaataactatgatacctgctgtaagtactgaactgttaatcaccgtgatcactttgtgtcgatgccacactgctagagggacagaactgaagccttgccagaaacaacagagaatctgctcaaagagttgcctaatgaaaagggtggtctgttggggagatagatggaattcttcaaaatagaaggcaattggcagcgttaggctggggtgagggtcaggagaagaggggcagctggggagagaagggctggctcatttatgtcttactttctttctatatcctggtaccaggtgctggattccttatttagccatgtggttagctccatcgccatccaaaaattacggaattctaaaaccctggggcataaagggggctccaggtccctgagtctgtcctcattccctgggcttaatcatgcatcccccgaaccacaccctaccccatgtgggggctgttggcccaaagacaagtgtctgtgctgctattccagggccttgtcacatcacactggagtgaccacctcccagctgacagtgctcccggattccgtttcttttagagatatgagcaggtttcaacactgtctctggaaaaatcacaggacatgctcaaaggtagcatcatgggaacagggcaagggccttccacaacagaacaggaagttgtattcatttccaaacacctggctttgagccgaaacttgcactttactgataaggccataaactctcctcctcctgcacccagtttgattcaccagcagggcccacacatgtggtgccatccagagtcatccctcctcaaaggaaatgatgggcaagaaacgtgtttgcacaagagtctctaaacacagcccatgaatgaatggtctccggtgaaggtagactggagtgatagagtagcatgttcacttctacatggcgctgcagagagcctaagaagagaatgaataaagaaaagtgtagccatttactcagtcataaaaatacacgtccattgcaatttagaattaatacagattagttcctccgactgaagaaaagtaaccccagcaaagatctgcagggccgagccactggacagaagagctttgataagagaaatttaaaggtttatgctttctaaatagatacatttgaattttgataaaagagaaatttaaaggtttatcctttctgaatatatatatttgaattttgataaagttattcagtgttttgttttattctacaagaaagtaaggatattaagacattttaaaaatgtctgggcagaggagcccttgctgttccctaaatcatgttctaaaaccttatttgctaagcctgagtctggttttgactaacatggcccaagtcttactctaagaacttcaatagtgccttgtgtgcaggatcacagtgtataaagattagaggtcaagcgaagacaaaccgcaggccagcactgttaaagaatgattacaactgtgctgggacttgtttgtgtcttttgcttgaagtaatagactagatctactctcaacaacttactgatgaagttgaaaagccttaattatttgcttgacaggctagctttaaaggaaaaagcctttgtttaccttctcaatttcaagcttcaaatcagcctgtccaaccattgtatctcatgtccatgactcatgagatatgataatggtgtccactgtcagttattatgttaacaaaattatctgaaaataaccaaatgcacacctactaacacatgcacacacaccaaacacaggagcaagaagaaattaaggactcctttcttgtcaggaatattcagaattagagtctcaatgaatttactaatattcgctaaggtcagctgggtccagctttgagtaaaaagcttggcatgatgcttgctatgcctggcagaggcagagaaaaagatccctgctgtccccacaggggagagcatctgcttgacatgaaaaagtaatgtcagtggtgggtcccagccccttggaccacttctgcattgactaggaagctaaggggtcagttgctaaccatcaggccgagcatcctaggttttcatcaagaagatcccaagcttcaataaaaactgcagagtttcttcttgtacctcttagatggtatacaatcatgtccatgaattataatttccataatcccttagtaaactaattctattaatctattaagtcctaccccttgattagatgagttgagaatacagcaatctgggatgaatgaccctcatgttcctctcccaacaggatgccagagtttttagtctgaacaattgtcgtgtgctatacaggaactaacaggagccagagaaaagcaggcagccagacttcacggccccacttgatagccagtctgcagttggcctctcccagtttccttgcttgtaaaatgacgggggttaggtcagtaaaagccccttccagctttggaatttgtttctgtagttctcagttgacacacgttagctttagctccaggagcctgggccaaacctgatcatttcagtccatcagaccccagaggaattcagttgattctagcttcttaagtcctcagactcctggaattgcacttttcctcctgcaggattgcctgcaccctgaaagccagcccgttcttccaacgatcctctgcacacttgtgcacaccctgatctctgcacggaaagcccagccccaccatctgccttccgaactgccatgttaccaggccaggcttgccctacccatcatgccatgtgccaatcacggagacacaagttttgcagcggagaaagcgtttgttcacaaggcagccaagcaaggagatggaagagcaggtctcagatccacttccccaaagatggggttttagggatatttatgggatagaggagcaaggtccaaggcatggggaaaggtgattgggggtaaggaaaagtgaggccgtcggttatctgcgcaagtatagtcaagcttcacagctcttcctgggattcaagttcacaaaatggcatcgttagcgtgatctgaggatggatgtttgggccctctgatgccaaaaggtcgcccattggacactcacgcaggcccagttggaggattagtggtctgagctagcttgaactggacaagagctgaccccaagctcttgaaaaatgacttaagcaaccattatcatggtgacttatacatcagagatgttatctgtaaggaggcttgtagaagtttagttacatattccttaactacatgacttttagctgcatatgttttaaaatcaactagaaaccagtgaggcaagttaggtttggtgacctcattaggttagcccttggtttcaccaccccaccttcaaagccccatcaaccatcccttccttttctgccttttctatcctcaccacctcttctccccagcagggtcttacccgctccttcatgctcccagaaaccccattccacagctgcatcatagtacttattgtatgtgatctgtagtgtctccctgtctgctgtattcattgcattttatctgtggcattcatctatctgataccgtctgctgggtagtacatcttgaatgtggggacttttgtattaccagaatcccatacagatcctggtgcataggcaatcaatgaatattggttggaaaagggtttggaaattgggggataaaagtagggtcttggcttggaagtccttggaattctgcctctgggaatggatcacttaggcctgctttgtcactttgtcagatctaaaacgaggttgggccagatctgatccagcagaggatatgtaattaaccaggcacataaattaatttttaatcttccattccttgcctgtcaacatttctttttcacttctcaaggaggacatgattatcccatgatgtttttcttcatgtactaatttctcctcctctttcttcttcaaacctgtccacggaagtgtcagaaatacttctcattttatcctttctcaggaaggccagctagccagctaagaatagcagtcaggaaatggttaagagaataccaagaataaattctgagttgcttctttacaactagaaagctgaatacatttaaggcttgaaaggtcaactcccttcaaagggggcagaggtttgatttcgtccattatgtggtcttcagcacaatgctcatttcattcactggctgcaatggagatttatggagtaaatgttatcacaagctgagacttaatgagaactcagctgtatctcctggatgtagtggaaagcaaccattttggtaataaatagagaacagcatctaatttgtaaattcctttttccgttgctaagtttaatcagatcagtgaaactgaagggaattgttgatgaccaaaaattattttccatgccttaatctggccaggaaacattactcctaatggaaatggcctgttgctctggcgatggaaggggatgacatttgtcattagactaacccaattgttgcatattgataaatatgtttaggccaaaatctatttaaaacccaatagaagctgaggccccatgttgccctggtactggtgttactggttcctagaagtaaaaactctttccagttaaactacagagatctgtagcagtggccatcctaaagatttcttcttgccctcagtgatcatccagagcaaggccagaaggaccatgatggagcccaaattgtggtcataagtgaccttttctgaatggcagagagtgggttcagagaacagaacacaatctctggcagggccttggcttactttagggttaaaacaaattcaagggggcacaaaagggagttgaatgcagctctcttttttccagcggtgcttcagtttttttcgtgatgaatcataaagatcatttccaggatagggaccatgccatgggtaagtgaccgttaacacgcagtaggaactttatgaatactgcatgacgagaatgacagcaatgaggaacacatctgagaagctgatggccccagagggaacacggctaactgtgacatctttagggggtggccctgagaatgctgtatcccttccagtaagagtaccgcctccaggcgacctttagacgcacagcaaggggtcccgaggacattcttctcttggcctgcacttgcttttatattcatgtgcttttgtatacatgcccagtgtccaggcatcctacacactcagagctctaatactgaatattaggaacgacagctactgctcatcaagcacctccttttgcccatattatctttgccctcacttcacattttcagatgagaaaagtgaggttcagatcattggcctgaggccagttcgctaacaggaggtttacccaggcttacacccaggcacgccccatctgactcgaaagccttccctctttctcttttgtcagagaggcaagcacatggtaaccccccagaatcatgagcctggtgataggagaagtggagtggaaagaagccctagaaagggagtatggagacctggttcctagtcccagctctgatactaactggccctgtaacctaaacaaccctttcctctctgggcctcaatttcctcataggtaaaagtaatacccaaaggatctctaattgtctgttaatctttctgcattccaatccccttgaagccccatccagccctgtctttctcttggagtttcacattccagaacaagtctgtggctaagctgaggagaggatgccctcattttgcaaagagacgcttctcccatcttggccaggcagcagaggtcacaagagaggaagtgtccactgcataaggactctggacagcttctctgccagcacgcatccagcagctgactctttcctcggggcccacgctctcctgcccttttcccagagccactaccctgacaatgtctgtctaccttgagagcactgaacagtagaacctcagtgccgggaggtgtcctgaggttctctccttctctcccgtcatccccacctatgtgtgaaactcctctacaacaccttcactacggagtctctccaccctgcttcttacacactctccgtgtaggaacttaccagtcacaaaaaacccttccatctttgtgcaagcctcagctgctggaaggtcttccagctgacacctgcagctattgagtgacagtggaaagacagtgtcctgggtgcagtggcatcctcccgatggtgtggtgaattatcctggcatggttaattactcacactaattgcttttctgtcactgcgctccctcctgcctcctatgtttccatgaggggttgtgcttttgagatcttttcccacctcttctccctttgtcctcccagtgactctgagggaagcgctgagctgctacaccatgttccttctcaaccaaggagccagcactgagcagagaggagctcttgcctcttgcctctggcccaggcaggcatcagggatctctctgtctctctctgtctgcctctctccctcccacccctcgacacagtccttccttcctctctgacatctgtgcttggtcactcccatctgcaagaaggcccgctcccccacagtattattgagatagtaacaggccactgtctcctctctgctttccccaaatcaggcacatcccaacttcaccatccaggtagttgttactcttgtaatgtaagcagcaaaagcgatagagcagcttgaagctgcccagggcccatgttctggctggacaggcccaccgatgcctgtgttcacacagcccacactgcccgacactcccactcctcaccccaagagccttcctgtgttccatccaccaggaccaggactccatccccaaatcagaacctctgtgtcctttccttccttccaggtttcctgggccactgagcctgcagcatgaatcctcctagaatttaagactcagaaggagacaggtcacggagaggtagcagtgtaccccaggcagtcgggcccaggtgagcccaaggtcaggcctcacatttcaagtcgatttcaggatcattaacattcccacttcctgtcatgcccccaggccttttgcttgttgaagacagtggtccctgttctctggatttcaaaaaccatttctctcttctgaaggaagaacaatcagcgtccccaacaagcccagctctcctgagaaattacagaatagttctaagattcgggcaaagagggaggagggatgaagggtgaagaaggcctttgattcagactcagccttgagaggaaggatctggagggagaggctgttcagtggaataatgagagtgacagaggcaggcgttcatccccgtctgttctttttgcacttttggtttggggtcggtttctccttcaatgtgcttggcttagagctgccccagctgctgtgggcatgaaaaccactgctcaccagtctccacatcttggcccttacccaaaataacccaggagggaggaaggagctcatgggtgggtggctggataaatggctccagaataatggatcaaacattgaatgagtgaaggagtacacaccccgtcccttggccccaagatgctcattcatacccctctctgagcgtgaaggagaaacagcaaaagctgaatttggggtgtgtgccccagtgccagccagtctttccagggtgcttccgatgcctccagtggaagtccccagccatgttccctccctggggcattcccatctgccctcccagggaaggctgcttggtgcagcagaggtgtgctctctgggagcttcggtggagaggaaaggacaggggagtcaggatacgagggctggtggagtctgccaggtggggctagggcagcctcgctcttccttgtcccaggagcacatgtcaaaagcgccagggctggggaagcagcagggagcagaggctggagaaggcctgcgtccctgtcccggttctgctctcggcagcctcagttttctcatctccacctgtggctggagacgccttccccagtagtctccccaggttgttgggagcatgaaatgaggtgctgtcatgtgagcgcttgaacagccacactgctggactctcctaatgaacgagcaaagaaccatatgtgtcagcacaccaagctacatggcacaaatagtaaatgcctcagggaaaaggaccattctgggatgccacgtaggtcaaggaggcttcatggagatggtcggagttggagggtaggtaggaaggcttttgtgcatgtgggggagtggtggggatggaattccaagagtggggcagcagggcaaagacccagacacaggcgcacagctcccagcaagcgccctggatgcattaagccctccatcagtggtgtcaaagcaagaggaaccgtgtgtggcatattctggaggcagagagtaggactgagtgcatggatcagagggcgaatgctggaaagggaaggtgtagttagatgggtagagtgaaagcggattgccaagggccctgggagccaggacaagggtcccgtgtgctgagtgatagtgatgtgacatggtgaagtccctgctgagaaagactcctccagaagatgagagaattacgtgtgggcttcaagcccctctctctctgtgccgagagtccccttacaaccaacaacttaactgtttcatccaatcaacccactcctttcttgtagagcttaatttttttttccaaggcaaagaaatcttagagatctcctctcaaccttcacctcccccacccctgcagcaaatgcttatccaggctttgcctggaaacttctactaatgagcaagtcctcatctctccagatagccaggccatttgggaaatgtttcatccattagggcacgatcttcccctgcagttctccttctttagtgcagtgccctctaaaactactctgggcaggtgctgtcttcctcctgtggaaaaaaacttcatatgttggaaggtggtggcgaggtctcttaggttctccttatctaaattaaacctttccattttttcttctactgttctctataagtgacacaacatgacttactggcccttccccatcaaagaactctattattgccccctttagacatgatcctgagcactgaacctctatcctaagggggcctgcctgatacatgggagagggaagccctgcctccctgggtctttgcctgtagcagtgagcctagaaatgcatgaagccgcaggacctctcacaaaagatgtgggcaattaaagcagctagagccgggcacggtggctcacgcctatcatcccagcactttgggaggccgaggcgggcagatcacgaggtcaggagattgagaccatcctggctaacacagtgaaaccccatccctactaaaaatacaaaaaattagccaggcatggtgctgggcgcctatagtcccagctacttgggaggctgaggcaggagaatgacatgaacctggggagtggagcttgcagtgagctgagatcgcaccactgcactccagcctggacaacagagtgaggccctgtctcaaaaaaagaaaaagaaaaagcagccagaggcccggcatggtggctcccgcctgcaatcccagcactttgggagggcgaggtgggatgatcgcttgatcccaggacttcaagaccagtctgggcaatgtagtgaaaccccatctctattaaaaaaaaaaaacaaaataattagctgggtgtggttgtgtgggcctgtaatcctagctacttgggaggctgaggcaggagggtcacttgaacccgggagttttaggctgctgcaagctgtgatcacaccagtgcactccagcctgggtgacagagcaagaccctgtctaaaaaaaaaaaaaaaaaaaaaaaaaaaaacctaaaactaaaacaacacataaagtagccagatggaccaaagactctgtctgccccagggcaagaaagaggaaaacaaactgcaagcatccagcaggcagagttgggagaagaattaaagcaaaggacacgctacatagcagggcaagctgatcgatattctgacagctgcccataaactcattcatgaaattatggggctgaagagacaccatggggttggagttaaaatgactcacttcacataaatgtcatcaatggcggcagcctagaaatttaaggcagcaatttacttgcctgctggaagggaagacacaaatgagacctgtctgaggaagtcttgctccatactcaaggcggctttccctctgtggctgttcacggccttcaaggtagtgctgggcccctgtagatcctccttgcaggaaatctgacctgctcttcagcagcagaaagcagtgaagcaggaaagacggggccccagagaagagagaaaatgagaacaaatcgtgagctctgcatagctttgtgaacggcaaagaacagggtgcaaacgtcaaaactcatccatagtaaaactctgacttccgtacaggagagggagcctggggcctgtgtccatccttgatacttttctgaccaagggtgggctcctggcctctccgtgatgtgcatcaatggtgagtgagaaagggaggcagcactgatggtggaaagaggttcaaaactctaccactatctgcctctgcgactctggacaagctgatgaccctctctggaccttaacattctcacctatacaatgaagggctaggtggggcacagtagctcatgcctgtaatcccaacattttggaaggctgaggtgggaagattgcttgaggccaggagttcgagaccaacctgggcaacatagtgagaccttgtctctacaaaaaatttaaaaattagccatgcatggtggtgcatgcctgtggtcccagctactctcaaggttgtggtgggaggatcacttgagactgggagctggaggctgcggtgagccaagatcatgtcactacactccagcctgggcaacagagtgaaactctgtttcagaaaaaataaaaataaaaaatcaaatgaagggctggcctacaatcctacagaccccttctgactgtgatgatgtcatgattaagatctccatttcacactggggaaaccgagccacagaagagtgaggtcacatagctccaagtggcagagccaggatccaaactcaggcccctggcccccaagcccatgctcctaaccacgctgcctgctgactgcttccttctgcccagaggagccggcagggaggccctgggcagggtcataaaataagtggcttctccccaggaccaccacctgcacccactgccctcctcctccacttagtgatgccagcacatcctcagggctctcttacccttgctctcccatgacagataggaaaaggctttataaattcatcaatagacattctagctaagaggatggacttggcatcagatctacccgggttcaaatcctgaatcttattggcgcttgcttggagtaaacgactgaattttctaagcctcaattttctcatccaaaaaatggggacatctaatgcctccctcatagggttacctcagttaatgtatgtaaaattcatggaagagtagctggcatatagtgagtgattgagagactgagctttgttgttaatatgaagatagaaatggctgatgttgctattgcacactctgggagacaaggccttaaaatcaaggaatggccattaggtgtcatggaaccgggttggaggaggattgggggtgcaaatcatactctatccctttccaatcataccacgtgggtgaccatctggcatgtggcacttagcacttaaaaggacaccactaatgtccttttagtagtgagaactgggtttccaaaggagtgctctagagaaagaccaccacactccatgtctagaagatccctgtcccatccctaatggttgcaggcaagctgtgttttccccttggagtgtctcgccctcctgtgtggtcagatagcctgttttccccatagtccccgagggtctgagcatgtcccaggctgccctgccatctctagtgaaggtggggtgggggtgggagagggagtgtgccaaagttcaagagtttgttgggtgcagctaaacttactgcccctgccccctcccggccccatccacctccccgccaacccggcagcaataaccaaggcagcctgatagactccgtggtgccctaatggtggagagagattttctgcttgggagcacaggatgtttatggcctgctgagatcacagtaaccctggctttcttctttggattatggctgcagatcaagggcaggcatttatgcctcctcccagtttatagcagtgatcataattatggtgatggcagagcgcacttctattgtgcctttttaataaggccactttgtttggcttcttaatatttaatcctgttttatatttactttctgatggcttaaaatcaaccaggctttaattgcttatgcagaggaagccaagctgggcctgggctggcaggaagttgttgagaaggttctggaagctgatggcacctttctctgtgacctttccacccaggcaggctgctgtggcctgggaactgtgtttctttttctcttctctttttctctcatccactctttcctcttattctacaaccttcttttctcttttgccattcctttcctttcttttccttagaagagatcctcagttcaccctccggttcaatttatccatgtaagagaccagagttgtactgtgacctgccaaagctttggagctacttagggcaaggccaaggcgaggactgtctttgttgtttttcctggactcacagtattagagactcctaagactccaaactgggcaaacacatatgaagagttccttcatctatccacttgacaatacatatggccacgtgcttgatctatccaacggtagaaaagtcataaggaataactttccaagttattgttttctgaaagagaaaattaaatcagatgaaacatgccgtgccacagttcctcaattcctgggaagtaacacagcccagttgctcaggtctattctgcggtggggctggagcaaccctgctacaggcccctgcaccaccagctctcagcagcagtccagcctgcaaatgtgcatttcagcgacgtcgcctgatggggctgaaaaaggcctggactcaagacctgtcattctctgccatttactagctctccccttgggcacctaacttcagcctttggggactacactttcttttgtcagtggggataataatatctaccttgcctgtgccgtaggggtatgtcggtcagtgtccccatggaaacagtaggtactcttaaactaggtgacttgaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggtttcataaagatgcaggcagggtttaaggacttaaggagggtttcataaagacgcaggcagggtttaaggacttaaggagggcttcataaagatgcaggcagggtttaaggacttaaggagggtttcataaagatgcaggcagggtttaaggacttaaggagggtttcataaagatgcaggcagggtttaaggacttaaggagggcttcataaagatgcaggcagggtttaaggacttaaggagggcttcataaagatgcaggcagggtttaaggacttaaggagggtttcataaagatgcaggcagggtttaaggacttaaggagggtttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggtttcataaagatgcaggcagggtttaaggacttaaggagggcttcataaagatgcaggcagggtttaaggacttaaggagggtttcataaagatgcaggcagggtttaaggaagccagcaagtacagtaccccagggtagcagctgtgtggatctgttaccggtaaaggctggaggaacaaagtgaggggcagcctcagagtcagagagcagctatgtggagagggccatggggcagacatgtggccttgggcagcaagaagcagccagtctacaccaaccctgtgtgctgcagttggggagcgaacgccccacctctctctcctcgggtccacccacggacgtcctgctagtgctgcccatgggccggcccaagcaggaagcaaggtcagcttcctggagcaccaggcctggggagagggaaggagagtgggtctgaggacagactctcaactgtccggcacctaggagtccccttaaaaccccatgatgatatgaagtgttattctagggagagggtgaaaccaaaacacagatccaggtttttacttaaaattctcaccgactccggagtcacaggagctcagaagaggagactcggtgggcaggagggtggtcctgggagctgccacagatgcgaactgggcctctgagaagggatgaaatttggatagatcagggttcagctaactttttctagaaagggccagagagtcaatatcaaaggctttgcaggccacacagagcctctaccgaaactcctcccctccactgctgtggtgtgagagcggtgatagacagcacacacagggcacggcagtcccaggaggactgtgctgacaaagacagggcaggctgcagttcgctgacccctggaatacgtgcaggaggtggacaggcactccagggacagggcatgacgtagggccccatgcacgggaaagaccagaggttggtacggagccagcacgttgaaggatggtgaggagggcagcccggtgtggttggagtttctgcaggaagtctcgggacatgagagagaaccgacagtgtcttagtcggccagggctgcctaacagcgtatcacagacccaggagctggaacagcaggagctgattttatcagtctagaggctggaagtctgagatcaaggtgctggcgggcttggttcctcctgagggtcatgagggaaaaggggtcagtccccaggcctctctttggcttgcaggtggctgtcttgtctctgagtcttcacatcgtcttccctctgtacctgtcagtggccacagttgttctgcttataaggatccagtcacactggattcagcccaccctcatgacctcatcttaatctaatgacctctttcaagactctgtctccaaacatggctacgctcagaggtatgcgggggctgggacctcagcatctgaatttccgaggggatataactcaactcacagcagataagatgaagccaaattacagggtgttttagataccagattggagtcaatgaggtaggaaatgaggaatccttttgcttgttaaccgtaagtctgattagtactttgagaaaataaatacaaattatgccgctcatatgcaaaaaatgtaataagatgggcacctggccaagtacatggcaaagtcaattccttagttccatcctggagtgccgggaagcctggacactggatcccagcagactggtgacctggactcagccattggccttgtatgacatcccaccacactggagaagtttgggtggggcaagcagtgctcccgatacccccagccactgcctgggatgtctgggcctgaggcatcaaccctcttcctcccggaggaggcataagattgacagcagctggtgagctctctggccttggataacgagctaccagctaagttccggaatacacactgggcatttttcttagcaaatctcatgagaggccagccactcctgctgacaggcacatcaggacattacaaagctccatccctgggacaaagtcgaagctattttgggtgaccaaaggtttcggaactaggcagattgtttcatctcgccccacatccatccctcattctctcatgtggagctttgctctggtgccactcagtcagtcatgacgcataaaaagctccgagacgggggcctcaggaacaggccggatattctctatgaggatggttctccccatcctcctgccagtctcaggatgggaaggaagggagtcaggatgtggcagggaggaaggaaacgagagtacagcagcgggcaccaaagaggattttgctcattgtttccttcgtggatttattgctgtcaccttagtgccatttttcttttttatcaaaactaaagtggttctgactctcaatcctttgccaaaaccccttctggagtcattttttattcatgaggatgactttggtcatctttgaacacatcatgctggcctcatggtggctaaatgagacccaatttctttttaaggagaacatgagtgttcacacgctgacacagcctgcggcagattcactacttggagacttgctttcagcaatacagggaactgtcaagagagccattcgttttacagagagctcacttcctatggggaaagtgaggcttgtgtgctctgacattgcccattttttgttgaccacagctgtaagaagcctggcccgctgatcagtgcagccatactttcaaagcaccacctggtgtttaatggaggattcccaaatttcagcgagtaaaccctcagagggtttgctaacccaaacaccaaggaagggcaatctacacaatggcttagctctagcactcctcccctagcacagctggtgtgcttccagtttcaagagattattccagggagaaaatgactttttataatctccccagtagtcacacaccaaagcaggtcgggggagacactggtgctgtaagacaataactgggcacctctcttgagacatagaaatagtcctactaagtgctgttcaagcaagagtggccaccaagagtacatgtttgtggggttgaggggagaagacattaattaaaggatgtaatcagttgttggcaattcgaccatacaacttgctgtagccattgatgatattactaaaaatgcaatgatgttagccatcttgagctaccagccaagttccagaatacagactggtcattttcttagcaaatctcttgagaggccagccactcctgctggcagatgtttcttgcactttcaaagaaacctcattttcttgtggagtcttctcaccagaagcaagggactggatagcctagagaaacacatttggtccatagcacctggtaagagggaggttagaaaatcggaaaacaagcttcctgtatagctttcttccccagcattctccttcccagatccattcaataaagcatattgtgccttataaaggatgtgctattatgacattgcctgcagatgagcagacaatcaaacttcacttctaaggaagtgaagcaagttggctttagagaaaaggtgccccttagtttccaaccaactcatcatttgaatggccaagggaggggtcaggctttccatctcatccactgaataagtatccagcattcatgattctaaactttcaacaatttggacattcagcttcctagaagttttccttgaggaatcagctttgataccactatgtaatcccttggtaataggaacacaaacaccatttcaccatttgattcctgcaggtgcttatgggataaactatcgcaaattaataggcactaatgtgttcatatattgcttcttccaggtgagacatttttatttcagaaaggaacctttagatatatgcagtgccccaaaagaaagatctgagacttatgtgaaccatccagggagatgatttagttgctcttcagatcattttccatgcaggtgactgccaacttggcccccatgaaagaccagccctggtcaaattcaggttcataaaatgatcatacagttacttctgaaattggacaacataggacacttaggatgtcagagccaaaagctgaataatgcttctgcatggaaggcgtcaatgttctggactctccaccactaagcagggctctcatcccctcagacagccaccacacagatagaaacttggtgactggcagcctacgtccaccccctatatctccagaaagaaagaccattcattatgagagtcccatgttagtgactgtttgagacacctttccctagaagggaaacttgaaccaagtggctcatttcagctcctaactctcagtgctttttgcatgtaggatttctgagaagtgaaaaaaaaaaaaaaacctgccggttatgaagtttctgttccacactttgtaccttaaagatgagtgtgtgagacacagatcttcaggttaaaaataggcatggcccttttctatcactagccagtctccaaaattctccttaccaggcaacatccaaggaagtccattgactataatctgtgttctaggataagaggatgaaatatagaaaaacctaagatttgggttgcccctcccctcatgcctttcctggaagtgatggtgcagcccacaagttcagcagggcacatgtttccttctgtgagtggtgaccaacttcccacctgcatttgctgccactcattaatattaggttggtgcaaaagaaattgtggtttcagactgtgaattttaaatcattataactaggctcaaacacatctttattaatcaaaagaggaaccattacaatcaacacatttttgccaacaagaaataagatttttattcctattatgtaaaactccgtgcttccagattcagcaaactctcggaaagcattttctgcatcctgctggttgtgaaagcattttccctgcaaaaagtcgagatgcttgaagaagtggtagttggttggcgagaggtcgggtgaatatgggcagatgaggcaaaactttgtagcccaattcgttcaacttttgaagcattggttgtgcgacatgcagtcctgcattgttgtggaaaagaattgagccctttctgttggccaatgccagctgcaggcattgcagtttttggtgcatctcattgatttgctgagcatacttcttagatgtaatggtttcgctgggattcagaaagctgtagtgaatcatactaacagaccactaaacagtgatcatgaccttttttggtgtaagtttggctttgggaagtgctttggagcttcttctccatccaacccctgagctggtcgttgctggttgttacacaaaatccacttttcctcacacatcacaatttgattgagaaatagttcattgttgttgagtacaataagagaaggtgacacttcaaaacaatgatttttttttttttttttttgctcagctcatgaggcacccacttatcaagctttttcacctttccaataagcttcaaatgcctaacaaccatagaatggttgacattgagttattcggcaaattctcttgtagttgtaagaggatcggctttgatggtggctctcaattggtcatcgtcaacttcccatggcctgccattatgctcctcatcttcttcattatgctcctcatcttctttgcaaaaccttttgaaccaccactgtgccgtacgttcgttagcaattcctgggccaaatgagctgttgatgttgcaagttgtctccactgctttatgacccaaatcgctcgaatttgctctttaacatcctttccatagtctaaaataaacataaaataaatagcaagtaatacatcattaacaaaaaaataaagtgagaaatgcccattaaaatgatgtataacataaccaaatttatttaagaatgtatttcaataccaaatggcaaattccaacaatgcaaaaaacacaattccttttgcaccaacctaacttgtgattgtgccttacttgcctctcattcccagcaccctgcatagtgacctcgcagaggcacagctcatgccagttctttcagatgaaatgggaaaactctatctgaacagttagctaaagcacttgacatccagaactccaagtccatacataacttcccgttccccatgcaatgattagtgtcttcatgctctccagtgcagtggctggtgtcttcacatgcttccatgtagtagctggaatcttcacattctcccgtgcagtggctggtgtcttcacactcttccgtgcagtagctggtatcttcacactcttctgtgcagtggctggtgtcttcctgctctcccatgcagtggcttgtgtcttcacactcttccgtgcagtggctggtgtcttcacactcttccatgcagtggctggtgtcttcacacactcctgtgcagttgctggtgtcttcacactattctgtgcagttgctggtgtcttcatactattctgtgcagtagctggtgtcttcacactattctgtgtagtagctggtgtcttcacactattccctgcagtagctggtgtcttcacactattccgtgcagtagctggtgtcttcacactctcctgtgcagttgctggtgtcttcacactattccctgcagtagctgatgtcttcacactattctgtgcagttgctggtgtcttcacactattccctgcagtagctgatgtcttcacacttttctgtgcagtggctggtgtcttcacactcttccgtgcagtagctggggtcttcacattcttccatgcagtggcaggtgtcttcgtgctctcccgtgcagtggctggtgtcttcacgccctcccatgcagtgggtagtgtcttcacactcttctggagcactctcctcttcagctgtagccgagacccagcagagctcacagaattcttcttccttatttacaaacttcctcaaatgaccacccattgacaggcaatttaacaacttattggcccatttaaactgattaaaagcagacacatatatgttttggatgtgagccctaggcctttgatgggtctttgctgaatagaattgaattattgaactgaacaaggagcaagtaggtcgaccagtgggttgtttttctacctgcaggtgactccatccaggtgcaaatagcaaggaagcccttgaatccactacaggtgaaagttttgcattgtggtcccatgtgagggaggagacaagtcacctggctattgggtagggatgaaggggataccagggctacagttagactttagcagtgaccccgcttgagcctgcaaagggcgacagctccctatggaaacaacagggatgagtggcagccccctccttggaagccttctcaaagtcactcattagatatgccagatagcctctctctcctggagtaattccttctctccagggtccatcatttgttttgtgatgttaattcatgtgagttgggagtttggttctattgtgttatgttttcctgtatgttttgatttattgaattttttttgtttattttctgtgataaaaatggatgttctatgtgaaagctgagttccttgtttctttctcttgcccgtggctgactgcgtgtgctctattgatgtcttgttcctggttcttgacactgaccatcttgtctgtgaaaggaggcactccggcgggcatgcttgatcagaagaaagggaagtttgcttggtttagtcactccacagaaacccatggtaatgttcccctgtgctctgtgtgtgtaaatgcgtgtgggtgcataccagactgaatgggaaggtgtctctcttgatggcttgtgccgcagtagttctgtgtgtgtgcatatatgtgtatgtatatatgttgtgtgtgtgtgtgtgtttgtgaagggatggcaacctgtccccctcaaagccactgccttatcatggcttcatatgtgtaaagtcagtgggtgtgacaaacaggcagagctattcctccaggagctcttcctctgggcagtgctggcctagagtaagcacactgtgaatgcacggttggaaccagcacaggcagtgccttgatttagaaggtgctgtcgttatttccagtgcccaggcctgcccctccgattttgtctgtctttccaggcctagcaccaccacctccacagcactgtactcacacataaggctctgggaacgaagtgtcacaaagtcacagaactttttctacgtggcctagcccttcaaacaaggatgtctggagggtagagagctaaaaactaaaaataaaaaataaaaaaaacctttgggctgagatggctggagatagatgggttggaagactgagagtgcttccattttatggcttccttagtgtggtttgagcaaagcccctggcaagctctgaaggtctgagctaaaaccatccctaagggctggtctcaccagcccctccagacttcagactataaagtgagtgtaatgctgtggaattcagtgcccctgtttggctactcactgccctcctgtggtgctcccagagcctagtaggctttaagaagcttgtctgcctagggtgtagagtacagaggtggtcgagactggggcgctcaagatgaacatgctacaggaggtgtgacacttgtgccctggacccagccctacttgaacacaccatatgaccatgggcatcacatcccttctctggcctcactttcctctcctgcggagtgaggaggacgagttagagccagataatttctaaagcctcacccagccctagagttctataaaatgacatctggattttttttaattcaattttattaaaaaggtcagagaggtctctcatacacaacagtcaaacatacggtaagtcgtggactttctgtttgtatcttccatgttcttgaaatgattctcttctcaccaacctggcttgtcttcatctgaaggaaaggaaaccaggaaaaatccacatctatcaacattatccatgcaaccagtaaaagtgtttcttgggctctggcagcctcgcagggacttgtcaccagaggccactccctcaactaacagcagattctgtgtctgctgagggctgatgactttctcagcatatgaggagttctattctggaggaacagcagaaccaggaccaaggatatgatggccactctaaagaataagggttacaaaactaaggaacacattgtatcatagtaagagagtgttggaaggtggagaaaaattctttgagttaaacttttatttagaagaaaaaataataataataaaagaaatggcttctttcaagccacccaaactgggttctaagccagaaaactcccattgttctggaaattcagcccacagctgccttgggaggaggctggacaagttgaattaaacggcttatatccaagtcagcctgttgacatgggaatgtcagggtggctgaaaggggaaatcgtatccctacaggctgtcttctgaccacaattaaacataattgtgtggactgcacacttccactcctcactccttatgtctgcagggctagcttgaatcttagtgcatggctctggggatggccattcccctcaagccctctgtctcagttgtgctcctgggtgtaaccaactgccggaaagggaaggcctctgtccacccagcagctcatcaaggtagcaagcacgccctttctacaaacaggctggtccctgttcttggagatggagccccttagagatggtgggtgggatgaagtaaggaaaatgatatattttcatgaaagctcctctttctgtggcaagtggtagttgcaaatggaaagcctctacagcttcttccagtccacagagtggagaggagagattcaatggtcagttttttcaggatgtgtcctatgaggtaaaatgctcttattaccagatgtcctcccatacttccattagtttacagtgttcttggcggcaaaacctgcctggacaaccagcagatgtgtccatcaaggggatctgtgcagatcagccagccagcgtgctcagcctctctttctgccaacccgcactgggtcttgcggtgggcgtgttgcaaactactgctcttctgttcccttgtctccccaccctcaatgcctggctctgcttccctttgactcttgcagtgagcatgcccaccagtgagaccgagtccgtcaacaccgaaaacgtggctggaggtgacatcgagggagaaaactgcggggccaggctggcgtgagtaggcacggcgagcccaggggctggggctttttctggagcatgggtggaaaagctgcatctggaaatcacagtgggctggctcatcactaggaagggcagagattagagccggtggcaagaaacaaacctcaggtgggaaccaagatggggagcagagggccctggggtgagggtggccctggccgggggtgagtcttaaaatcaaggctagtcttcaattcatcacttcttcgggggtgctgactcttaggttttgagcctcttttcatcacatctgagaaatatagagggtgtgtgtgtagggggcggccccaaagtctgtttctttcactccagtccctttcgcccctcttcaaagagacagcgaggttagggccctgagtcctgctggccaccctttccattctgataaatgtgacctgggagagaagcagccaggtgagaagatgttctgggagatgactggcatgtgggtccttacctgaagctctctcatcctgccagtaagggaagcagaagtgcagtggagcctgctgttctgttgccttggggtgtcacgactgtaaactcaccctggcctctggaagaactgcaaacagaggctctgagtcagaccagtcccaggtacaatgcatttctgaactgctccacctggggggcggggcagggcggcatctcccttccctcctcgtctgtggaatgatggagagcctgggcaagcgcagccctttcacaacgctgagctgtggaagagtctaaacacagcaatgccggccttgagcgtggcctgggagcccatgttggggagggagaatgaggctgacggcagagcagctctcacagccgctgtttccagggagcgtggagcttcagtatcactcactctgacactggcaccagggagtctgcactgcagatttctcagcattgtcgggaagcaattattgtcaaaatgttgttaaaatacgatgctaattacatttttaagcagcagtgcaaacctcttcttttggaatcatacaaaacaagcacttgagtttctggaagtaggtcccaaacagcaactctagggaaaggcctataggaaggcttcaaagtctgtcagttctaggcctttctgttgtcttgccaccaagacgaggcttagagagatgatcaaaggccctgcaactctggctgttgggcaggcccaagtcgcataccaggagggactagggagctggcaccaggaagtcacttgatagtacatttcaggagagcatgaggctctgttaggaaggaaacatgatattcccccacggatggagcctggcagtctccagtggatctgtcgtttgctcagagcacatgctctgcagcctggagagctctgcagaaatggtccccgttatccccatgtttagccacattcgtactctgtgcatacaaaacgctgagtcacagtgccagaattataatatgccccgaataaaatgtggtctttccccatctccctacctcccaccccgccccagacaatgatgagccaagactgccagcattcctggcgggagaagcagcatgggaactgagattgcgtgtgatggtctgaggggaagtgagtgaccgggatctttaaagctaagggttaaaagtcttatgtaatgagattaggtcacgatgaggactgctgtgtagtaaggaggcctggatgaagacggttcctgttgggggaagggaggaaggaactacggcatgttacttcatggcagcaggggcaggcgggtgcaggtaatgaagaggaaggagccgtcacagtcagggaagaggataatgaggcagaagtgaaatctgaagcaggagcccagttggagtgacctgcgggtgtcatggagaccacgagatacggaggcccgaaactcagccctgaacaagggtggacacacatgtttgaggttgttgggatgaaaactactaatgaggtgataggacgggttgttcagagtgaagtggaaaacaagaccaagggctgaatcttgggaaatggacacacagaagaataagaccaagcaagcaaaatagacaaaggaatgttaagagaacaggcagcagcgccagcctggaagccgcgggaggaggaatttcaggacagagctgtttatccatgcattcgttcaacagtctgcccagcttggtgctaaggctaggtggtggtgacacacaacagggaggaaattgacaccatcgtgctggagctcacagtctagtgtgggagagacactatgcaaataaataggcaactataaattggggtaagtgttatgaaggaaaagtaagtgtaaagtcgggctaataacaaaggtttctaatttggactggcaggttaggaaaggcttctttgcagaattaaaattccagctgagaacagaaggatgaacatgagttattgagggactggcagacccttaaccgtttgggtctgcatcagaagagtgtgagaagtcactgaagggcattcagaacagagctgagtgggaggttgatttggttagttctgagctcctgaaggatcactgcgacgtcaggaaaagagcagggaggaatgagaagctgcaagagcctgacacaggtgagaggtaatgtggcagcagctcaggctgcagagggaaagaagggctgtgttgtgtgtgtgttctggggtgctacccctcagggttgcagggcactggtcttgggagtcggtctcagtgagggagatggggtggaaatgggccacgacagggtgctcactcaggcagtgaggccatggacagggaggaagatgggagcatgtgaagaggagtagcatgagtgtgggaagcgctggccttcattgtaataaaggcaagggcaaacttcaagacaaggaagaagtcacggagcaggaagaggtgaaacaagctgtaggggaagcaagtgcttataggaaggcattgcttctgaagaggagaatgggcgacagcaaagacagtttgaggccctgaacttgctcaggaaggaggaatttctgtgcacctgaaactaattggaaaatgaaagaagaggagtcccagagtctagtgcccaccaacctccagctagccctgggatcttggccaaagcactccgctctgggcctcagcctcgtcctctgggaaaaagaagggtcagactgacatctctgcagaggctggggtggggggcggaaaccacctgcagcggtgcaagatttcatgtgaagaaagcattctacacctggagaaactgcaaaccgtaggtccatgtggtatctaagggtcccttccagttctgtaaagcctacagttctgtaaagaatacagaatcagaaacaggctctgatgaaggggtcagtgacaggagtcactccgaatgagctcagccatctcatctcccaaagcaagggtcaggggtcacaggaacttgaagggcagtatagagactgaaaccagtgagtcgtcgagaggatgctctaaggttgctgggcagcactgatgccacggtggagactgatatcataaatgcgcagtcagccgtatttttggcagactctgaagcctgagagcactaaaaagagacagcggcgtgtcccagggtggggcttagccatgcaggcatggcagaaggcccaggcggtgtggagtctgtgtggtatcgcgggcaacattgccatgactgtagtcaagcctggtgttaaagggtgagagtgatggggaggatccagtgaggacaaatgttgggtcctctgaaagagcaggagggatcatagaaagggaggctctggccagagtcatggagcatctgagctcagcacccaggagtggaagcaattctatgccgtgcaagggcaggatgtggccctcccaataataagagctgtgggggagaggacgtcctggagttaaggatgctgagtcagacgcattgtcaatgtggatgatgactgcagtgccatctgacttatgttaaaggcgaatttgggacaattcagggaaatactattttacacagcaggtagtaaacatatggcactctttcctctaagaagaggggagaggctgaaaatacaaatggctctcaagaagttcaaatatgtctcaaataatgacaaatgcaaactgagtaactaggggaaaaaaggagtttggggtttgtctctaattctgaacctgaaaagcacgaaggaaaatcatggtctcccagaaggtttgtcttggagtcctgggtggagaaagtatctggggttgcatgaacttcagttcctacccagtggatctgttctgatggtctcatgttccttaccagccttctctccctcctcgctcttcttcaagaatccgctcaacctgaggtaggaattgtgcctcattggaacaacaacagtggagacaaccaggaagccttccgagtgtgctgtgcgtagagaagccagagcccccagctgttctcagagttctttggagattgtgaagatcggtagcagggaggcattggccacagtgaaccggcctagggtgtggaccagcaccatggcaccaaggcatctgggctcctgatggcaccaaggcacccgggctcctggcttgcgtcctctcactgcaggagcacctttccagcccagaaccctgggccacctcccaggaggcaaagaggtcctatcattaacgccaaggtgtgcaaagggagcagaaagaaccaaggcgttcagacgtcacagagttctcacctcagctccccatgggcatggagttttccctggcctccagacaaaagccgctgagcagtgtcctccccttcgcaaggagtggagcctgcctgacatggaacttagccatttggcggttgcttgtcaaaagtgccagcctttaaaagcggatgaggttttgatccccatgaacctaaaattctgctcacaatcccggaggatagcaacaatagcaacaaaatcagtcttcaagtgtggtgcccaggcttatccatccagacctgtaacaaagcagacaagaaggctctgtccatttcgtgctcagaatgtgcccggatgccacagaaggacctgtagtccacgactgtgcttgaagcaggacctcctttcccagcacccccagcgccaatcctgcttcccagggtcatttcccttggagacgaacactcaggattaggtttccccagaggggagcttttcagagcccacttgcacttgtgacccgcttgcactgtgagcaagacaacgcctcatggcaaagggccggtggtcgtcatcaaggggcaccccagacaggactactgaggtgtttctgaaagaaggcctgggaccaggctaggcttggagtcagagtgacaaggctgaagtccatggtcacccacttgagcttatggttaacagcaaggggagacaaccacccaaaagcagcctgggaagacactgaaggtctggggctcagcatggccccgctggagaagagagcacctaggctccccagcacccaattagcagctgggaaacatttgtttgctggttaaactgtggctgtaaataacaatgctgccctgggctcccagtccccctcccacacgctgttaacctgtgattaagccctccagccctcacaggcagtctttgcgggtgggatgaggttattagctaaccgttcggagcagtaaaggcgcttggctcagactcgcagtgccccagagatgtaattatctcatgcacgatggctttgccacctgtcacatcttctggcttaatttttttaataagaaataacgagaggggctggcgttttcttgctctgcgacacagctagctgtgtgccgcgctgggacgtcgcaggcctgcggcggttgcctcccagactcccttctcctgtttcctccccatgcctctccttgttgctccaccactgtctccatccctttcttcatctctaacttgcgttctgtccttctgcttctccatctgaacattgtcaccacctgcactatccccagcgttcatgcccttctcctagcaccaaagccaagctgacaggtgccttctaatggtctcaactgcttacattctctcactctccctgtctctctctctttggctcagccttctctcctccacacttctcttttacagtctgtccctcctgccctcttctccagcctcctgcctcccctggactcttccctacatgaactagggagcctcaggacttccttgaaggttctgcctttccatggaacctcctccctgttccatgacccttccaggcagccaccctcacacccaccctgagcttctgcccagaggtccccaggtcttcagggctgcgtgtgaccgtcagcatcctgggtttctcctcggagtctggggctggcgccttaggcctcctctgcagctcttgggtgggggctgttgtggcccctccatttctggctggctccttttgctggtcttcccttcataaccctactctagctgggctctggcagacagctgtgaggtctgtgccgacctgttcttgcctgtgatttttctgctgttggggtcctcttgtcatcaggagaggccttttctttctctgcagcttgtctcaagatacagctcttcctaacctgacctcatagaagtttctaggcagaccctgaggacctgctactctccctctgcagcaaggattgtctatacttagaagatgctagccaggccagacctcagtctccacattcaaatacataaatagggttctttctctcccaagatgttctagttcacaccatgcctccttccagcacccacacgaaattacctggggaacatcaaatttccctgggactgttgaccgtcttttaaatgcacgtgtgtgtccatcctttggtaacatttcctttttctttttcagccaccggatctccaagtcaaagttcaggtgagtgagactcacgctgctcttccttccttctgccaccagctctgtcttcagccaccctgttgggtggcccaaggtaatacctacaagttgccagtagtgtaagggctgttcttctaagggggtaactactttctgtatggccatcaagaaaaagcttatggctcagatcagacaaataatccagcggttgatatttgttgagtgatcttggactgtccatctttttggcagcacagtccctaggaagttgtcagaccaaatgtgttttcctcccttctaagatgaagtccagttaaaagaaacataaagtgaatccttgtgactgtcatgacctacttcatgtttatagaacatggtgagatataacctttgatgatgatggaaagcacataggattatgacacccgtctgtgtcactgctcttgacaatgacagaacctacaaaaggatccagggtcctcagcccccatctgcctcccagcctcacttcctgcacttccatgaaaataacctttgttccccctacaaggaacttcttgcagttatccaaatgttccctgtcctggtgcacactgaggcccctgcatggagccaatccttcacttaaatcactatgcccccatgccttcatctggagaactcacacttctgttcagaccctcagatgtgactgcttccgtgttactgctttctctgccatttcactgggcctggaaaataccttctgcaaactccagggagagttactcagctcccccttccctggtgctttgctgatgcctctgtcacagcactcagcacatgacactcggattactggctcacagtcccctgcttccaaaggctctgcctgcatgcctccaggggttatttccagagcacccagctcagtgcctgtccagtggtgaacgtccatacatgtgtgttgaatgaatgagtggacagatgtgtgcagggagaatgtgaattcactcccacaaagcttgtatgtgccaaaaaatattggttatttttcataattgagctaatcttgtttccctagccctatctcctacatggcaggagcatagagaaatttttatccagctgagtaaatgtagcccagtgctgtattttaaacagtcccttaaggtaaagtgatttgtctctcagattgcctctctcccagctcctctcttggacggagctggacacatggcggagagggactttgagatcccaggaagcagggaatgatgagggctggtcctaggagccacgcgagccctctggatgcttgctcatctctgctgcatggggctaggctgaactgctgtctgaactggtacctgctgaggtccatctggttagggcatccactgctggagtccatgcccttagggcatccactgctggagtccatgccctctacttgcctccggccttgaaatctccacctctgctctctgacccttgagttctgttggcccactgactttagcacctctatacctcagctgaggacatggacacttccaggtccctcacactccgtgaaggagctagaggagacagcagccctatgacaggctcattggcctaccggtgtcccatcacagcctctgtaacagccaggataagcttcaagccaagggctgaccttctcccagggtctgccgaggcactccaccagccccagtgttgctgggcttccccgtggccatctgggtgtttctaaagcaactccccaccaacctcttgggctgtggtgaccaagggctaaaaattaagtggggaccctggtatctgacttttgctccacttctgacaccttctttctctcccgtttcactaggactggaaaatacaggcttttttcccaatccttgtttctctcaaaccaagacctcatctacataaaacatctagggtcaggcccatccactctagctcttattacagagaaagagctccagaaatattaaaaaaaaaaaatttctctctctcagtaatgcttggctgttactgcttaatctccagcatctggagaagtggctggtacataacaagaacctaataaatatttgctgggtgagtgagtaattaataaatgaatgatcttgccccagtaagacaatagacttgacacagattcaaacaaaatatctaatttgacagtcaaagctgaaaaagcatgttgtgctttaacagttccaaagcccccacacaataagagtaaagggattaaaaatacacttgaaaatatttccaaaatatcattctcagttcatgcaagtgagtaaatcataaattaataaatgaatgaatgaatgaatgaatatgatctggaggatggaagggaaaattacatacttgtgtctcgagttagagattgcctggaacactctgggaacattattttcatccagtgatctatggtgcaagctgtgcttttcaacaagagggaaagagcagtggtgcctgtaaacctctggagtctccctcggccctgaggctttgctatgtgctggccattcagccctgatcatctgcctctgggaaggccttctccttctgcagccacccctcaatacaccgcagtaatgcggacggcagattttgttctcctaaaggcttacagctagtagattggcactatcattgaaactcatttccagatgaggatcctgaggctttgagaggcccaggtcacagggctctagtatggctgagtcagagctcatacccaggggctctgctgccaatcactgtgccatccttgtgatgaggttctgcccgggaatagtaaaccctgttcctgtatagctagtgtgtccgcagagtgtgtaactctagagccatgctattcaacagaaatatagtgcaagccacatatgtacttttaaaaatgttctagtaggcaggttaaaaaataaaaagaaacaggaaatttctttgatttaaaccagtatctctaaaacattactatttcaatatgtaattcacataaaaattattaatgacatattttgcattcatccttttgtgccaagtctttgaaattcagtgtgtgtttttcccttactgcccatctcagtctggactgaccatgtttcccatgcacggtagctgcatgttgctagcggctgccacgcaaggccacgtggccctggaggtttcacacatgagcaggtatcacacagcagccgtctaatctagattcagcagttcactgatggtgtctgcttagggaatatcaaaggttacaaatagattgaaaatgccaccaacgttttcaaagtattcctgatcattttctcaagttaggtgaaacagtttaacaattacagataatggaatttgagtctcaaactggccttttcctttgcaaaacagaatgatccaaagtcacggtttctttaaagaagtgtaagaatggagtctctagggaaaatgtggccggttagtggattacagccatagtggaggattcccttggtaatccacgttttcacttagaggaattagttaaaataagagatttgtgacatttggagctcactgttcagaataaatgtaaacagttatgaaacaaatgattcaggaagtcttttgtaacctgaagggattgattacacaagttggagtttctggatctcaactttacggagttctgaagtgaacctcacggggttctgaaattgggaggactagcttgcccagtcttcagtgaaatgtgcttccaatgttctcttcacttctgccataccatcagcaacaaggcacaaatccaaatttgccccaatctctaatagtcctttgtaaagttacttatttacaagagaattaaacttaatgattttctgtggtgtttgttgttggttctggtaaaaaaaaaaaaaaaaaaaaaaaaagtggaaacttactctagccactagaaggagcctgcagggcccatcattttgatgttgtcgacgattccagatgcctgtgcaccattgcatgtcaagcaaactattttaggagcactgtccgctcctcacctccaccctcagccctggttcacaagagctccgggaatcttcaagccttgtcttccagagggaggtagtacatttgcgtagagttcgtctctgctgctcaaccgtgccatcagccaggggttcccgtgcaggatggactgtgctgagtcccatgggtctgtaaccaagtgtaagacacaacccgattccttcgtgggtcttgtgagctccgcggagaggcaggaaccatacaaatgaaacgtaactgacagtacaaggaaatgggaactcatttcctctggggacccttctcgcctaaggtgtcctttcgtgtgctccctggtggacccgcccagcactcaggccctgctgtgactgctcacttagtggtctgtgtctccgtgtagcttttacgcagaggaggcctgtgagcgctgtgctagctactgagtatctggtgcctagcccgtggtcagtgtttagtaactatttcttggatgtgtaactaaaatgagtaatgcagacagtaagcgctgaagagtgccaaggctgagaagactagaagcatgcatcgtggagaagctgggactcagtgtgagccccacaggaggggcaggacagacaggatgaagcaacggtggagtttccggtagctgggaggacttgccttgcagctggacaggcaagaggaaggcccagtgtagggagaagggcaggtggagctggggctgcgagagcagaagtttagaagcagtgatcccgaagtttagagacatagatgagacccattcgtatccatccctctctcctgtgtctacatatggaaggttctatttctagagaaaatgacttccagttagtgtgaagggaacatgaatagcaggcaaatttctcctccctattttatcatttaatttctgtatcctccatgcatatgtaaacataaataaatttacacattctaataaaccattacatttattatacagtaggaagtgttgccaggaaaccagttgtcaagcaaagctatattttgaagagtgggaggtgcataattatctttaaatactttctctggatagtaattaccccacccccaccccagcccaaatccatgtgactctcccaaatgggtctgctcaggagcaccccagttgaaagggacaccgtcctgtccactccggccactcctcaggggtctgtgcagagcagctccagacccatgggaccagcctgaccacacagcacccatatccactactcccaagcatgaggaaaaaggggcataatcaagctctcatattaaacccactccaagacagctctacataccgcaaagaaagcaaccttgattgccttggactctgaataacaattatcagtgatttctggaacttgagactgtatctatttaaaacatgttctttgcaaacttcactgtcagctctttaagatcagatatgagtttgtcctgaaaattcattttttaggggaataaactacttgccaaatttctgtacagtattaataatcacaatcacaggaaaaaagcagaggcatgccctgcaagataagactgtttagtatcaagatctggcaaacttcagaggtcgcctctcaagaggaccatctgggactcattgtctcatttctttgtccctctgtccaccctccaccatcctccctcggatccagggcagtatgtctgggggtgcaagaatcccaaagtgcatttagaaatcataacgttttaaattgttaatgtttatgggcactaatgggtgtatatatttatgaggtgcatgtgatgttttgatccaggtgtacaatgtgcaaaaatcaaaccagggttatcagggtgttcctcacatcaagcacttatcatttctttgtattacgaacattccaattccagtcttttagtttattttaaaatatgcaataaattatcatgactgtagtcaccatccttctctcctatgttgtatgatcaaatattacatcatatttattctatttaactatattttttcacctatttaccatctccactaccctttccagcttctggtaaccatcattctactctctgtatccatgagttcaattgctttaatttttagctcccacatatgagtgagaatatgtacaatttgtctttctgtgcctggcttatttcacttaatataatggcctccagttccatccatgttgttgcaaatgacagaatttcattcttttttatagctgaacaatattccattgtgtacatgtaccacattttcttcattcatttgctgatgggcgcttaggttgattctgtatcttggctattgtaaatagtgccgcagtgaacataggagaacataggagtgcagatatctcttcagtatacagattggaaaccatgttttccacctggtggcctgcttccctgtgtagtggattttcccccaagtggtaggccagtgtcgcatgttaaggtgtggccctcactggagatggccttcaagctagagcagaacactgcctggattaatcctttttcccctccctgctcctcaagccaaaaactaagttctccctgcagtcctgaagaaagagtacccttctttgattactcttcactctcctaacctcatcttagatttagcaaagtcttggtaacaggattttctgcagatcatagatagaaaaatgacagagtagaaaggtggatgaagtcaggctactccaagaggcaattttgggggtatgtgcagggatccgtaacagcccaggttggcatcttggagtttgctgatgtttggaggggcttctgccctggaagtagaggaccaaggctgagggcagtgcacacagcacggagctgtccctgccccctggggcacacccacatgtggtgctgctacatgcccgggggctaggaaggaataggccattcacagaccagtgagttcacacagatggggcttgctgttccaccaccagcataacttgacccaggaggtgacgctgaggcttgatggtcatctctggcaggaagattggagaaacggactcatgccatggactgtgatttagaatggaggacctcatttcagcttccttgcgctgaagtggagggccggttttcacatccagacttagtatgccacacacagacacacacacaccggaaacaaagttttatgtaaaaatatttttgcttactgcttactttaaaaagcagtttccttacgatatgatacgcactgtgatattttccactctattcctttattcagtgccaggcatgacctactcaatagatttcatgacccactaatgggctgcagtgtgaggtttgaaacctctgcccagaggcagattctgcatgcttatttagaggaatgtctgtctagacgagagagattcatagaaaggagatcattttatggaaaaatacagatattcatggactttatcaccaggattctactttgtttctcctcctgccttcattacccaggcaggagctgtatcttcaatgcctcgtgggtctgcgtacaagccctacaggtgccccaaagccatgtgcagagctaagcaccccatttttctcataactgacccctctgcctggagctctactcccgctcctctggccctcctctgtgctgccctcccaaatcgccccagctaaaaatgttggcagtcccttccatacctgtctttcttattctgcacatccgctcatctcaagggactattgattctgcctctaaaattgctgccagctctgtgtcatcttttccattaatatagctattgccttcatcatctctaacctggagaacaggaagagaattcctcatactctccctggtctagaaggtgacagaggggctgtttttgtggggtgttccgatccaacctgatcatgtcctttccccctccccaagccctcagcatggcccctgcagtctcctcctcagcacctctccagctatggttcttctctccttgcacagtgcagccatttattaaccatgtcgtctactgaattcaaccaaacagagctgtatattttctctgtatcaggaaaatgaaaacgcctccaccatagaatcttaaaatgtgtttctttaggatcatcttagccactggttctcaaccatcattacacattagaaccacctggggagccttaaaaatacccaaccccggccgggcgcggtggctcacgcctgtaatcccagcactttgggaggccgaggcgggtggatcatgaggtcaggagatcgagaccatcctggctaacaaggtgaaacccgtctctactaaaaatacaaaaaattagccgggcgcggtggcgggcgcctgtagtcccagctactcgggaggctgaggcaggagactggcgtgaacccgggaagcggagcttgcagtgagccgagattgcgccactgcagtccgcagtccggcctgggcgacagagcgagactccgtctcagaaaaaaaaaaaaaaaaaaaatacccaacccctagagaatcagacttaattggtttggtgttggggcttgcggaccagtggggttttggggagggttccctaggtaattctgtgtgtagccaggtttgagaatcactgacaaaggctcctaaaccaagatacggggaagagtccatggagcatggatgagctttgaggggtctgtgtgctgtgtgggctctcaagtaaaggtgtgtgtgtgggcatgtgcccatttttctgaaaggcagatctaaacattcatcagattctggaaagattctataacccagaaaaacaaagagcctgtgctccagatgaaccccttctaccatatggatgtggcacacacagtcagggccaagaggctgggcagaaaactacggatggctctgcctgctgtgatattggtcgagtactcaacctccccagccctgagttttctcctccccaaaaatcaggataatgcgtgctttgcagagttactgaaagaattggagagaaggcatgagaagtgcctgatgtggtactgggcccctcctccactgttactaataatgctcttattgcttacaacactatttctaagaatgctgtttcacaaaaattaaaaaaacttccatttattgagcatcttcaacttcaaagcagccagatgcattataaggtatttgatccatccccacaataaccccatgaggtcggccctcttcccgggagaactgaagcttggaggagttcaggggcatccccaaggcggcagggcctggttagctggatgagaagctgggctccttgccaccagattgggctgctctagcaaggccagatcagtgaggggcgagaagagccatggtgctgcatcttgggttggaggaaacctgaattcacagccaaccccacccttctctccctgtcccctttccagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaaggtgagcggcggccccagctctgctctggtttcctcctggtaactcagccccaaggcccaggggagggcataaccacaggcagaaggtggaggggaaagcagccaatggtcggggctcttggcaggtgctgtgctggagacaccaagggcctggcagttccaaagccccacaataaaatgcgctaccttgttaaaaacagacacggctctcctgactgggcccacaccatcagcctgccccaaagtcactgttggacccaggtgatgaggaaaggggctgcagcttgtttgcctatctcagactcctggctgccaactccccagcatggattttaaatacctgggggccttcctacagccctgaggtggccttaaccagaacacatgaggatggaatgagcaaaaaggcagagaagagaatagggcctgagcacaaggaaccgtcttcaatgggtcgttcattctcattatccttccttgggcccctagacgagggtcccactagccaggcctcagcatcattgctgggcagtcaagaagacctggccccatcctccacagctgctttccagagtcctgggaggcagggggtctagtggcggagaagtcagactcagacagtgcggctccaactgttggctgtttggcctgcacaggctactcacctctttgaacctcctttctcatctctgaaaatgggcatgacgatggtggtaccatccccacaggcctgctatgaggaggagagattgtgtgtgctgagcctatggtgcatgggagatgctcagtaaatgtctgttatgattgtgacgagagagccctttcccattggcttggccccaacttctgttctggccgaggtggatgggagaggtgtcatgggggatcttttttccaatggagataattactgtatttcctttccctgcctccctttctgcctcctctggccctgctcggatctcatccctctcctgggcctgccagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactgggctccccctctcactttgaagaggggactcaggaagaagttcttccagagggcaagggaggtggcaaggcctgggtgggaggggggctgttcttcctcaaagggtgtctctgaagttcacatgcaatgggggtagtttgtgttcatttagatggcacatcatttggaaattcctctggctgctaataccagagactcaactcagtaatgtaagcaagctagggacttattcagccatggaaaaaaagtccagaggcagctagctgaggtgccttcaagaagagggtcagggactcagtctcttctcctgtgcttcaccagccttggtgctgattcttctccagggtcataagatgacttctggagactgagccatcacattcaaattggaggtgggaagaagagaaaggagcaaaagggccgaccaccccggccaagtcagcttctccactcccagaagtcactcccagacacacccattaggactgctgctgtcaaaaaaactgaaaatcataagggttggcaatgacatggagaaattggaacccttgtgcactatgggtgggagtgtaaaatggtgcagccaccgtgggaaatggtatggcagttcctaaaaacgttaatgataggattaccctctcatccatcaattccacttctgggtatatgcccaaaataattgaaagtaggatctcaaagagatatttgcacacccaagtgccttagacagatgaatgtatttttaaaatgtggtctacacatacagttcaatattattcagtcttaaaaaggaaggaaatcctgacacatgctacaaagtagatgaaacttaaggacattatgctaagtgaaataagccagtcacagaaagacaaatactgtatgattccatttatatgtggctcttagagtagtcagattcacagagacagaaagcagaatggtgggcgcccagggctggagggagggggcagtggggagttagtgtttaatgggttctggagatggaggatggtggtggtttcacaacagcgtgaatgtatttagcaccactgaattctacagtttaaaaaaaaaggttaagatggtaaattttatgttatgtgtattttaacacagtgaaacaaattggaagaaatcttccagaagtctcagcaagggcttctgttcttgagcacctgagctgttagggaggctgagaaatgcagtattctagcaggacaagttctgctgaaaatgcgttcaagatctagccactgtaaagggctgtggacactgcactgcagatggtgttcaccctctgtccacatggccacccctccatatgtcagtccggcacctacccaaagcaggccatctccctcactgtctaggccaagcagtgactctcaagacaaggacagggctgaggggcaccatgctctaggacaatgattttcacctgacttatgaccactgggagtggtggaatccatttattggatcacaaccatcattttaaaacatactgaaatataattcatatcccatatatttaccccttacaatgtgtaacttaattgtttttttatattcatggttatgcaaccatcaccatgttctagttgtagaacattttcatcaccccagaaagaaactccatacccattccacatttcccccatcttccctcccagcaaccaaattcactttatgtctctatagagttgcctattttggaccattcatgtgagtgaaatcttataatatgtgtttttgtgatggcctctttgacttagaataatgttttcaagggccatccatgttgtagcatagatcagtactttgtttccttttatggtgaataatattccattgtagggatatactacattttgtgtattcatgtatcagtgatggacatttggttgttactatcttttggctcctatgaataatgctgctatgaacattcatgttcaagtcttcctatagatgtaggcttttgtttttcttggataggtacctcggagtggaatttctagattatttggtaacaatatgtttaagattttgaggaactgtcaaactgttttccaaagagactaaagcatcttacatttccaccagcaatgtataagggttccaatttcttcacattctcacaagcatcgtttttaaagaaagaatgaaatagaataggaaaacatcagagggtctcacatgaacgtaaacattgtttcataaaaagctgagatgcagacctgacttgcagtagaatacatatttcttaatgtgcgttatgatcaaccttagaagacatatgggaaacacctggaaggaattttcaacctgtgcccctctaaggtacaagtcccctgtccttaaaaatctgctttgggggctcccaaaatctctgctttggggaatctttgataacaggagcactaaaaccatccgttggattgtgatgggtaaaaagggatggaggttggtgtcttcagttcaggatctggagctgatggcatcttgctcagagcgtgtttctgagtgtccctaggtgttgctcttctcgtcacaattctcttggcaaccacccagagcatggtcacatggtgttgtggatggtccggggaggtagacatttaaagtgtttcatttagtgcacagaaaggactcaatatgcagaagcttttattattcatctaatattatgactgctattattagaaggaagaaagagaagagagctaatagtgacctacatattcacatactcttgttcttacttatttacccactacgtatatactgtgtattgagctcagagagatggaaaaaatcgaaaaataaggcgtatggcgtgaactaaatccaggagaaatgtatagtctggttggggagatggagtttgtgcacatgaagagattaaaggaaaatctatgacagaatataatgagctggcaaagtgtggtgggcgtgggaattacctgctgtgagaaattgggagcaggagatagctcctggagaaggttgaatctcagatgagggacttaacagacacccacgattaaaatccagaagtttaatgctcctaagcaacagccttctttccctctctgaccccatcgaaagagagctcttcctaagtgtcctgaatatgttggcattacagaaagtccttggtttacagtgaaagtggtagaaatccttatatcagcaatgattaccatgcaccagtgcttactctgtgccagatagggtgagcagaggcctacgaatgttagcttgagtgatcctcccaagtacctacatgaggatgaggataggctactactattattattcccactttgcagatgagagactgaggcttagagagttgtcagttgcccaaggtcacaaaactgctcagaggtaacactgggattaaaaggcaaggcaggtctgtggtctgacttgaggtgctatactcctaaccactgccatgcactgcagagctgagagctgacctgtcttcttgtctaggtccctgagacaggacttaaaagatctttatgccctggttcttgttagataattgccgattctacttgctcctcctggggtctggtaaaactatttttaacttgcagttttcaatgcctcttaaataattctcaaaagtccctgttttgggcttttatgtatatatttctatagaaaagaaatcttgctgctatatattgttatgacatcttgaaaagatttaacattcattctatttttaatcaccaatttatttctaatctgaagatattgccaagaaaccatttttaaaaatctatcttaatcagagagcttcctgtagtccctccacaagaaggagtagtagtattttcagatctctatgaagtctataaacagaaaaaatcattgtctaattgaaagtgactgtggcaaaggccgtcatcttcctattttcaagtctccaaagcctctgggggctttcggaaagcaacaaagagactaattaggttgggggatcccataagtccgtctccagcgccagccttgggactgggtgacagtgaccaagaaaaatgcctaaaatatgggttgggagtggacattgtggtcccttcagctgaaccttgaaatgggtcatctgtgcatggtcctgccatcagacaagtgcatgccttcttcttttaaaatatcttggaaagtactttgcaatgtcttgctgctactcatatgtagaagaaatttcttctctttttttttttttttttttttacaatgtagtctgaaccagtaattgcaattcttaaacttagctgaacccatgaaggagttcattaaggagctcatctctagagattttggccagcaactcctggagagttccatgctagtggtccaatgaccgacctcacttgaagaaccactggcctaatttcctactgctgctcttggtctgctttcttctcctaaaatactgcccttcatatgcaatcggaaaacttgattattattcctcctcctcctcctcctcctcttcctcctccttctcttcttcctcctcctcctcctctnnnnnnnnnnnnnnnnnnnntcctgtcctcctcctcttcctcttcctgctccttctcctcttcctcctcctcctcttcctccttctcctcttcctcctcctcctcctctcctgctccttctcctcttcctccttcttcttctcttcctccttctcccctcctccttctcctctcctcctccttctcctctcctcctccttctcctctcctcctccttctcctcttcctcctcctcctctcctcctccttctcctcttcctcctcctctcttcctcctcttcctcctccttcttctcttcctccttctcctcttcctcctcctcttcctcctcctcttcctcttcctgctccttctcctcttcctcctccttcttctgttcctccttctcctctcctcctcctcctcctctcctccttctcctctcctcctcctcccctcctccttctcttcctcctcctcttcctcctcctcctccttctcttcttcttctcctctcctcctcttcttcctccttctcctcctcctcttcctcctcctcctctcctcctccttctcctcttcctcttcctcctctcctcctcctcctcctgtcctcttccttctcctccttcttctcctcctcctcctccttcttcttccttttcttcttcttcttctcttccctcttcttttttcaagacaggatctcactctgtcacctaggctggagtgtggtagcataatcatagctcactgtagcctcaaactcctgggctcaagtgatactccagcctcgtctcagcctcccaagtaactgggactataagtgccatgtctggctaatatttttattttttgtagagatggggtctcactatattgcccaggcaggtctggaactcctggacttaagagatcctctcacttggctgaccaccttgcccagccaaaaaacttgattcttacatctccactgtcttctccatactgtagtctctaattctgtcaagatggtacttttgatagtttttgactgagaaaacacatcaaggtaagaactactatgaattcagcaaagcttttaaatttaaattcctacacatctgtgtatgtttgaaaagtggtaatatgaatgcaagacaaggctgtttattcagagtagtataatgcttggtgtacacatggattcatggatccctttctagaattctagaattccaggctgctcttccctcacccaggacccatggtccaagggtcgggaacagggatctaaatcaatggttcttcaccctgaggtcatgacacagtggtacatccagagcagctggatagtgatagcaaataatttattactgagagctgaaattccaaagtttgtgaatagtttctttaaaaaataaaacaaattaatattgtccttgtaacataatagcatcactctgtcacttgcattacaaaatgcttctatgaatgggtgagatccgggtggacttacaactcatccatgatgcctgaagggagcagatgtctttgatatatcattatgaggaaaatgaattatttacatactgacattttttgtgttttgtcaaaatctgagaacaccttagggagtatgctacatgtatgaagatcattcatcctcttgttgagaacaccttagggaatgtgctacatgtatgaatatcattcatcctattgtttcaagacaaaaaaaaggccaggaagcctgtactagactgtaagaaaattactttatagaaaagattgaggaagacaagattcctgctcattgaaaacagtggggcacacgcatggccggaatctttgtcatctttgagtaaatgccccagtacggtgggccttccagcctcatgatggattgggttcttccacctgtggctcttggtgctgcccagattcaatatccagtttttctactctttgtcagcccagtctgacatattctgtggggtgggagaagggctccagacagattcaatccggacgtgataccagtttactgattgcatctcatttttgacacacttggttttcaagtgcagtgaggcccctctagcacttgctgtttcccctctcacaccttcaatccctctttatttctcctgctgctcctcccctgcagctcccttcccaggccttgaaatgggagctggggctgattcagcacagacagattggctcataaatcttggccacatatgggccccacagagctccaggtgagagccgttagcacatctcccaggctcgaaatgtctccatgtccctaccagcatctggccttgagcagcagatccagccccacaccttcccagctcttccatcaccttctagcccccactcttctcaggccccctggagcctctgagctcattgagggccattattaaggaagtctgtttggcagatgcccagttccctggcaggggtctgtggcaaaggtagctcagactccagagcctgcaatgtggctgtcaacacaatgggtggttctcctttggtatgggaatggactggtgtcacctactaggagaaagattaaaaagatgcaggtgaggatgactccctagccctgacacaactgtggttggaggggccaactaggtgacactgagtagccccgtggcccagaagctcagagaagcatgctgctaaggccatccccaggtccaggccagaccaccttgcccgcttgaccaggttacactccccatgcaggttccgttcttaatgtgaccgagacatctgctgcaaacagagaagacaagacctttgaacttgttaactaagtcagcccttgcctcaaaagtgaaaccacaaaatggtcttcccagcctgctagaatggacgggagcaggggcaggtaccagtagaaactgaaccggtagttgaggccttggggcccaggttgtcccagaccaaaatactctagaattctgcttgactcctcctggcccagcccagcatatacggttctgcctctgggcatcctaatccctcccagctctattgtgtcttaaggggctggggctcaatttgacggaagctctgctctgaggacaccccctcctgtgctcacttgctggatggattctacctgcttccccaggtggcctcagccaattctcactcctcttcactccattgcctcccatgaagccccagccacacagattcaccacaggggactgctttataactgctcttttaacaatagatcacttgccaccgaaactaagaatttttttttagccttcaggatgagaacattttgggcaggtatcaaactcagttatgaccttctctggaacacagagagaatagggtggaacatttgcagagcatccgaaagtggtgggtactgttattttgaagatctcttatttatggcaagctcaatgctctgctctatacctagaataaaggtaaaggacctggccctgagctctttgaagcaaaaggttcatgagatgaaagttccagttcaaggaaggctcgggtcactttatattatagaagaggaggaagaattccacagagccccaaacccagagacagacctagagacggggaaacaaatggagataaaaggatttctgaacagatggtggtaacttaaatcaggagaggcagagggaaaaggtaacagaagtgacatggtggtcggcaagtgagagagcttaaagggaggctgggagtaggaaggtagagggaaggagagaatttaggtggcagagaacttgatgtgatgaaaagccctcagatgtgctgtacttttaaggataaaacagggagccgagtgggtcagatgggggatggggtgagcagggacgcacagtttggagagaatgattccagcagctggagaatgggaaaggaaagttgatgccaatgatggcgacgcaggcagagtgtctggggggtgatctagagctggacaccggcacccgggtgctgtagagcccacagtactgaatgtgagcttgtgggcatgtgtgtgcactgctctgatgagagagtgcttcatttttatgcttttccatgaggcctgtgaccaaaagacatgaagtgctttgctctgctgctgctcgcttctctccaaagctcttgcctttttggtgtgtgagcgtgtgtatctcatatttttgaccaatgaggaaaaaagcttcagctgattgtgaatgtgccattaacccctctagtttaccaacagtgaatcttcctaaaaaagatggtgattctaggataggaggccatcatccaatcttcaggccatagctgtgcgagccatcagaccacattaagaggagggagtgtgaggacctgcaggaccgccagctgtttatttaagtggtttcacgtcaccctacccacctcaaaggctgccacctggacacctccaaatcccatccatatcagtgatagtgagcccccaccctcaacctgctaccagccaaggcctgccagtctccagaattcagcccatctcctctgaaccctatcagcattctttgccacatcatcatttcagcaattcctttgtctcatcttctagatgagcatataaaacatccctgataatttgcacgttaggaatggaagccttctgctcagcaagctgagcacccctcgtgatgccaggccctgggcagcagcctgccccctttatcctgctgcaaaggaaaggaaaggacaggtggcaggcctgcctcgggcccaaccccatctttctctctgttgaatgggaagcaacagtaggctgaagacaaacagcacaaacaaccatatctctgtctgtctgtctgtctgagccatgttttaactgtgttactggtccccaggacagtgtctttcccctcaggtgtttttcatgtagacagtaggctggtgccaattcatcttttaaacagaggctgacctgtgccctcaaaactgggaccagtgaatttgagaatgtgagttcttccccaaaggtgacacatgttcacagtgatctggaaatcctactcccaaggtttgctcaagccacagaaaccgttttctgtaggacatattgatacatattagtttgatgcatggtctggcaatggaacagtcaggaatctcagaaaatccctccccatggatgtagggaagctatgggaataggaaggctatgggagcaggggcaggcagccacttctcactgtttggcaaagtgtgttcaacttaagtgcacacgcacacaaacacacatgcacagaagcacccatgcacctccatggccccttgcctttccctccaggaagtaccaatgtgtcatatgaatagtaaggttcattcattcactgaacaaaatgtttgctcatcacctgctttgggccaggcactgttctaagctccaaggatataaatgtaacagatgggttccttctcccatggcctcacattctggcgagggcaagcagacaataagcaaagaagtaattattctttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccagaagtaattattctttgagagtaatgagggatagagcggtggccaggggagatgtgaggcctgaaggagctgaaggggtgagctccactgacgtctgccaaagaacctgcggacggacagcagcatggccttggtcaggcaggagcatgtgtaggagttggagaaagtgagggggcccgaggaaggggagtgcagctggctggtccctgaggctctgggcccagaatctacagcctctgctaggcctttgggaggactctggctttgacccagaggagaaggggaggtgactgaagcaagactgaggcttcgtgggcctcacctcatagcaacacccgctgctgctgcagcttggacatcagctgcccggagcgggggtccaggcagtgaggatgaggaggcggtgggaagtggccaaagtcaggactcgttttgaagatggcgcagaaggatttgctgatgcagagtgtgagagagccaggaagatgactccgaggactttgccttgagccaaaagctatggttctcatttccttgagacggggaaggtgatgggtgggaagcaggagctccatcagagcacgaacccggtgttgtgcagcttggactttcccagacgccccaggggttgagggaggcaggggcggcagggagagtgggcagagggtgctcctccagacacagctctgtgtccctgcccacgtccttgcctttggccttcgctctaggagatccctgctagtttccatgctccatctctgccttcccaggagtgttctcccctcttagagactggatctgttcctgggccacagcctcctcctccctggagccccaagcattctgaggggctcccaggtcaggagggcccccccacctcaccatccctctctgctcctcatctggggcctcccccagactttcttgctgacggcacctggccctctccctctgcagccatgacctgcttgtcaggctcccgttggtccccatggctgtcagacatacctgggtctcaggtataatcccagttgcagttatttcccacatgcctctttacttcatgaaaacgaaggctccaaccttccatgaccattaaggcttttccagaatcttccatgacagttgagcgcacagaggatctctagaggatttgtgacttcagtgcacatgcggacactcttccctcggatacagctggaaattcttgttataaatatgcttaaagttgctggttcccaactcccagtgtattggcaggtgttggactggtcgcctgaggattaccccagccccagagtcagccccagagtcagagattagggtttcatggtgcaagggagggacctgggaatcaggatttaggaaatgctaacacacccctactggtattgttgttgttctattattaattaattaattaatattttaggacagggtctcactccgtcacccaggatgaagggcaatggtgcaaacatagctcactgcagcctcaaactcctgggctcaagtgatccttccatctcagtctccccagtaggtgggactacaggcatgcaccaccacacccagctaattttttaattttttaaagatgaggtctcacactgctgcccaagctggtctcaaactcctggcctcaagcagtcctcctgccttgacctcctaaagtgacaatcctcccaaagggggttataggcatgagccaccaccatgcccagccacctctactgatgttgatcaccgggcaggcttgggaaaactgctttagctgtaagaggggagggtgttctacccccagagaggttctcttactttttcctttaagcagatcactacagcctctagcctgcaggggctccaggcagtccatcacacatactgggttgtacagaatttatataaggacagagttgggaagctggagggggacaaaaccctgcaatcttctgccgtctaaaatttagagcctattttggtgagacaagactgtatagaacagatacaaatagatgtatattaatattctgcaacagagggggtatggctggcaggcaaaatagaagtaaggaaaagctggatttgtggaggccaaaggtgccctcgaggctgcaggttggtaaagagttcatgttgccatccaaactatgacccctctgcttctgtcccttggtgtggaaccattctctgcagagatgagcccaggctgtggctgcaatgggagtggcttgcatgtcactcactgaagcagcaaaagcaatccactgtctggattggtgatgagctgggaatctctcaagggagtgacctaggaggcaggtgggccagagggggccagagggaaatgagattgttctgttcttgctcttgctccctcagggccatgtccttttgccatggtgcacttcctggtcctgagctgaccctcacacaggtgcccaccctgcatccagcagtcattagtaggttccccctcccactttgtcatgagaaagggattttcccaggatcgctgtatttatagtggagagaggccccaggactgtaaggagtggggacctcctccccaggaatcccactgaaagcccatgtcccctcaggaccgagctcctgcccactcagaggactcgtgctttgagctgccccagtgggtgtgacaggtttgctataatctaggatttcccagactcacctgctgatcagaatcctgtaggatgcttgttagaaacaaagatatctgggccccaaactacagctaatgaatcacaatctcaagaggaaaggcccttaaagaaacaattcttaggacagcgtaaacttgggaaaccaccaagccatgaactctctcttacccgtgggtgacctaattcctgcctctgctagaaggctgctgcctataggctgagctcagactggcattcatggcgggggaaaaaaagctttctttctgtttagagaccaacagtgacaacaatgattaccaacctttatcaactatgtgccaggcactctacagggggctctttggggaaaggtggatcatgtcacgcaatcctgccatagcctaatgaagcaagggctacaacaatctccatttttttgatggggatgcagaaggcagggaagtgaaatgtcttgcccagaggcacatgcagcaggtagccggcagagctaggtcgcgggcttctgaccactgtccccctctcttccccaacagattaatcatcttgagaccttgaattaactccctccagggtggcaactcacaccaccaccaacacgcatcccccacgggcagggaaaaagagcatagagtggcagctcctctgagaacctgcagtgggcagttgtgagaatgaggcacgatggggaggacagcaaggggcagagtgctgacctccctcctgttggctctcaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcaggtatggactcttctctgctgggattcggactcggggtggttgagtggcggggtggtgggaggagtgtgggaagctgcacccttttaccgggcagccacagccatcctagatcagccctggagagcccatgcccgggagagtcttgagttttttctgtagtttccctgtccccatctgccatggaattccactagtgggtggaccattaggggaaacaatataagtggtttaaaaatgccttctcaggagaatctcttgaacccaggaggcagaggttgcagtgagccaagattgcaccactgcacactctagcctaggtgacggagcaagactccgtctcaaataaaaaaaaaaaaaatcgttcttatccatggaatcctttacttaaattctccatgaaagcccaaaacataaagaaaagcagactgctcttactgggggaggggagggtgacgaaaccctggctttcctaccatgcttgtctcttgaaaaaaatattactagcccatcaaatttgtgatttcatagatattttggcttagggcaaactcaaagtggcatctatttaagtttaaaagcagatcgattgagaggtaaaaatgaatcacatgtagatgttgtcaaagtcttgaagatgatgccccagtgacgaatgtttggggaaagctggtgtagcctgtggctgtctcagcaaacacacaactgcaaaagggtcctgacgccttacccccaggaatggctgacggtcagctcaagcatgtgtggggaaagtcagagatctttgggccaaaaagcccttttagtcacccttcaaataatattatgccaatagccaggcattttgtctaaggacagttcaatagctcagagcccctggggaggagaattgggggccaggaggagggaaagaagtgaaagggaaattttggacaattttgttgacgtagtggggcagggcagggtggttttgggtttgctgttggtctaacgctgtgtcccttattggtgggaatgtgtcattcagatcctgaccggggaggactggaattcggtgatgtatgatgggatcatggcttatggcggcccctcttttccagggatgttagtctgtatttacttcatcatcctcttcatctgtggaaactgtatcctttgctgctgccccccacccctgcggcccccagcccccagcctgcagcacagtgccaaacgggcacgcccctcaggtccgggcggtcctgctcgggctcacaccacccagcctagaaccccatggcggcggaggtgggtctgggtggaaacctgcagctttggcatgggtgaggttcaccttcctgaaccctccgggcccgcagcggcgccgcgctccgggcgggctgtcgccgtaatctgggtgagcggcgccccctggcgttgcggcgtgtgcggccactcacaccgcctgcgatagggacgcgcgggagcgggccggctgccctggggccgcggcgtctgctcagaggcgggacgctccgggagggaggatgagccgttgtccttcaagtgaccttcagctctcctcctgctttttggtcagcagccctctctctgatgctgctctccaggactttagtcacgggcagagctgcacagacttcaaacagccccaaaagctccttcctgatcccggctggggcaggtttccagggcacaagccacgggtgctgcttctcttccccagctcataaccccgagagagtcacgtccagagccaggggtaacataggaacagctctgggccaagtcccagctaaggcagtgcagaaaacacagtcatggaagcctgcagacaaggtttcctcttttcccagctggatgacctcttgcagattgaaggtcctctacctcagtgtctgtaaaatgtggcaatggaatcatagaacctactacataaagggtcgttgggagttttcatgggatcatgcatgcaaggcctctgccacattcagaagccaccctggacaaagcccctcttccccagcctgggttgctgcggcttccctgtgtgtgaaatgatatgaatgtctgggtgcctggggccgggggtcagacttcacagacttaaagcccccttccagctatgctttcgttgattctgcagttctctgacccacagtgtttctgttggtggagtggggaggagaaagggcaaagaactgtctccactgggaactcccaagccttggctggctccagatggaccctccaagggtcttcgtgggtgcaggctcacattaagagttggcagagataccaagccaccccctcagcgcccagttataataaaccgctcttaagagcgttctgcatcctgctagagacaatgctgtttataatgtcaattacagccagtcatctcagcagggaaagcaatcatgaaacccagcaattaaagtgcaaggcagggcttgctgcctccctcccgcctgctccagtgtgcaggctagcctgttctcatccctcttgatagctccaggtagctaggagggtgatggggaggaaggggaggggaggaacactgttggggtctgactccctcaaattgcttccccctcaagctctctctgctgaggagctctaccctgcacgccccacatcccccgtgcccctgtgcccaccaaaaccccaaaccaagggtcattttctttaagaatggacacaaacagatatcctactgaatgtgttcttggccattgctgtggacaacctggctgatgctgagagcctcacatctgcccaaaaggaggaggaagaggagaaggagagaaagaagctggccaggtaaccctctaagcttgcccaggcctggggctccagggctcccattgtggaatgtcttcccactggtggcagagagaggcttgactgctagcctctgttggctctccctcctaggaggactctgggtttggggcttcctaagttgggcctctctcctaattcctaagcatcactctggtagggaccatcatgaattataataatctctgcaatggtgtcatattctccacctgctgggattatcttttgagaagctgtgataggtggcaggagtgtagggtggggagagagaaaggtaaccactcagttgggaaacgcagctccagcttacagagggagtcctcctcactactttataattcatctccagtgttaggaaggcaagacggggccctatgttgtatcctatcattatctagacgggacagttccaggccacacagctgccgggcactgagcagagctcctccaggagccaatcctagatgagatccaccatccttttctgctttggcgacccaggcatctctggagctgcaagaggccaattgcgtgtcaggcagagcaggtgtagctcagccccatagcacttgtgactgagctgcacacgagaagcgtcctggagaaaggaagatggactcagacccaggggatctgtcccctctggccccaacaggccacagggcggttccctcctacactgttccctatcactccagtaaacagccatttatttttttctgctgctgactggccaggactgccagcccagagaagaaacaagagttggtggagaagccggcagtgggggaatccaaggaggagaagattgagctgaaatccatcacggctgacggagagtctccacccgccaccaaggtgaggagctgtctccttcctggagctgtgaggccggtgctggggagggagggccacagccttcccaggccagaaccctgtggagaagaggagagaaagaaagacacccagtggaaagaaagccagtggggatgaacaggagagctgggagggggaagataaggcagattggctggatcccagccatctgctgatgtcttgaaggagatatgcaaagtgacaagtacctatttttgagctaagtcactgactaaaatgcaacttcaaggctactgcaagcctcttaacttggggacgtatctaactattcttcccccttctcccctgtgactgtctagatcaacatggatgacctccagcccaatgaaaatgaggataagagcccctaccccaacccagaaactacaggtaccagtcccactgcctaacctgggattgggagattgggggcagagatctaaattctaaagccacgtgggagtggccatatattagggaccatggttccagtgtccctctgtaagtaccttccactgctgagtgtcttctatctctatatttaagcatcatcagtcagcatctgggaggcaggtttgtttctggtttcctcataatgagatcacatttgagcagtgcttttgtgtcctttccaagttggattcagtgtacatttaaatttttgttacattacatgttgtaaaatcatcattaatttatataatgtattagtatggcatatgttgcaacattatgctcacttaatattaatagtcaatcccaagtctgccttgcccctactcaggaggcagtgccgagtgcagggacagctgccaccacagatgtcccacttgttgctttaggcaatgatttcaggtctcattataaaaggcgcgcttactgactccatctttttatgcttctatctgatacctaaattggcaggcagtctgcttctcaagagctttaatgtcagagatcagaggtcctccctccaggcttcacttccctgctccctgaaatcccataccctgtgcaaggcctgggcttgccttcctctgacctaggattgcagatattatcgccagtttcaagcttgaagtcaataacatgctatcaagggactgttgattttactgacatttccttgttcctgtaggttaggctatatttgggttgttcaccaagttaggtggctgagaacctcctacatttatgagcaaagctcggtttccctttttgctttccctccgctggttctctgcttagaacactcacaggcatccttgggaaccagactccctgtggtcacaccatcctcactcccctcctcctgcaagggaataggatgtggtttcctggagcttggatagaaagaacaggaagggcgttttcatatgcccggcattaaggctttgaagttcttaaaaccccttctagggtgaaaccgttagggaatttcaacgacgtactagaattattgaacaaatgcaatgggaggatcttgccttgatcctgaagcaacaaatacactttaaaatgacgttttagagggaaatgggggaaattgaatatggactgggaactaaatgattgaaagtagttttgttaatcttgttggtataatattttgtagttctgtttttaaactgctgcagtgtttatggccagagtctaaatgtttacgagttgctttgcttttaaaatattccaacaaaaaaaaaatggggacagagaagataaatggaacaagattagcaaaatgtccaaagttgttgaagctggttatatatatgaggtttagtatgtgagactgtactcttgtgtaaatctttaaggtttaaaatgaaagacagtaataaaacaaattccttagagccctgagaagagccctcccatggggccagcctccaggatgggcctccctgcacacacaacagggcagatctagcatgagggtcttttcacacaggcacccagctgcagccaggcctgtacggcagatacacctcttgcatcttcaacaaaaatctcaaattctattaatctatactcttggcttttcttttctttgttgctctaatgaaatcaaagagaagaatgttaattttaaaaaaaaagggctaatgaggattttgtcaccaggtcggccatcctagaaatgcctctcacgtagctacccagtggctctgaggactgggggatgcttacgctttccagctgaaaagctcttcccaccctctgctgaggcctcaggattcttgagatttttgagtgtacggcccgctccccgtcatttctgttggttacatgtgtctctttactttcgtgttgagacctctggtccataccctgaggctgccctgactgccccaccacgtacaccagccaccactccggcctctgaagccagccccaagcatgcccatttgtgcactatccctggtttccaggtcctcatccaggaggtccaaagggcagcatgctcttaaagctggtggccccacacatcactctgcccccaaaggctaagttagcttgtgcttcccagctcttcctgccttcccatttcctcccttccctgcctccacagtcagctcctggatcctttagtgccaggtgcagcagaagttcccagagactcctccgaagatcacgtggcctgttgtctctgttctggtcaatctctggttccttcctgcttcttgttctcccgaaccacgaatggcaaagatcctgatctaccattgtgctcccaaccgctgccccttccaggccgctggcccctgccatgcctggttcatgcaggtaccccttagcaggcagcactggtgagtgtccctcctgctctgccttcagccagaccactagggagaaagggccggtgtcagggagcacactgccatgctctcctgctccctccctgtctctctcttgccctgtctcctaggcttgccccctgccctctccctctctcctgggctgtccagattgcacccaaagtgatgtatcagagtggccaagtgggagctggactccagagtgcactctgctggctgcagcttcaattaccctcgcatgaccgcgaatactcagaggaggggcctgtttctaattcaacaaggggccatcgaggccagccatggccctagaatccttccctctctgtttcatctgaaaagctcgccagctgctttcaacctcccagatcggtataccctaattatagagaaaaacccaactcactgaaaaggaaagcattgtgcccagatgagtggaagctaattctacttttgtttaatttattaatttatttgagtgagcatgcagatgtttgcaagagccactaaggacttaaagttaacaggtacacactaaaaaaaaaggagtgccaccagacactgagtagtcagcaccgcctgtgctgggggaggctttcattgctgcagagggttcaaggacaaggagagccatgaggtggtggagtctgggggcttcatgcagaagggtggtcttgactgagctttgagtcagggagttggagaggctgaaggagttttttcaggatcgtacaatcatcagagatgctgagagttgggaggaaccttgtagatattcatgaactactcatgaagcatttaatgtgtgccaggcactgtgctaggtaccagggacatgggggtccttgttgtgggcaaacagggaagacccccaccctcctggaactgacatatcagtggggagacaggcagcagacaaaccaaccaaaaaggtgacatcacatgatgtgaagatagtaaaatcaaggattgtgttaggggatactcaggggtcaggctgctttgactgtgtggtcagcaaaggcttctctgaggacacagcatttgactggaacctgaaggattcaaaagaactagacatggaatcggagcgaagagctctctaggtggagaccctgagtgcagagtctcttacagggatgcacttggctgtggggactccaaagagggccagtgtgcctgcagcagagagaaccaagggatagtgccctgaggcgagaggccggggcagggcaggagggcagggcagaaggcgcagggccatgcgggaggctgggtctgatccagtgccctagagggccaccagaacgtctgagcagaggaggccctgacctgatgtccgactcaccctttcagagattccctctgagcggtgtgaataaagagcagtggtgttcgagagcagaatgggggcagggaggatacttgcgcagtatccaggcagagaggatggcagcttggacaggggatggtgccggagatgcagagaagtggtcaggcttggggtacattttgcaggtaggaccagctggattcactcacagcttagatgttggagagagggaaagagaaatgtagggtgattctgaggttttctaattgagccagcgaagagaaaatccccaatgcagaaactgtatccaccacctgtgctccttgtgccccaaggcactgctccgggtgtctggcccttaccaaccaggcactcccttcagctggtagcagactcttgcgccctgctagaaactaagctccttgaggacaagaaccatggctttgtcttctcagccttgggctcaatactctgtaggcactagatcctacaaatgtctttactttatgtggccaagagcaaaatcacagaagtgaggatgagcatcagatggaggggggcaagggttgccaaggaccaagggtggggctttgagtgctaccctggttttactttggaatcctctgacctgccttctgaaatgcagcagcaactccagcgtgcagcagcacctcacttccgatgcttttttccaaacctccaagaacaaaaattagaaaagaaagatccctaatgtattctactggcatttgggagtaggaggctaggtggttcagttgccaaccccaaaatgagccttgcctgactttccctgatctgtcagcatccctcctcatccataatacctgctaagcatcacgtgctgtcaaagttgtgttcctttacaaatctgagtttgtccttcagaaatcgtttcctcttaagtactgtgcctgaggttcagctgctgtgtgtctgaatggaccagctaacttgcttctccccaggaatggagctcagcatggagcttcataaacgggggggagctcgtgcagatgtaagagcctgcaccgttttccattaggaagttcgaatggcacaaagctatagtaaatatgggtttctgtaaacacaaatgattaaaataagcataaaattacctgttatcaaattatcatgaagaagaaagtgttgggtcatttcgagcaaaactgaaaagaatacaaacacctaggcaggaatttaagatccttctcaattaaatttcacttgaaataccatgatttaggccaattctggttttacttattcgactttaagtagaagacttttcttttacataccaagggttgggtgtcacaagaactccaactcttgtcctgtagacagtttttcatcttgggcctctcttctgctgaaaaaatattaattgtcttgctggtcagctctaattaccctagggaaagaatctgattgatgtctgtatggtactggccctccaaaaaagccttgggtccctaaatgcttgaatgctttttgcttgataaagaattgctttctgtgccaggcattttttttttctttgcagtacctggctttgtttgaaccagaagagggagaacatgcagaggcacagctgtgtccatgagacgagcatcccataactatctttctccagccagactagtatccccttcaccttcatcttatacagagtccccttccttctgaccggtgtggaagttcaatcatcatcaagaaataagggcttctagtgccaggcaaagcttttctttccagggttttcagcacatagggagaagggacagacatttaaaatcagtcatcaaggtactggaggcagaggttctgctgggatccatggaaaggtcattccctggagcgtgagtactcaggaaagttggaaggaggatgctatctggattgggggtccttgtgtgctctgcagagagggagatgaagcgcagctcaaacagagagagagagagcatgaggaaggacggagcacacagtgagcttgtcagctcactagggctgccataaccagtgaccacacactgggcagcttaaacagcagaaatgcatccttttacagttctagaggctggaagtccaaaatcaaggggtctgcagggccaagcgccttctgaaaggctcttgggaagaatcctcacttgcctctcctaacttcttgtggttgccggcagtccttggcttgtagatgcatccctccaatctctgcctctgtcttcacatggccttcttccctaagtgtgtttttgtgtctctgtgcctgtcttgatgaggataacagtcattacatttagggcccatcctagcgcagaataacttcttcataaccaattacatctgcaaaggccatatttccaaataaggtcacattgcaaagttctaggtaggcatgagtttgcgggggaaactgttcaacccactgtagtgaagtgctcagaaaatagtttcgtgtgagtggacagtttgttagggaataataggtggtaaggatctgactgagaaagatgttgagcattaatttacaggcttcgagtctgtcccataggtagaggttgtaataaaagcagcaaacacttacttacagagcggctgctatgtgccaggcaccgttctgaggtatagaggtactgttattattattccaccttagatggagaaactgaggcacagagagactcaataaaatgcccacggctagaaagaaacagagccaggattctggtccaggcgattggctggagagtctgctcttcactcccatgttgttactttcccctctgagcatcttcaacacatttgagcagcccaggatgggcagtgcttcccgtcatgagcgttgtgctggcaagcacaggaataagctgtctgactttggtccacattaaatgtggccactggctgggagaacgaaggcgcttctttaattggtgtcagtgtctaaacctttgcatgaagggcctgctgtggtcagtagtattgccctgttatctcgacagcacatgaatttttttttttttttttttagttgcagaaattgggaaagtgttggtttctaattcctggaacttccaagagtgaggttatttgcaagggattccacaagccaactcagccataccctttccccaacctgcggcctagatagatgagtaacacctggcagtgccctgtcctacctggtcaccttttttcataccttacaactaggatgaccaacgaccccagtttgcccagaactagggggtttcctgggatgtgggaattttagttttaaaaccagaacaagttggtcgccctacttacaatcccccttattgtgcactgccagatacgacttctccagcagagatgagctgcagcagcacccacagggagacagcagaatgtctgtcttggttggtaccctacattttcagagccataatcatgtctgccagtaggaaggtctctgaaagtggtaaaataagtgggagtgctggagttatttagaatggtgctgttcttcttacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtgtgcagcaatggtggggaaggtggggtcctgctctctctagtaccagcctggcagttgcctgtattttacctgaacctctggatggagactgagactctcccagctccttgcaaattgtataaacaggcactcatttagggaagagtcctggattttgaatcagaagacttgtgtttatttttctctccactttttgaaatgtttaaactctatttctattctttgggtgattacccttgataatttactaattctatttaacttaacaaaatgtgatgttaaacaatatcaagaacctcctcctgtataatagagtgaccttagactattttaactcactcatctgctccttacttacatggaattgtcgttagtattttagtccaacttttatttttaatccaacaagttagtgagtcttactgttatatagatactgtgtgtttggatatatgtacaccttaccattttatttgttcaccatttttttactcatttcagtccatcctttagctagcattttctttcttcctaaagtacattctttagaggctcctttagttccgtaatggcaaattcagtgggcctctacttacctataactgtttcacttcttgctcttgaaagatagttttgctgtgtacacgattttagacagacaatttttgtcctgcagcacaagaaaggtgttattccactgtaaagtcagctgtcattccaactatggtttctttgtgagtaacctaacgtttatttgtagctgcttttaacatattctgttgcctttgtggttgtacagatttactaccatgtgtcaaggtgtggatttctttccatttgtcttgcttagaatacattctgcttcctaagcctatggatttagatttttattcagttattgaaaaagtacagccataatgtttaaatattgcttctttttaattctatatttcttccttctgacactccaattggacatctgttagacattttcattctgtcctccctgtttcttagagggtcttacatatctttcatctccttgtctttctgtattctgggaaatttcttcaactgtatcttccagtttcttaattctattttcaacttaatctatattactgtttaaaccaattttttatcttgaccattatatgtttttgtttcagtcagttccatttgttgcttgattttccagatccatctctaaatctagtagtttctatcaattcctcatctttgtgatttagtcctttatttcattaaatatttcaaatatagttgttttatagtctatatctaatatttccaatacctccagtctttggaatctaaatcacttatccagtgtttcttcagatttcccatcttaggggcttgtccttttgtgcatctgatgatctttgattgtgaccccaacacttcctcttcatttgtgagagtcctgaagacctaaagtaggtctggggagactttcttccagatgccccttggaggtgttggcttggcctaaaattcccaggctttcctgccccacctcaagactggcttaacctgcaatttcttgacagcactgctgttattggcttccatcttcaagcaattctgccctcctggctggctctctctccatacgtagcctcagctcagtggaggttggtgggaggggttgttggtttgaagcagatgattcttacagccatctcctaactcttataaaccagaattgtctcagagagtttggcccttcgagggtttggtgcttctgcagcaggagggcttctcagagcatttagtcaaccataatgccaggagcagaagtctgaaggcctgggttgaagccctgactctcccacactaaggctgtgtttctgggcaagcctctcctacttgggtttcagtgttcttacctgtgaaatgaagatgatgacacccatcccttccttcctacattgctgtcaagatgagatggtgtacaagacactttggcatttaggaacctagcatttttggtgctatcactgagtgcctagaagctcagttgggtaattgtgctggggcatggaagtgaattgcacatttaaagctattacacaggagcagatcacctacagagagccggtttggctggcctctcagcatacccagctccgggtagtcctattgtgccttatgcataagcatagagttgatctcataaagtgatttcttttcaatgatagggaaaataagtccccaaacaaaagccagttatgaatgtcagagcaggatttgggaattcagagattctcaaaggtctcagatgtaaccttctaaaatatcaaagatgatatgtgcaccatgggggtgagcagttgtcattaccaagcagcagtaagacttcagaatgaagaggtcacttcaggccaacaagcacctgttgccagctgctggggagagctgaggagaggggctcccaagagccgactggtgcttccccttgtctgccttgacttgtctctcctcctgtcccctctcccgtacaggtttcgcctccagtgccaccgcattgtcaatgacacgatcttcaccaacctgatcctcttcttcattctgctcagcagcatttccctggctgctgaggacccggtccagcacacctccttcaggaaccatgtatgcatcgcctgtgtcttctgcactccttccccctggggctgtgccaggcccacagcttctgttgctgacatcattgttcaatcaggagcccaattctaggtgtcataattagatccacaactaacatttcattaagagagtagggctttgatagaaaaccaccctaggaccacaagcaaataaaagagcatgtacccaaatgctcaggctggtttgataattggcaaagatcaggactttcattgcctgtggatgttccccaggaagctctagttccctgcaaacttagtaaaatgtggccactgactacatgccctcccttgctcccagcatgctctgaccagaaggggagcattggcaaataggtgccaatgatatggctgaccttacctaaaagagagtcttggtacctttggtagagtagaaccaaatgtgaggacccacccaaggctctggtgaacaatattaaaggccagtttaagaattgctctatctcaaaacctcaaaactttgtcaagtcccaaccaagtgggcatgaagacagcccgctgatctaaagccatacccatgccaaaccactctgcgctcctggggcctgcttggtccagggctgtcttaccgaggttagcaggtgttggccccatccctgatccatcacctgaaatataataagtatgcagtcctggagccggtcctcagcctgtgcagacctcacctgaaggatgcacctcccttgccccagaggacataacccaggaatagatgtccaccatcacaggaagctggccagctcagtcccaccaacgtgagcgaagcattttgaatctccctgcaaaaagacaaaccccattctctgtccttttgacaagtatctcagtggtctgatttgggtttgtaagtaaattggattaatgggaaaagcatccaaccagatgctgctcagatccagtaccagctgaggcatgccctggaagctcacctcacttatctgggggcttcaagggaagccgctgtgctgcctgaggctagccccgcctcaggatgtctgtgtgtgtgccgcttgccccccatgtccatctgtgtccctgtgcaaaggcttaagtgccaggcatctcattttgaagtgtggccccttttctggtgaacatccactgacctctcttcccgtcctgcttttctcccttccccatcccatccccaccctgttcctttttgttttgcagattctgttttattttgatattgtttttaccaccattttcaccattgaaattgctctgaaggtaaagcccccatccccttctgctcctcctgtcccccttgtgccagcaccaggtctctgccgctgtctgtcgctaacacacatgctccttcctgttggtgtggggttcactctcagagccactaatccaattatgcttatttttcagatcctaggcaatgcagactatgtcttcactagtatctttacattagaaattatccttaaggtaatgcaacctgggcaatgcatcctctgtcgctttctttgtctatctctgctctgtctggctggatcttttgtcttttctgtttctttcactctctcttttctttactcccaagcctgaaattggaaaaatgagtgcccctcactttgtgtgatgcactttgcccagacttagaagccaggagcagcctaccccaccacagctcctccctccagccacccctaagcagtccgtggcctggaagggacacgtgttggctgtgccaacattaaggctgccatttcactggttggggctgcagccgtcagcagcgccagacatacatgcccacatgcaccagctccggttaactgatacctgagcccacgtaggactctccttccctcctcctgcttcatacactctgaaagtgggaaacctcctggggcgtgaaagaatcacttgagctactctctttggatgcccatccttagcaccttcctcagtacttgcagcagatattgggtctaagctggagttggggctgtgtcacagtgatcacaggcctactgtgagatgtggagctggtctcccagctgagggcttttagcagggccattacagactactgccgaccctcagtcacctgctgcaaagctttgtcacagtgccccttgccctgagcgtgggggagggagaattgtgctggagagctgagtacagcaggatgagagcaggtgccgcaaggaacctgagcacccagcccccagcccccagcccttgcctgctgctggcccagctcagttctgctaagggaactgctgcaacattgctaccctcagaacaggcagagcccacctcagggcaacactgggatgagagagagagtattcctccatttttcgggtatatttctgagtctctaaaccaatgcgtggcaagccagttcatctgagagtcagggtgtgagttccatgacctcagggaacgtgtgctcctctctgagcaagggggtagattctaccctttccccaaacagaaggactaaggctctgaagcccatgcttcagctttagcttcttcctgggagactagcctgggactccccctcccaaggagtccaggctcccttgtcatcctatcgctgtggccaatgcaagctgaagtccacacctaaccgatgccactgccagctgcaggcctctccttccctgatgagactccctcatcatggcccagcctgttgatggacaggacagttcagtcacatccagatacaaattgaatggggcagtttttatgtgccttcccctgtgtccttgtccccaggacactcaggtgcccccagctgccatccctggttcctgctaaccaagtatgtggctcagatttttcttttctgctcgtggagagtagatctgaccaggccttggttcctggaggtcgggagagggaaccgaaagttgcgtggctgcactaagatgcaccgcggcaaaacctgctttccatggtgagctgctttgcttcccggacttcagatgcagggaggcacacagaccccagagttctttcccaggacaagagacgctctgaggcccaattctcagtgcccttctacagagctgcccttgtggatttcaatggtgctatttctccttcgggattgccatacaagctgaagtgaaaggtctctttgcaagcattgtcatggcaaggtccttccatcccctccctcttctactttcttctatgctcagcatgcttctgaatagaaaccccaatgccggaacactcccctgtacctccttcccactgggtccctcttcccggcctaaggcccggtgtcatgtcatggcacagatgaccgtggctgtccaagggggacatttagcacaaggaacagtggaagggcctggaaatgtttggccttaaaaaggaaaggcttgtaggctcacaacagttggcctgagtcatacaaaggaccgtcacatagaagaggaagaaggcagaatcaagaccaatgagtagaaatcacaaaaaaagacaggtttcatagctagaagagctgcctggagaggcagggatggcccgtggttgaacagagagctttcctacccttccaggcagagctagcgagccacgtcccattcctttccttcctcaggatggaaacaccccagcaagggccccttcccaagtaatggtgtagaattaggaaagcaggaccgaggtggctggcaatcagaaaaaaagggtcaaagaggaacaattagcactgggtacctgagtctggcttttcctgatgccctgaacaccacagatgactttcaagtaaatgctacgttttccccatgtccatttgccctttcttgtacagccactcttcctctggccctgcctggatgcatgttcccaccgcccccacatgcacacacatgcacttgctcaagtgttggtctcatttgagggtccctaaacaaaacaggagcccaaaaccagaggacagagttggcactctgagccttattagtccacccatctgaggaatgcagagtgttctgttagagctcagtagtagcctcagaagatccaagccaggagcaagaagggatcagacccagtgccttcctaacactaaaagcaaggtggctggggaagtactgggctttctgcaggcacaattaatatgaattatgggagcctcctgagtccagtctgtgggggtcccagctcttcaccaagaggcagggaggcaaggcttccagatggtgggccttctagaactatactcccttgcatcttttatgtaatctacccacttctaaaaaccattgcccaacacaggtgcctgagtcctttgggaccccctgctgcaagagataaatggaaagaattaggttgcaagagctatttttgcccatttccctctgtgtttgcttttgaatggctctgcggacactctgccctgggcatgctctgattccaaagagatgaactggaccccagatgaccggggagccttgctccacctctccactgtcggctccacattttccctttggccgatgcttcctgtccgctgcctgtcacagcccttatcctggataaccactggcccttacgcaagtcggcaaaatgagaaaggctgtaaaggtgatttgttgagcacctgcagtgcgcagctttacaccaggctcagagggtggtaataatggccaagtcctgtagcagtcatcgtcatcttgtgtgttctctttttaaaagtttccaaagggctttcacaaagccaggggatagtttcctcaccttttgatgagaaaacagaacttttctcatccaggaagcatccagaattcaaatccaggctgtagtgacagctcacccttttatggggctcaccgtgtgcagggtggcatcctaagtattttacatagaggtacccacttgatgcttacaaccctgtagggtagaccttatcctcatttttccaatgaggaaacagaggcactaagagaatttgagtttcttgctccaggccacaaaaataaaataccacaggtctgggattccagcccaggccgtctggcctcagagcctgtgctcttagccactgagcctcatagcccctctgatcacacaacttttgcccttaaagaactccagatgtagtctagaagcaggacagtagaattgagtttagaatatttggcatcaataataagcaccctttgaggccaggaaggggaggtatgctaattgccagggtcaccactggaacttctcaccaggcaccagggtgaccagctggcctagtttgcctaagactgaggagttttctgggatgcaggatttctgatgataaagcaaatctgggcaaaccaggatggctggtcaccctgctgggcatgccccgccccccaacccacccactcacggcagatgtctggtgctctcagctggcctaaggactcaagcatttggagaggcagtcgggatgtgtgctcccaacccgacagcatcaggaaaggaccctgcaggcccaaagccatggacttgggatgtggaacagtgcgaaattagagtgggatggtggggcccacttgaaagggctttgaatggaggactaaagagcctggcttggcctggcaggtgcaaggagccacccagcagtcctgggctgcgagagtcttgggtggttgtgtgcatggtagcagaactcttttcttggcaccatagcgccgtctttgtccttcctgttccccatggatggtgcttgggacttgcccaagggatgctgtgggaggaaggggtggtgtgaggggtctctgggctagggctagggccactcacactggtgttcctttgtccctccctgcagatgactgcttatggggctttcttgcacaagggttctttctgccggaactacttcaacatcctggacctgctggtggtcagcgtgtccctcatctcctttggcatccagtgagtgggagcccctcagcccacgatgggccatgcagctagcaaggggtgccagagaggacaaccagaccctggagggcctgcctgcagggccaccgcagtgtgatgagagtggggtggggcctccaaagctgtgcatggtggctttgggttcttggttctgtgtcctcagtggtctgatacttggggcacgttgatcaggtgagaatatgtttaattatctgggttttgccatgacaggcagggccaggctcagctattaagaaacggttgtctccaggaccttcctgcctcctccaccacggccccagtgccctaggctgaccttcagcaacccacagtctgccactgccgtgacctcccctgacctggaccctccttctccctttctctcccctctctctccagccaaagcacctcatgtatgagtgtatgtgtgaatgtgtgtatatatatgtctgtgtaagtgtggggtgtatgtgtgcacgtgtgtggatgtgtggggtgtgtgtatatgtggatgtgtgtttgtggctgtgtgtatgtgtgtgtatgtatgtgtttgtgtttgtgtctgcatatgtgtctatggacgtgaatgtatatgtgtatgtatgtgcatatgtatgtgtgagtgcatgtatgtgtgtgactgtgtatatttgtgtcttttgtgtgtgtgtgtgtgtgtgtgtgtgtgagtttttcatttcactggtctggggtacagtctgggtgtgagttctaagagctttccaggtgactcccctgtacagccaagcttgcagtcctcgttcaggtgtggaggatctgattaccagtttctaccaagttctaacagctgatagtgtgaatcctacactttaactttcaaagcacttccacatacacattcttctgtggtcctcacacacacaaaacgatgggggagacggggcaagtgttatcatgattgtatagatgggaaatttggagttcaggacatcatgacacttgctcaaggtcacacctgtggtagagaaaggcctaagtcccagcgttcctgggtctctcctcccaagagtgttttcatggttggctgagatcatgcagggaccaggaccttgggagagacccttttctgtgatcatcagttatattaccccatattttctgcctgggagcctacaagtccagatttgaatcccagcatggccactcagtcactatttaaccttgaatgaggaattcctcctctttagcctgtgtttttcccatctgacctttaaatcccttccattgtgattcggtgcaaactgactccctcccagagagactgtaggagagacacagtgatagataggaatggcctttgcatctcttggaataaaagagtcatgcaccagagaaatcggatctttccaccagccccttgagcacatcatcctgaccacacaaagcatgaaatcagcgcttgctggcctgtcattcattgtttaggtcccaagacaagtatgaggctctccaaaagcttgagaggctatctcaggtagttagcccgtgagggttaggatgtgctccatagctgctcaccaaggtggtatggttaatgagccccacctgggtaggatggacagctccaaaaaccatccaggcatcttgcttagggacctgtctcctgctgtctccattgcactagggaaaagccgtagcccgagactccgagaagctctggcttggcctcagcatcccaggtgtatggaacctgtagtgccacgtaggagccaaagggactggccttctgaagggtcactgaaaaatcaactgacaaaagaaaggttaattggagacaaagcattcacatttatttaacgtgtatacacagagcctatagaatgcagacccaaagatacaggggaaactgaccatttttctgcttaggttcaaaaaagtatggacagccatgtagaaatgtgattggacaagaagcgtaggatctaacgtgaatggaccgagtggggaacccagcaaggcctgtctctaggttcttcttgtgctctctgtgaagctttccctccttctgggtcggggcaggatcccgtctgcaacaggagtctgaggatctacactcccacatggtggatctggtcattttttatggccagtttttatacagaaaaggagagggaaattttgaataatattttaggttgtgtggctggctttggggaaacggggttctgggttctggtttctgtgacccatcttggggaagagggattctagtgtctatggctagcctgagaggagaaggggactgagacaggagggcaagagaaggtcagagaaaaacttttgcttctgagactgcttctaaggccgtcgtttcggggtgttgtttcctgagccccaacagcgaagcccatccttccttggagtcctgagtgtgctctgggtgggttttatgtttaggtgtcaggggcaatatgtgtttggagataaacactaagaaatctcctccccatgacatcacctccagccacaaggcccgagatcccaccgttagtacggcattcctttaagtgtagtaacgtcttcagcaggcctcatgagcaggtaccattcaggcagtttctcaagcacatggctgggtgatttacatagaattcttatttaacccttgcaaagaccttctgagctgattacagacccattttacagataaagaaactagagctcagaaaatttagaaaatttgtcctcagtgccttggctagcaagtgcctgcactggggtctgaattcccatggccttgctctgaatttctttctgtgacactgtgaatgcccctgtgagtagcacagtacattgctaatgacctgccatgagccaccttgcatattatttagtcacccacaggaaagccccagggttacaggcaagctccaggctctcacgggatgggagacaggagtagagagtggtcccagaatgcgaacatccccaagatgggctttatgttttctcaggtttgcctcggattcacctgtcaggacattcccttaccacattatttttgctccccccagaaacaggaggagcttactaccctgcctgtttccctctcccaggtccagtgcaatcaatgtcgtgaagatcttgcgagtcctgcgagtactcaggcccctgagggccatcaacagggccaaggggctaaaggtgagttgagggcttgggtagggagtctccagccagcccattggggagtgggagctccacagaggtgaggggtgggttggaaggagatgatggtcagaccaagtggctgccatgtggggtcccggacactggtcccactgcatgtcccggttccgtaatgaacagaatagtaacagaggcagccatcccaagtgtctgccctaagcagaatgtgccaaagggagatcccacacaaaccctgtgcccctgtggtgccaccatccctatattccttccactgtaagatgggaggttggcaggacttttgtccttgtagtcacggagagtccagtgggggcctttgcatcccattagggtccatcacttcccatgtgactttgggagcgtggctttgcccctctcagcccaattactccccgttgtggcaaacgggctgcccctgctacctcctggaaaggctcctggcatctcctgaagccacgtccctctccccgtcccttcccactgcagcatgtggttcagtgtgtgtttgtcgccatccggaccatcgggaacatcgtgattgtcaccaccctgctgcagttcatgtttgcctgcatcggggtccagctcttcaaggtaaagtctgggctccgttgtggtcctcctacctcccctcccatcagcattcctggggaagggaactggcagatatagtacaaacgagacagtgtcctgagccagacttggcttggatataacctccacctgcagcccgactcaaccttcagaccagggtagggaggcgctagaaggaggcatcgggccaccaggccagaggcccctcaccctctccacttcacctgcccttgaggtcactgcccttccttctagaaagagagagagagggactttcatcctgtggaacctctgtgtcagtcagttgcttaaagcctgcagcggtgacctattatcaacagcatcacgtccccactgcaccacccagctttcagagccctgcacctgtcaaagtcagctcctgctgcttcctgcagcacccctcgtgtcctccttggattctggtcttttttgccctcacccttttagttctgctattctcccacctagagcattcgcccccgctcccctccactgtgtaaacgcccatctaattcatccctctgagcccagctccacttctccctccctggcgagacctccccggagagtacagctcccatggacccgagctcctgtttttgcattgcagtgctacttgcagcactggcgtctgtattcgccaccgttctgtgcgtgtgagtcaggtcctgcccatctggattctgcactttttatcccactgtccctagcacagtgctgggctatggagatgctcactaattgcttttggattgactcattgattactgaacatctctgatactctgttctctgccttccagggaaagctgtacacctgttcagacagttccaagcagacagaggcggaatgcaagtgagtagaggtgggagggcagccagggccacggccggtcagccccaggaggctggaggcttgaccagaaaggagggacagctcattttctaagactgcagtggcacctgcgctctgcctgtgtgtcacctggcctcacggacacaatgtgtagcattttttgttcctgaagtttctgcccactgaagttcctcccatggctagaacggtgaagttcaagccaggcagtcccatcccacccagcattcaaggtcactggcaggccaggcgtgaaggaagatgggagatcccagagtaaactccttctcctcctctctcaggggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagtgagtatgcaaagcaaggccccacgagccctgacattcaagggccagtactgactttccagcccatccccaagttttgttaatgtcccgcactccctctggaggtcatatttacctgggtcctccccaggcagtgaggtgtatttctagaacttacagtccactgtcactgctgaaactgactcttctttctctagaaggtgtcaagaaactcccaccaaaagtgacctttttttagccctctttccaacctcagcatgagccacgatgtcagagatctctgtcattacccttatggcatctgggagttgggtgtggggagagcttctccaggtgtgggccctgtggtcaccataggattcaagattgccactcccagcatgcccttcattgggtaaagatggctgagatgtctttgttttatttgactggatcccggtctccttagaaaaagccttgcctgtatttacagtggaaagtaggaaagggatggaagcccgggccccacttcctctgcagaggcaatgcgtttgtgcgtagagcagcccgtgggccttgcacgctgcatcacctctaccaggcagcttcccatcagatccttatatctttgtatagatacctgcttttcccccaatatgtattccagtgaaattagaatctgaaagtcagaaaattctaaatgtttctaagtcaacagcaatgcatggatcttaggtaagagtcacattattatgtggtaagatataggtgatagctggagaataaccaagtgctgtgcagggctacagaggaaggggaagagataatccctgtccatgaaaaataacaagcttcatggggcacacagcccaggctcaaatgaatggcatatgtatgtaaactgcttatgtctaaaaccaggccattggtgatgatcggagtagcatgggtcatgtgagtgtttttatctaagtggatatttgctctcggagagatttattttacattccttctaacattctctgagctcatgccagtttgcaaagctgtctcaatatttaccaatatttccagtgttttaaatcaatgtccatgactcatgttacatttaaatagctcttcacagtttcaaaacaccttcctatacattattctaactaccctgcaaggtaggaaagtcaggaattattgtctccaatttacagatgaagaatctgagtctcagagaggttaaacgctttgcccaaggtcacacagccagtaagaggccgagctgggactccagcccagagctgtctcctgcaccctgatccctgggatccctggagcagtggtgccgtccttccgcagaggggaccctgcttctccagttccctctgtgggacctgtctcctcctgcaggctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccaggtagcttcctaggaaggagcggagggaagcggggcccacggagggaatggcagcctgcggcccaccccgcagaggggctgcgacagggagaggccgtgcagatactgagatcgtctctctattcctcaaccagagtgggctgtcagtctttttgagggacctgtgcaaaagaaatgcaaattcctgcaaaccccagatctggcaaatgtactcagccaacaaatatctatgaagcttctacttaaggatactctatgataggttttgtcaaatctcatgccctatatagaagttaacaagttagagggacccaagtgggtcggcaccatgatacggaggagagaaactagaactgtgagggagtgagggcttttggggtggggaacagaacggcttcaggaaaccactcttacatggtttcttaagtaaaacccagaggcttgtgtgggaggtgggggcaggaaagaggcttaagtgggagtgagatggtgatgccaagtatcgtgacaggttctgttagccgtgaagagctggcagtgccgtggctgagtcaggaagctgtcgtggtgggaggtagatgtagtgcctcaggtctgttccctagctcggctcccactgggaggagtccgtggggaaacacatccctgtctgtgaataaggagtgcccacgggcaggagcgcagtgtggtgtgctccttgtgaccctcgccaggccagccagtcccctgtgggttttcaagtctacatctcaggcatagactcactctgctggctgctgtgtggaccctggattgaaagaagacaggaaagagaggaggccagttagaaagtggaaatgagagaggattagaccccgatctagtatccggttaatgatggtagcgatggaaagaataggaggaggtaaaagcgttaagactcaggcgttggacaccggggctgagggtttgagaagaagctggggacattccccagttcctgatctggaagcctgggcaaagtacagagaaatggactggctctttgccagagtcccaagaatctagttagcccagaatctccttccctctcagtgaactgtgtttttccatcttatggacactggcaaataagaaagattgatttagttggccaggcacagtggctcatgcctgtaatcccagcactttgggaggccaaggtgggcggatcacttgaggccaggagtttgagaccagcctggccaacatggtgaaaccccgtctctactaaaaatacaaaaaattagctgggcgttgtggcgtgtgcctgtaatcacagctacttgggaggctgaggcaggagaatcgcttgagcccaggagatggaggttgcagtgagccaagatcacaccactgcactccagcctgctggatttaggacaggaaagaaaaactgaggagagaagtacccaaggagggtctgtggcatgggaagtaatcagtgagaagcacagctgtcagtcggtcaggaagcacattcttagcgatgccgactccctgccgaggcacatgccaggcatcaccagggtgaggaaaggaggtgtatggtccctgcctaggaccttgttacggggatttgacaagaaggggctctctccttgattaagggggccatggaaaaatcaagacattttccaaataacacctcccacctgtaagtgagccggagcggccaatgatttctcagacttccggagaaccccaccccacagtgtgtggtctcatcacatcccacacttctctgccagctccccccacaccctccagttaactaaccccactctccccatcctccaccaccctcccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcaggtcagtcccaggaggagcacagccatggtgctgcagaagggagtgtgccatggggatggaaagtgtaacggagcggcaggcagctcagtgcatcgctttcctggtcaccaagggaggcatttggagaaagacgagtgttctctgtcaaggatgtgctcctctctgggccttacggaagaatccatggcaccctgggttgatcaatggagagaggggaggagatggagaagggagggttgagctgaatgcattcattgttggttgatcaatggagagaggggaggagatggagaacggagggatgagctggatgtgttcgttgttggttgatcaatggagagaggggaggagatggaggagggagggatgagctggatgcattccttgttggttgatcaatggagagaggggaggagatggagaagggagggatgagctggatgcgttcgtttttggttgatcaatggggagaggggaggagatggagaagggagggatgagctggatgcattccttgttggttgatcaatggagagaggggaggagatggagaagggagggatgagctggatgcgttcatttttggttgatcaatggagagaggggaggagatggagaacggagggatgagctggatgtgttcgttgttggttgatcaatggagaggggaggagatggaggagggagggatgagctggatgcattccttgttggttgatcaatggggagaggggaggagatggagaagggaggggaggagatggagaagggagggatgagctggatgcattcattgttggttgataagtggggagaggggaggagatggagaagggagggatgagctggacgcattcgttgtcggtaaggcgtggcgtgtggagggaggtgggttctgcatccacctgtcttcagggacagagcttgttcccaagctctcttgagtgccagagtctccataaagttgtcacggccaaccagggaaatgaacacagatgtgttcagagatggcagagcagggaagatcttggaggttctcctgagtcctcctgactgcccacggagaggtgggcggccctctgggggtttggttcaaggaaggtcttgctgaggcgagggcctccgagaaggctgggcaaaaggtggggaggaggagcgacctccctgccccgtgttcacagctcctcccctctcctgatgcagcactacggccagagctgcctgttcaaaatcgccatgaacatcctcaacatgctcttcactggcctcttcaccgtggagatgatcctgaagctcattgccttcaaacccaaggtaggcctctgagaaagacctttgattcccaggcatcaggggtggacagaacggggaggtggggtgcaggtattgaaggcagaatgaggggaagagggaaaaaggcatcggtgaaggaccatccctgctccgatggtcagtgccccaactcctacacctgcccagagctgaaccaggccaactccaggaaacactctcagctctcagtgttgaccctggctggcatgcacaagctgcagattcctcgctgagctgaacctctgagcctctcctaggagaggcaggtgatggtctttctcctatgtcccatcctctagtacataacctgttaatagaagaaactatgctcatagactggcagaccaaacctctccaggcccagccccccagatccactcaggcctctgttccaccctcctcccatttcatcagccacacagaccaacctcatataaaacattcagccagggctggatttgctcagggctcaggactgagggctccagcccatgggcactcctgttccctgcctaagaggctatggcattgctccttacatgctctggggcaggaagaacaattaccagcaaatttctctgctttgttccttgtgtaagggcaagaagattaggcctgctgctgaatgaggcagggtcagaattcctgttctttggatcatctgtgcccttcctagccagtcacccccattgtcctcagtggtggaggagcagacactggtatgagccacaccttccaccctgggcctctgtagatgggtcagaatcacgggtatccactggccgggattcaccaccaggacagctgcttctgagggaggctataagagcaactgagcagcccccaggctaccataacaccttttggagaaggatgagaaggaacgagttctaggagcatcatgcagttacagacttgagacaatctctccagcttactgagccttcccctccctcctttggtagttttcccagaggcaacacagatcaacaggaggccaagagcaagaatccctggccatatcttctattttcattcaagtttttactggtctcaagattaattgggggtgggggagggtccagctcggcctttgaatccatgttcattgaggagatatccacagccttctttgaatgaatattcactcacactttggattccatatcatgtgctacatgtatatcatcgcacgtcattctcaaaacgtccctttaaagtaggtattagcatccctctgtggagaagggggaagggaggctcaaacaattaagtgcccaggattaattgatccactgctaagaactggcagaacggagactggaatccggcacctctgacttcactgtattttccaccacactgaggttaactatcattttcccatgtcaagtgttctgcgggtattttttagcaagagggaaacaaccttggagggacttaaaagataagacaatattcctacaatgcagattcttctgtcactcaaagaatgcctggggatcccagctgattttcatagaggaagtctcctaagggacatcctttggtgatagaacggtggtttcctgccttctccagagaagcaagtacactctttttcaccttcctgtacaagtcccatttaggaggacagatcttgtcctgacctagagaggacccctgggttgccctgacaccttccttagggtacacggtgtctgtgcccacacatggtcctattccaagccctgcagcccaggagctctgacagttcgccacccacagcagcatgaccagctgaggccaggagtgcagtcactgcctagccgagcctcagtctcggatgactcctctcagtggggaaactggcatcattttcatacagtgtcacgagacatatggtttaaatatttcaaagccttgagtcattccacagttgactcagatgtgtttctgacgatgtctgaggcagtctggagagcctgcagtggactttctgaatcatgcctcctgagcacgggagacatacagacaaccttccctgggaagtgcatgaaattgacacctgcaggagcctccgtcctccgtctaaaagacactccacctaaatcctgccaatcaaggaacaagccagtttcctaggaagtaaccattgcgagtggtctaaactgtaaagtgcctcctaatttcctctgtccctggttttctattgtgagaagatggggcaagataacagagacttttacccaagaaggaagacagccatcctgggcccatttgcatttcacattccagggtacatctatggtgtaaagagaaaggaaaatggatctttccctgtgaatttccctaaaggggctctggcaagagggggataaaggtcaccacccagttaggagcatcatggagcacagctgagtccctggattcttactgagctatgttcttcattcacaaatagactccaggtaaagcagctccaaaattttcaggcagaaaaccaaactggaaaaacttgaagctctggaagaatatccagctggatctggcccaagaaccagtggcttctaaccatgacctgaatccatgacaactttcatttcccaccattaagtaggactctgtgctgcactttttatttcactggcatggttgtttgtgtatgacccagatgagcatcagcatttgctgtgaaaggatggctaggaaccaaggatgttgaagacagtctgaagttgtcactgcttatgtttcgtctctgcaactggctggttggttggtccatcagccggtcaacttgtattcttgcttcattctttcattgttttcatggtcatggatgttcccaatttcttcatttctgtgtgttctcctcaccactccatggaaaataaatttactcaagtaagtccctgccttaaatctaaccatcccactccttaaattcatactctgttcaaaaaaaaaaaaaaaatcacacaaagaaactaggaatcaacataaaccagtttagattgagtcggtccctgacaaagcctcaggaacctgcaggcatggtttgaagagagtgaggtggatcatgccagcattgatttgaacagtgaacagtgacccagaaggatctccttccctagaagtgagaggccatgacctggagataactggatggcccctgcaccccacacgaaggtgcaggaccaggctgggcagcacgaaaagtgctggctggaatattctgaaggtaattaaataactggatagtcctatcatgaactgaagcttgtcagcaaagacaggaaaataaattttgaagatactcttatagatttgataaactgaaaaatatgcaatgcctggggaaaaagtctaacagaaatggctaagatctctacagagaaaatgataaaattgaaaggaattcaagaaaagctgataactgaagacatctatcatgttcctgaattggaaagctcaatattattaggatatcatttctcctcaaactgatccataggctcaataccattccagttaaaactcccaattgcactttgctggaggtgaggatggcaggagagggagccacaccgtaaatcctttacggccaacaggatgaggctgggtggtcctgaggcttcagccccttcgggcagctctgaggtcaccaaggagggaatgcacaggagcctggcgcgggaagcagtgtctgtctcagctactccagtgtcggctgctggtttggtagtgggagtgatgatgtcacttagttgcctgaggtttgctgtcgaggatgtctcagcaagggtactgggggggaggagctgcaggaggcgatgagtgagaggctgcgctccaagcttctcctcctcagtggaatgtggtatgccaggaaggcaggggttcaccccgtggaaggctcctaactcctcccctccacacaggctccacctgggccgcagaggggtgaagcagctgagactcacctctgcccctcagctgaagccatcccactcagggagtagccagtgatcacctccccaagaggaggacgctggaggggccttgaccctggcagctctctggaatccaagtctcggtctccctttttggctttcccccagcctgagaatggtccagaggggagaatggacccagagtgaaagcactcattggcccctctgaccccctgctttcttgaataagcagctgaaacctcgggaggcctggcccctttcccacacgttcccagtctccgctctctttctgtctgggcctcctcagcccagctgctccagcttcacaaagccagatggtttctctcatccccctaccctttcttctggtgattttcagccagaagttgacgcatatatagtggagcccctcttgactgggttagacagtctctcgccctggccgagtgagtttctcccactgtcggttgccccagccctccctggccttccccagccagtggcagctgcaagcacccagccctttccctgcagactctttcccacccagtcctgagctggccctaagaaggcagcaagcgcaggtgaggtctggagttagtcgctgctgcgagcccccatagggcgtgtcccgtgagccatggggcacccagacactcttttccacagtcgattggacttctgtctagacttccccatcagcattttattgccctagtgacagaaatctaacagccgtgagcccctctgggttcttagctgaccccctctggggtgcagagccttgtccagctgctggccagacttgccgcctcatggcctccatgccacttccgaagtggaggcagcctcctcaccacggctcctctccagacttcctgccggcgcccttgccctgcacgctggtctctgctgggcccgacaggccttaccacagccatctggggctgtggctcctgtctgccaccacacacaaaggacgtggctggcattttcagaggatcagctaagaatggggcagcagttcagttgccacagtcttgtctgctttgaagcccctgttatctttcaggaaagaggaaatgaaggcagtgaagccttggccttggctgcttctcagagagtagagaggcagaaagaggagcggtttctccggtcccccacctgttgtcctgaggaatccatcaacgaggccctgggcacttcctttatcgagagtgagggatgagtcaggactagtcggtagcctggtgaatgagatgctaccagaaccagagctgctcgggaccctggaggtcaaatgctggctctctcttggggccactcttcatagcacagctctgggcccagccttgccccggtctcactgacacatatgccagctaagctatagggagggccagggggctctggaatggtcgtcctagtggcgagcacctggagttcgtgtgccaaaaccagcccgctctgcatcgtgaaggctctgagctgacagaggctgttgctggccttggactttccacactcaggggcagccgtcctcgtatccagtgtgcccatgtgggggcagggatcctgtggcttccagagcagtcttttctctgcaggctctgctgttcttaggactggtttctgctcttacaaatgattcttggccctgacatgggtggccacaggccctgcggaggggagaaatctttggggataccctgaggatgtggctcaaatggaagggtcatcaccagctgccttgttttcactgggcttgtgtcgaaaggcacagatgagggctgagttggggctgtaggttcgcatatggatgggcagagggaaagttggaatgaggaggtggctgcatggggaagaacacttgcttccatagagaaacaacagcccagtttctcatctactctgtcagctctgtccatgtctagaaacttctgtcctttagatttagcatctggcctctttgggcaaatagctttcgtcacatgacccgaagatactgtggtccctcctccagccagcttggggttctccaggggcatccatgccctgtgcagatgcaaggggactttggaggctgagggtccggattgctcaggtgtggacctgctgttttaggtgttggagtctgtggcgccaggagtgagctgctcccaggaaagggaccagattctgacattcccctggcaggtggagaagttgggagggcaccctcagcagacaactcagcccccaagtcaaaggtcagatctgcttgtctgagcaagggaagagaaaccacctttacgaactgtgggccaggcctctttcccacccaggccagggtgtcagtctggatggtaatcagacatgttctctgcccccgggaggaggcaagtggacggcacaccaaagaacaggctcctgaaggttgccaatggtgacagaaacagccacaggagaagagagtgcatgagcctgtgtcagagcagcggctcatcagcctaaggagaggtgtggcaaaggccacgaggccccaaactgccccaccggtgccctggggcagccagggctgaggcagtgggaagaatgccagggccagaattcctctaaagacaccaatgtggccacctgaggggccaggggaaccctgcaagctaaatccatcaggcctgagctgagcctgccccggaggcaggagagactccgatgtccacagactcttccatggactgttgagagacatttcagaacgtgttcttaaaagctcagtcaaggaccaggagaaggaaggggaagtgggatggccaggaggaaaggatgcacactggagcccgttcctctttttgaaagcggagaatcttctaggaacttggtttgtttttcagtcatgttttcggcagcaatgacattgctggctgaaatgtactttctctccaacttgacctctgcctccacctgcaccgctcaccaggaatcatcctcttccaactgttttaaattagccatgcacttctgtatgatgcagtaatttttgtgaagttttaatttttacaaagcaaattttgctttatgtcttcgcttcatcatccactgaccccagatcccacccagagaggaaattctggtagattgagacccaggaagcctagatcccacctcagcatcaccttgaaccagccagggctgagcagacgggacaggaagagcttcctacaagcacttgttccttccatgtctgtttctctgtaaagtaggaagactgccttagcatactgtggtgagactgagtgaggtcatatctacagaggaatgaaggcttcagggaaagtgccattcagatgaaactcagccggatccctacgcctggggagtttgcgcccagccctctaactcagcaccaaaggaacttcacctccagcctgggtgtgccctcttgtctgtgaccattttaaatgggcccttttgcaatattggtattctgtcgtctttcatcctgagcccatgtattctatcccttcagtctgatttctgtctcacaccatgaaataactttaaggctcatcttaatgcatccttgaagttgggttgtgcaagcatcaacgacgctaccagcatctaaactatcactcccctttcctgtggctaatgcaacccattagtcggcttttcaagccttcagctcagtttttcaccattccctctctttctcggtgcctaggccttgccattcttcgtattctttatttcaagaactctttgtttgtgtgacttgcttagtgttttgctgcaggctaaagttcaccaacaacccccaaaatattttgttgagcagctcacgtgctaggcggtaggcttggtaccagggactcaatcatgaatacaagcaggtaggtaaggccacacttgcctggggcgactttggcccactcttgagacttgtagcatccccagttcaccctctcatttgtcactaggaaaactcctgtcagctggcattcatatttcaacttaaaagaagcagtcgataatcaatgcctacacctgagatcaagtaacatttagaagcactggagggaagcaaacaacatatattgtcaatgaagaaccagacatgaagctggatattttacttgccttatctcattcaatccataagacgaatattatggcctcccattttacatctgaagaaactggaggtcagaaaaaggctaagtccagagctggctttttgttgttattgtcagtttgtaacaaacaccatcctgcttagtatgcaccctacactgctctaagcaccttaataggaatgcatttaatcattgtaaaaatcctgggattctattgcaggcttaggtgactcaaaagccactctttccacgacaaccctattaaaacaagaaatgtgaataagccatgttgttgctatgcgcttagtgagtcctcagtaaatgttagctgtcttccttctaagatccgagacagaaagaaagaaagccattctcgagtcaccaccctctggaatggaaagtgttcactccactcctgtgtcctgccaccttctctgaggccccttgccgtccttccctctcattcagccattctgtctgtggcccctgcattccctagattgctttggacctttgaattttgtttccaaatctgagttgacaagcactttcaggagaggggtagtcagctgacaggtgggctcaggaaagtgaaaccgaagcctactacacactcatctgcatgtgtttccacacacacatgcacacacatttgcaatgggaagacttacacattggggacacaaaaattgccaaattcatcaatggcgggagctgtttcatgttcatctctgtgccatgagaggcattcagtgaaagtttgatgcatgcatgcatgaatggatgaatgagaattgtgagcccggaaaagaaagtcggaatattagtgtcagaaaggattgagaccattgagcttccatcagtgcagaaatctctacacagtcctactttctgccatacaagtctccttgtttctagaggtagctctgttggaaatccttctttatactgaattaaaatgcacccctctgtaacttccacttatccgtacttccttttccatcttttctttctataagtagttcttgagcgcctcagtgatgatgttgaagcatggtaccatctttatagggctcacagagtagtgcgggagacaccaatacacaacaaacaaaggtttcagatggggtaagggctggggtggggaaactaaagagtgtgagtgaagaggcacctgttgaaaataaggaggtcaggaaggcaccatttctgctgagccctggagggtgaaaaggagccagaagaggagcatttcaggcagaaggaagagcaaagaccccgaggcaggggcaagctcagctcgctctggaaactgagagtggcgcgtgaaaaggactgtgccagagcgcacaggcccttcaggatcacggtgaggggtgtgcacttcctctgactgtccttggaaaccgcagggatgggccattcagtggggaggattatataatctgattttcattttttaaccagcatgctggctgctcattgacaaatgactggtgtggtgagatggggagcagcaaggagcctgatgctgggaaggcaggtggcagtggaagagatggagcgaggggggcagagtcatgacatcactggatggcgaattggatgtgagggtgaggaacaggaatcagagacggctccggggttcctggctttccctgagtggatggaagagtggtgtcatttgctgaaatagagaagaacaggaagaaaccagtttaaagtgagaatgtggggatatattaggttagaaaatgtcacgtaggctgtgaaaatctggaattcagacaggcgatctgggctggagatgtattttaggagtcagcgccatctattccctctgaagatagaaactccaagaatcctgtccagaagccttcaagtcctgggagaagagttggagaacatgcagaatcacaaggaaactgggagagaagagaggaaggagaaggaaaggggtctggaggccaagagccaggaaggctgaaatgaggggtggagaagaaaatatcattccccaggataagagtagggatgagttaagccagctgcggagaagaaagaaacggtcctccaggccttctagaaactgaggacaggcagagggaggccagaatgctgccctgctgtccagagggtgacatgaaaagggccggacagaggccagtgtgtgcaggcccttcaggaccacagtgaggagtgtggacttcctctgactgtccttggaaaccacagggatgggtcattcagtgggggaactgcataatctgatctggggtcttcagtgtgcacctttaccctcacccacgtcctcccatactgagcatcacagaggtccctgactctgcccctccttctcccatactagaaatccttgccctggaggagctcaaaagccaggccttcccagaccttgctggacatgtttgcgacagaaccagggccctttccttttcccagctgtgcagaattgaatttgcagtcctcatgattccataaaaggagtttccaagacagaccttctgcacttctctttggctaagaggttctttgctataaaaaacacaggataatgggggagtgtaccccgcccccagcccaatgctgaagctagggacaggcgttctcatacagctctcttctttccttcacaatctttcctctctcctcgctctgcccaccacccaccacctcacctgtgttccgcccctacaatggtcagggcagcctgaggctcataagtctggccggctcagttttccatctcctggtggccttctgtggggcctcaggacagatcttcagggccagtggctgttctcagcctcgtggggataaccctgaccacagcaagaaatgccctgctcttggagtcacttttgaggaagacgttttcatctctatgtagtctttcgatgtacagggaaatgccttaaaatcttttgcaggagcccaggccttcgtcgttcactgctctgtgttcagccctgctctttgggaaggtattcaagaacagtctaagatgttgcctgaagaaaaaaaagtggcagtctagtgggacaagggtttaggatttgggatgaaaggaaagtggctgtgattgggtcacgttcaaacatcgagactgttggttcctgcctggcattctccctcccatccctcccctgccgtagcctctctgggtccctgcagaagcttcgctgttcctcgtggttctgcttggtcctgagtgcccccacgagcctctccgtggttccccattgtccacagaggaagctgctctggccggccccgtcctccagcccttgtctccttttcagagccacccatgctctcaccttttccgtgtaataaataataaacacctctagtgctgcatccttcaagctgcctcccgagatcagcctggctagaagtggtctccaccacctctgagctcccagagcacccttttccctcttttctggtacttaatcagagctcttgatggaaatgtctcatccttccagcaggactggaaagtctttgagcaggactgtctcttggtggcatccacactgacctccttccaaatgctagcccaggaatgccgtgtgcctgtcatctctgtcagtgtcagctgaatgaaggccaacggaagacaagacaggcagcttcctctggggtgcccctcctcgcaaaagtgactccagcccctggctcacaagctccggcatccagcaaggacacccccttcagttctccacccaccacaggagcttgtcactctctggggtggtctgccggaagagaaagcagagatggaaggcaaagacagtggctccggagccgccatccgtgccgtgctcagcaggacttagcagcatggccacccaggtcagggaaattctggctcaagtgtgctcagacagttcagtgcagaactcagggccagtgagaggtgctgggccctgagactacctcaggccaaagttctgaaattcaaccctcccaggctcattggaggatggggtccttgtttgggggtttgttttgtgtcattggttttttgtaacgccgatgaacacttccacagacctagtgttctacagaacacagttctggaaatctgtagggcgtcaccatgattcggggaggtaaaactgacatttagtgtttagcgggtgggactgaggatgctgaaagtcccacaacgtgtgagagggttctgcccagtgaaggagcatccttgggccctgtggaatgtttgggaaatacttatccaaggagcacccttcatgggtgatgttcagtgacactgatagtgggggagtcttcagtggctggccaggggccgaggctcagcaaggataacactgccactagaaatatgaccgtatcttggattgtatgactgcatttcctcactaacctggaatattcacattgaagaacttgaagagcaagcaagaattttatttcaaaaatcgtacggaaacctagacattctcttgggctaggtcttcaatcctttctggacccagtgctcttctttttggaatagtctccgcacccactgtatactccatgtccctacagagctccacagcgccccgtggtggccagtgtcaccccctctctaagaacccacacatagcctcaggctggctgactcagcgtcttagtgacttttagatgaaacctgtttatccaatctattgagaaactgcagtgtctgccaccgtccacagaaatccctaggtagagaaatgcattaaaaggagtagaaaagggaccgggaaagaagggcagcagctgcggatgaaatgcggcaactcttgccccagccttcgccatcggcacagaattcagaggccaaagctgtgtgggccaagctcccgcattcccctgattattatttatttgcagagtgcccacggggcaccgggtgccacgcagtgctccttagacaggcaggccccagctttgccaggaggaccttcccccgctccccccgccccccatggctctgcactcagggatttgcattttgttacaacactgtgacaggtttctttccggccttgtgctggagagcttaaaagtcactatgaagcataaaaaataattatatgacttgcataaagccttcatgtgggaaggctagtattagctattacatttaattatttaatgtaggaaattattcacacggtgtaaaaaagcccggtgggaaagtacactgtggtttccgtctctggccctgccacagggaaggaaactggaacacaccggtctggtaggaagaagagggattcccagacctacagggtgcgtcggcgataacccgacccaccaaagcccgaggtgctgccagtgcttccggccctgcgctgggtcagcctgccttaggggcaggaaggaccttctgtgacacaggctgcgggcagtacaggaaggtagcctctcagcaagaaccccaccaacaacagcaatagtagcaactgtagcaatcagtgagcacgttctcggtgccagacagggcaggtgtgaacttatatcattctcacaaagccctataaggggccaggcacagtggctcacacctgtaatcccagcactttaggaggccgaggccaaagggccgtttgagcccaggagttcaagaccaccctgggcaagaccccatctctaaaaaaaaaaaaaaaaaattctatttttaaattagacagatatagtggcacacacctgtagtcccagctccttgggaggctgagacgagaggatctcttgtgcccaggagatggaggctgcaatgaaatattattgcaacactgcactccagcctggatgacagagttaaaccctgtctctaaaaataaaataaaataaaaaccctacaagggcaagtactctggttattcccatgttgcaggtagggaagctgaggcacagagaagttaggtaacctgcctgcacaacccgaggctcattgtgggaagtgaaggcggtctatcattttattcacatcttgttcaagagtgtgggtgcaggttgccggccagatgccctggccatgcctggagctgggcatggctccctcccccacagccacctctgcccagcgccctgcctggcgtacctgtgctctctccaggagcactcgcccactaggttagagagggcacaaggcaggagtgacaggatgggctgtgggagctttctgagagtgctgagcaggaagggacctctctgtttggggtttggaaagctctctccatggccttggtcctgtggattggactggaaggggttctaggcaggcaggcggttttgaaggctgccacagattcaagccctcccatagcaaaggagagattgctcctccttgttccagccacatctgatgctgcttgtttcctgccttcccttcttcagagtgcatggtgctgttcatttgagcttaaagttgcctgtgtgcatggccatgtgtctgcctagccttatccctctccaaggaggcattgattcagcaccctagtcctggaggcacctttgcagaaaacggctcatttattccagcatgagtagtgtgaagcagctattgggatcccccaatctacccaggtacaaactgaggcagaaaaagagcctcctgagacccccaaatggagcttaacccataaccccaaattttcatctgctctcagtggggaagatggcaggcttcaggagggctgattcatattcgtatgcccaagccttgcatagttacaggcctctagtaagtgcttattatgtgttgatgagataaataaatgaatgagtaaataaatggacgaaggccttcaaaaatgtcctggggaggataagccttaattccaaagaaaaatgggagcagaaagtgtccagttaaaagtgtgcattctaaggagtgtgtgttcctcctgcaactaggagagcagcccccctcgcctccacccgcctggggtcctctcacgaggcaagcacccagccccctgcccactcctgccctttgtccaagcagtcctcaagctagctgtgcagcgtgtgtcttggggtgcttctgaattaacacatcacaggatgggagctgacagaggagggcagaaatccccacctcctcccaggctgctggcagctgtgtgctccagttatgccttctccattaggcgccactaatttccatgattactgttatgtctaaatggcatcctggtgtaatacaatttatattatctctgcttggtgtcggttaccattgttttcatgatattcagtgggatcaactctgcatagacacacagacacgcactgagacttcaccaccaccgccgccagctgccagtgggacccagctcctctccccggttcattcggctctcatcatttctgggacccagaaaagatcagtgtttccaggagctgggcacagctccctcccccacagccacctctgcccagcgccctgcctggcgcacctgtgctctctccagtgcttgctcactcaagcaggacctctgctctcttgcagggacccccttccctaggtccggtgaagccatctgttgcccctccctccctcagcgccgccccaccgtggcagcctccagctgcttcctgactgatgttcctacccctgtctccaagggcccttcagaggacccgttgtccttttccactctctgtctcaatctcagcagccccacttctaatccagccccgaagtcctgcagcccctccagccagcacgctccgtgacccatgtgtcctaggaggggaaaccaggtgttcagagtcagcttccccacagggccggggaactcaggagctggctgcctcccctgtgtttcttggggcagataaggaaggcaggcaggaaggaacagagaagagaaagaaatgagtcatggcagtgacagcacctctgccctccaaatgcctaagactgacagcaccaccccaggcaaggagtgaaaggtgtgcggacttcgtcgtggacgccttcttgccaccagcctgactgaaagctggtgcggcctctgctctgggcagagaaggagcgaaggactcggaattgaagggcaaaggcatgcacccgtcaccccttccacagcagtcccctcgcagctctcctgtaacagacagaaaatgggcccctgccaccacccctctcgataaaagaagagtggcttctaagaacctagcagttaactgtctacatgaactcgagtcttacaaaatgcagccgtgacaacctgcaccctgtcgccaatcccaaacagcgtcagccagatttcattcaggagagtttgaatactagtgacctggaggatgggcagaaaagacctgagagacagactaaaggagaactcaagattccagaaccttcagcttcctccttcctcctttcacacacctaggctttgtttccctgctgttcagtcccacacccaaaatagaacctgtgactcctacgtcactaggcagagcaacgctggtaaataatgacagtggctgaccgggcgcagtggctcacacctgtaatcctaacactttgcagggcggagacaggaggatcacttgagaccaggagttccagaccagcctgggcaacatagcaagacctcatctctacaaaaaaaaaattaaacaattagaggggcgtagtacttgggaggctgaggagcttgagaccacagtgagctatgatcacaccactgcactccagctggggcaacagagagagaccctgtctttaaagtgaacattttttttaaaggtagaaattcagagattttggtcatcatcctctgtctggaacattcacacatccagaacacctattcctgaggaggccggatagagtcggtataaagaataggcatctcttggatttttttaaaatacttccctaggtattggtcctcacattaaccctatgcaagacataggactggtgcttgtatggataataatcagattatgattacctcccctcagaaagctcaatctccagccgactagaataaagacaacggtgatgacgagattcttgaaattgcacttgaaggtgtaatgaggtggaagcctctggactctggttgctttttgttttaagcgattgcacacagagggcttgggaagtgttcctccagttggcaggaggcccatgatttcttacataggtagtcatcccatcttcttttcccactgggagatgggcatgtcttgtctccaaaaagcagaggacccgggaggtaggcattttacagccaggaagtaccactggaccatggccccacagttaagacacagtatctgggaccagaagaaagcaataaaagatcaggacacatgtgccttgtggatgggagcagaagaaatggcaagttctgagtgctttggatgcatggtctcctttcaccctcacctcaactctgtgctttatcccatgttctaggtgtggaaacagtggtatagggaagttaagttatttgttcaaggctacccagctagtcagtggcagaggtagtgtctgaatccagatctgcctccagagatcaagcttttcaccagtatgctgcctctttcaacttggtatatctccaacgatggagccaaatcagggcatggacaaccaaaatggaagaaaatccacaattctcgtgcatgtgaaatgcatcctatgatgcttttgcagcagttgttccttcccagcaatgattttctgatgtcaataacaatttggtgaccattttctcagcccacccctatcagtgagtggaggtgctctggcactcaggcctaggtactgggacctgccctgagatggccagaggagaggcccatcttatgaacacatctccagagtggggagttggaagggggaaatccactcagcctgtgggattgggggatggcgagggcaaggcttccagctgcaaaaacgctttcccttctgggcagcccgccctgcgtggctctgaggagctggacagtagaggtttggtttgccacttcaaggagagccaggaaaaccctttctccaaccccttacttctcaaccatttgggacacagtcaccagagaaataaggggcaacaggtataaccagactccaggtcagactgatttcgtaagacgtgtatgatttttttcccaccctcccttctccattacacccttaaaacccctattactaatggtttccagcaaccgagggggcgggcaaaaacagagagaagagagatgagacagcatcaagcccttccactcccgagagtgttgggaaaagtattcctcctaggacccaaccacctggggacttggggaccagcaggaaggacctgggccttgtttctgggcagggtgtggtccaagtgggaggaaggggctgttgaaatagtgggaggaggggacaaaggggcaatggggatggaggcctgaaagctggccctgaaattgtcttcatggtccagctggaggactgaggggctctgggcaccaaaggcaggacggtgggaggatgggtcagggtgaagagctgcctcttaaagggaccctgtttgtgcccagacatgtaccctcacccactgcattccagctctgtggaaatcccccagggctggggcacaggagctctcagcgacaaggaacctggttggtttctgcagctcccaggtagtgtgccaccaaacagatgtcagtctaaagcctggagtagcacagcctgctgaggacaagtgtgaggcacaaggccttaactccaacagagcccagccagtgccaatccagtgagagccagcgtggagccatgggaggagggggctcccatggtcaagaaagagggggctgtgccttctgtctgcacatatacaaagaaatctgggagaaagggtgaccaggggtgcacagccaggcggttaacagggttcctttaggtctcagcccttcaccgtggtgtgcccgctgattaactgtgtgtgtttctctggttttcaacaccaaacctttgctctgttctgtccatttcttccttttcctttctccatcttagaggtgttgcagaccaaggccaacttacccattttgtttcaggtctctctggtggatgaagattccaactcatcctcctttcttgagcactgacactcacaccttcctctctctcctcctcctcccacaccgaaataatgttttcttgcacgctttctaggctgatgcagagaattcctggattctgctcttgttcttgtttgtctcccttctcttccttgacttccctgcccttcccttctgaaatagctctaccccacaaagacagtattcatatcgagagggtcacccagtgttttccaaaatctaattttaagtcttatgcatagctgtagttcatctggggtcttcacttcttatttccctctccccaaaatcactattctccttttgccctgtgaatgatatctgagaacctgagagcgaattggttatttcctgctcatagcatgtgacttaaatgggagaaagaagtctctctgcctcataggctccactatattcagaaaaataccctgggaagccaacaagaaagccctgatttgaagctgaccctcacctcacccacgccctggtcagctaatctctgcttcacccatcctggctgtccagtctccggggtggcgtttctgttttctttcggcagaaatgcctgggaaccgaaaggcccctttccctgtgacctgacctcccacgctaagaataacagccccaggacagcatgtctttcggtccctctggaaagagggcatggctgggaagtgggaagttaagggagctggatagagctgggaggaaagggaagaacacagattcttggctttgtgagtaaaaaatgaagaggaaaagttggcagccttcaagtgagctggggagagatctggggaacctctcggaggacgcttcatgctttcataccccactccgacctcagaattccacctcctggaagcccagagggcaggcaaatactggtcccactgaaaaaatgtggccagccctgtcttgtccccttcgcagaccatttctaaactaaaggcgtgaatgttttttcttaaagaagacaaatctctgtagtactcggtccttccccctccacccatggggaatatgaccgcctgtagctgggggtgtatgggggactatgaccgcctgtagctgggggtgtatggggaatatgatcgcctgtagctgggggtgtatgcacccattcagtcacagaacatcgctgtgcaggcccctacacctcctacacccaagaaatccatctgctaaagagtccactcatccaggacacctggggtcctatagggcctctgggacagcccattccttggttgacctgttgtccaagtacatgaaaaaagtcttttaagaacattcgtcccttctcttctccaaacatggtgaaaaataaacaaaatccatagctacagaatcaagtggtaaagtcaggatactggtcttccccttctgtgccagaatctctccttcagggcaccactgtcttcatccccttctaggcagccagcctcccccaacctaccagcctatccctagcaaacccatcctcaggaaacgctttgatcaccgcgtgccctctgcgcggcgtctgcattcagcaggaccctacctccaaatgaccatgaaagaacctggggaggggcttagaaagcctcagaaagccctgtcaagagccacataacacactcccggagtaggagcccagccttgcctctgtctcctttcccttaggaaagtctttgccagggttggaactgcccctggaaacactggggcacccagtgcaggaactagggtaccctgatttgatctgcaagagttgcacttattatggatcttgttttaacaatttggtccttcttttatttttgagctttatatgagtcaccagtgagcccagataacctgccaccctgcggcccacattgatggctgtggttttcaaagcctttttcattcccagcttcacccataggaccgagcccgctaccctctgaggggtcacacacctgtgttccctccctccagacaggcccttctgctggaagaggactgggggtgcaggagatgctcagcgtggactgagaagagagcatagtagccacatcctgccgcctggcgatttgcaccacccacgccccccacacccactcctgcccctggtgggacgtggacagggcctctgtggagaaggggtagggtgggtggatctgtaggatgggggccacgtgaccgagggaatgcgggcagtagggttagagtgtcgcctccctgctgctccttccttgctggtgctcctgggctcctggccatggtgagggcgtccggaactccagaggcaacacggaggtgcctggacgatgattctgatggtggtgttgctctgttcttgtctgtctaatattcctttttaatccccatcctgcctgccctcccttatgtagggttactttagtgatccctggaatgtttttgacttcctcatcgtaattggcagcataattgacgtcattctcagtgagactaatgtgagtattactctgccctccccaggaaacctcctcattcctcctcctctgcctcgtctatttctctctctctcactctctctgtttaccttcttttatgttttttttaatttcctgtttttacccgcctccagtcatgccttttattgaacctgccgtcgtcctgtgggggaaaaaaagtgggagcttctcctcctttttttccatttacctcagctctgcccggcgctgccgggctggggcgtggagctgagcagagggagtggcggtgcaggggacacaccgcccggctccccggggcggccacagccccacgccacctttgaactaacccagcttttgtcaggcctctgcaccctgcgaaaaccaggttatccaggtttgagctgccagaactgtagagtggtaagagagtgtttaatatgcccacgtaacctctttcttttctcattttttttctcttctctccctttttccataccttttttttttttttttcatttttcctcttcccttttgttttgttttgtcctttcttgttggttcttcttctctctctccccggctgctctgccccatgcagcactatttctgtgatgcatggaatacatttgacgccttgattgttgtgggtagcattgttgatatagcaatcaccgaggtaaacgtaagtacatggcgtctgtccctaaccgtccgtgcctgctctaacactcatttgccttttcccggtttgtttccttcattttattttctctccccaccttcttattttttttttttaatttgtttgtttgaattggtttgaaggtttttttttccttgttgctttattttgaaatctttttttttttttaactttggaacgcattaggccttccccttttctgttaagttctgattgctgcatcttttctctctcccatacaatcagcctggcatgactcacactgtatcggaggaagcagctctgggagctgtggagtgagaacatgaggggatgtttgccactctgggcagctgctggggcagggacccaaacctcttctgacctccaccttctcctccagccactgccttccctactctctcctttgcatccccacagcatctcagaagggagctctctcaaagtggaacaccctgagataaggctaagactcagcctacaccgtcagccatagcccaccctcgcccaaggaccacccatgatctcgggttgaatgggctctgttttcatttaacatcagcagcccatgcaggcatccaggtccctgcaggctcatttggaagaggaacgagaaggggaggatcagtcatgtctgaactcttctctagaggtggtgggtgacgtactgagagctgctctgggtggacctttcctcctagttgctgtggaagcaggccccatgtgagcgcctcactcccacatgcacctgccacccctgccctcgacccctgacctctcacacccctgcctctggctcccgagcctcagacagcaccccagcctctgcaaggcctcctgccacctccttctcccaagaggtgcctcctcctatacagttcctaccagttcctgcacatgtcttttctgttacctggcatgtttaaatctctctttatctataggcaagccttcttgcggtctttaacatgtgttgtttaattttttcgttattatttttccttaattaagagacttggtaatgtttgcatagacttttgatgcactgaactattgaataacagcacagagcagatgctttagagttttgatctaagatgtttggaactacccagcccaccacccccagctcctccatgcacccttactcccctctccactccatcttttgctctcagtcagttacactgccgtgttatcttgcctgccagattcttccagattagagacccctgtctgctcctcttttagcagatggactatggaaagcggttgtcacacttgtcatatgtcccccgctgtagtctggtgccccaaccctgctcaccctatagctccagagaccatggcccctctgtctccctgtgtctctgagaactgtctttgtccggtgtgtgtgtatgtgtatgtgtgtatatgtgagtgcatgtctgtgtgtgtgtgagcatgtgtgcatgtgtgtatgtgtgtgagtgtatgtgtgtatgtgcactctctcttaacttctcccagtaaatcctcagatcatttttttaaaattagtcttcctactcgtgctctgagactcctctcccctttctgaatggaccccagttttgcagctggatgagccccaagttgctgttcccactcatgcacataaaggccagagcttctgtgcccagagcttgtgccatgcagtgctcagccgtgggagacactgcagggagagaaacaggaaagacagggcagcagtgggctctgccctcaggaggtttcctttccagacagcagtgcagagccacattaaaatctatgcagaggggccgagagccccacagcaggaaaacgcagaaaggtgaccgcaagctgcccccctgtacagtggcccactgcagctctgggggtcctatgggttcttcctacagtcaccaaggccccatcgctcagtctgcaattttctcccaaactattcatgtctttaaagaaaaagaaaaaacaacaaaaaagcattttctaggatataaaatttatacagaaaagggggctctgttggggatagggagggggcctgaacccgtccagcagctcctgacattggaatagtggttttctatttacaagtcactttgcatttatctgacaactctaaactaccctttaaatttgacaggtaagaattctcatccccaatttgctgatgctaaaggtgatgatggagagattaagtacctttccagtgcctcagagtcagcctagccctcctggggccagctcacttcctgctaggccagaattcctggtttctgtactccacagtgccttttggtaaagagaaacctcacctgtccctcctggtgtactgccactagccacgacttactcagaacttacattctgtaattgatatcttaaataagcacagggttttttccactttctaaataagcaataatcagccaccctgagagttccgctgcccctgtgtcctcccatactgagatgctccgggctgaggcatttgtggctttgaagtcccactgaaggattgtcgggggacagggtggcaactgtgcatgtgactgacagcaagaggaggtgtcctgagacccaacacctatttcagagccactttctccctctcccacacaactgatggcttccgaaccaaaagaacaaacataacatcccccaaggcaggaaggcggtttgggagaggagaaagctggacttgaagtcagaaaactggcagattgttgagtcttgctgctgcttcctgtcaaagcgttaccaacatgcccagagactctgttttttcatctgtcagaggaatgtggtatttacagcagtgtgttttgaagctcaaataagagcatctatttaaaaactctatataaactggtaaagcactgtggaatgggaggaactgtggcacccaggcaaatgacattccttccaaagttactgctggtgtcactcggagggcctagtctccaaccaagaccttttggttagtctaattataacttacaacccacagtcgaaagccctgtttcccagatatgcttagacccatagagatggccaacaggtacaaccagatcaaagccagcacacacacacttaccacggcccataactctgggccttgaggggcctgctctgaaagcacagtccggcttgaccctgggctcacatcgcagccagtgtgagggacagcagcttaattgagcaaggtcgctccctcccactagattctgcctccagggcattagcagcgtatgggcggccccagcattttcttccaatcccatgggatccttcagaaaatcctgcatccctgggccctgctccgggccttcccaggtatttttagtcatcctctcatcacaagacatatattcccagggatatggtctatttggaaagagtctacattgttagcctcagtgtgatccatgagggcgtttcacctgtaacctgccatctttaactcctaaacccctccccagatgccttatccaccctaactttcctccaaatattccccacatttaaactcgtctcaccttttctcttttccgggctatggggccctccctctcaggaaccatcattcattcaatccacagcatttagagtctcacttcctatacgtcaggcaccgtttgaggcacctgggatccatcagctggcaaaccaaaagcccctgccttcacagatttgcattgtagaagggaataatcagacaattcacaatgcaatgaggacagaaaataaggaactcatacggtgtgttagaagatgatagacgttttaggaaaaaaagtagtgccagataagggggctccaaggtgctggggagcagtgatggcaggcattggtttaaataagatgggcttccttaaggaggtgacagttgaacaaagcaaaggcatgaaggaattgaggattctccatgtggagatcgggagaagaggtagcagggcaggaggagccaacctggctggtgcggactgagctgggaaaggagaggtgagggtagcagaggggtaactaacaggttccacttttgggcttttactctgagcaagaaggggacatactggtggctttgagcagaggtgtcacgtgacccgactggtttttaaagagaccactctggctggctgtaggagtcaagggtggaatctggaagatcatttagaaggcaaatgcagtcatccaggtggaagatgcatagcgtggagcaaagttgtggcagtagaagcggtggaaaatggccagcccgtcactctgttttgcaagcaaaattaacagtgtttcctgacagactgcatgggggcaggaggagaattgcccaggaggactgggaggtttggcctaaatcagaggaggatggagcaggtaggcaaggaggcgggctggaggcggggcctgtgtgagttaggaaatgccagagcacagttttgacgtatctgttagcccttggaggggagatgtcaggtggacacacaggtcagaggcctggggatggagtcattcacaacaagatggtacccaaagccccggcactagagaagaagaagcgacaagaggcagaggagcggagaggcctgggccagggcctctggcgcgaggagatcgggacccgcaaacttctgttcatctgggagatgccgctgaacaactgccaggtgtcacaagaggaccgtcttcaggccccctcgtgcggtcatgctgaattcagcctcagtatctgagccatgggccccggcccttctcctgccaatgcatcacctgggtctaaatccgagcttttcttcctctgtgagccggggaggtaagagtgcgatgtcctgctgctctagggaagcctcttgctcttcctcagtgcttgggtctgaaatcatattttcctgtgattgttcgtgaaagttactacagcaccagaaactgctccctaaacatcccaaactggaattaatttgactgcttgggccaacagcctttcccgacacacttctttttcattttgtattttaaaatataccgaacaatagaaagtgctgggcagcctgaattcctgcattatggacatagagaaacattcccaagttgtcaatgaagaagccttgattatgcttccagctctggtgacttagagcaatgaactccattctctgggcctcaatttccttgaatgcaaaagtgaggagtgagaggtttaggatggtctcttgcaactctagcctgcagtgattctgacttgggcattttctgacagctggaggtggatgcttcattgcccccattgccttgctgggttctgaggtggtgtttcctgtcatcaggcgcccatggtgtcatggggatgcttcctccagggaatcatctgcatagagataatccctgaagccacagtgctgaagggcagcaagggaggacaggctcccttggctttggtggagctcacctggagattctccagagaaaaggagcaggagaaagaccttcggggagcagagcaggcacagggaggggaaagaacactggccctggagcttctgggcacagctcgcaggaggaattgctggaggctttgcacgatgcacaggagtgtccagagcagggaaataaagctaagcgaaggtggcactggctgtgaacatgagaagaggaccgacatgaggatgacctgatgagcacggatcaggcatcatgctgaggacaccatacacatgatcggatgaaacccgtgtgcttactctccacatgaggaaatcaaggctcagacaggacgaacatctgcccaaggccacacggtgaatgggaggcaaatcttggattcaaactcatttctgtccaagaattggctcttgcatttcacagtgcccgctggctaaatccctgggccaggctggcctgggcatcactgaagggcagggcccagtggctcctgcactcctcattcagtgcctcctggcaacgggacttggggcggagctgcctgacttgacttctctgtgtcggttgatgctgcggatgctggatccacaaagcctgggatccccctgggatgctcagacagaatgcaggctacacacccggatccgtgtctctggttacagggaacagaaggcaaacgccaggaggcgcagagcagcaccactccctttgcccagttggcatctgcatctgcagctgaagaaagagactgggaggaggggggccagaaggagcaagcagcgacaaggcagggcagagagtgtccagggatcagcatgtcgggatactggtcccaagtcttccccaccttcaggccctgaaagcctttctaccttagtatctttccaccataggcccccaggcacaacttcctataactgtcactcactactctccacaacaatcacaagcaagccgggctcctctctggctctgggtcctggaaggatggaggaaaagcagtcagtcctgagtcatagagagagctacttgctgcacgtccaccccctcaggggtgagtcagctcagcctgcacgactccagccctctctctcggcctgcaacccacagtgcttgcgttggacagtgggcctggctgtctctgtctgcctttgtggctgtaaccacgcctcctgccccctgccatggcagagaaggggccagaatgggcacaagaaaggcaaggctgagtgccccccactgcccatagttgtgatgaggaaggagggtagagagatgtggtcagaaagcagatttgtccaaggacattagggtgtacacaccttagagaccacctagcccaaacccttatttgtttattcctcaaaggtaccttgagcacccgctgtgtgatgttgcttgaggatatacaaattttctagatgaggacacaaaaggccagaggcaggaaacagcttgctcattttcacaggtttttcacagcaagctgaccggaactcccggtcagtagggggctccagtgggtgctgttgccaaccattgtctagatgacattggtgggtgtggcctgagctggttctaggacacatagattaaatcaagttccgtggtctcaggacagctgggtggggcagaggttatccttgacatctccctccagccccccttctcattgctggagcctcctgttgccctcggagtcccttccagcttcttcccactttcggcaacagcccccacccccaacaaacctaatgctaccaagatgccttgtttcaaaatgaagtgattccagcacagtcattcatgctgggtggtagcaactcagtgagctgcccttctaatagatcattgtaccttgaagagaaggcgatgctcaacctgcaggtggaatgtttattgtatctcaggtgagcctttagcaacgtgacccctgagtggggagattacttttgtgaggtccctccccatccccccacaaaggctgttttctactctgcttaagagtatggctggcccttgagagagttagcagagccaccctcattcctagaagtgggatgaagcatctgaccatcagcagtcccctgggaggaggccgaatgccccggatctcaaggtctagggcgaggcttgttgtgtgaactggtgtgatgtggggttgagggggtgcagacagagagacgggcctgagaagtggcctggtgcagcaagtcttctcaaaagcttttgccttgagaagtaccctgcaggtttgacccgaaaggtcatgggaacctgtttttttataggcatccaatttgggttgttaattcagctgtgtgagattgccgaggtcctgatgcggctctgacccatccaggctccccttgccctctgccttctgccccaaactgtgtcactttttgtttccctcaaatgctctttcctttcctgttctcatcttatcaacccacatacggccctctgttcccttcccctccgtgtaagggtgggaggaagttgcctagcacaccttttgttgtggccagacaactgattgtacctggccagtgtctgacacttcacttcctacaggctcagcaacctgctgctggggttctttccagaaagctcgtaaagcaaaggcacctagaagatgccatgagctggtagtgaggagacacaggaaggctcaaagatacgtagggtgcctcgagaagcatggccacttctgttgatgcccacttactctcatatttggtgctcccacccagggaatcatctgtttgtttcctttttgagtctctgccccgccctgcctcacccactctgtttctctgcctttcttctctatcttgtgacctctccctctggcataaggaattctttgatgtagttagtactactggcaccttgatttcattcgtttattcttcatgggctttttgttggtggaggttggttggtttgtttgaatgactagacgctgggctgtccttcccaggggaagatgaaactcccaggcaattctgtgatcagtcttgtttagtgtgtgtttctggcaggtaataacaccttgggagccatcaggctgcacatgataacagtgagaccctgaggcttcagccacttccagccagcaaactggtcactgcagccagtagcacagggcatagctctcagccatccacagcttcacacacaaagcaggaagagcaaaagagggccaggagctgcagccccacgctgggagcccggctgccagtccccttggggccaaagacccctcgaggggagttctgaaggggcatttcaactcagtgtctgtaactccaaacacacaagaaaggcaagaagggccctctccttctagctggaattccactttggagaaacacaaaagcccgtgggtttccgacctgggggtggtggcccgggacagagtcctttccatggtccctgtccatctttagctttatcctggtgcgttccctgccctttgtttgtcttcttctgctcagtgctcctcctccatcacttctgtctctccactcacaccaaaccaaaatgggaattctgcttagaattgctttcaactacgcatacctcattcatttgctcttctgtctgaaagccatggcctctaccctcagcttctgtctatcccagctaacgtttgtttaaccttcgcctctcttagcaagtacctgttcattcagctttagaaggcttgcagcttaaaacatgcttgcctttggcctccttaaaatgtcttgccccgctgccatacccagtggctccaagattcagcacctcccgactcctcctgagatgtgcatttctcctggtgggaaggggagataaaaggatcgtgaggatccccccacacacacccttaacctacacctgctggctcctggccatgaagttggcgtcagatgtctccagcagcccctgacccctgccattcccagctctctctctgcaccagcctgaccacctcctcccaacctagatcacctccgaggtctctccctcaaagccccaccccttggtcttcctccacaccatgacaccccccaacagaaccagctgttgtgtcttgcaggtcaaattgagattggaggtagtacaagcggagaagcggagcatggggagggggtactggctggatggagaccttcaggtggcttggaatgaaatttatatcagatccacctccctaagttctggacaagacattttaaaaaatatagcaagggttctgtagcaggaccactatttagagactcacactcccatgacattacttttgacatctgtttcagaggtgcgtggaatcttagtgacactgaggtcatagcattgtctcaatggcagccattggaattgggcagccgttttctgtagggctaagaccagccttccctggaggagatcagaggtaatctgcacctttcaaaatcagcctgccaaggagaatgcagccatggcttatgcccccttcacaatgctctctggccacctgaccgcaggagagtattgtggaggacaactgggttgggtattccagcctagagatctactgctcagcccctgaatttctataattcttacccttggctgtgctttaaaaaaataataatttttaaaaaactttttttcgtatggtgaagagctatttttcaactaccttttaagtctccagagagaccatgtaatgtggcaaccaggaaacacatcctgcggcctcccacaccatcctggtgggaaaatcctccacctgggaggatcctgtctctgctggcctctggcattccctgagtatcgcccctcagcatcctaaatgtggcctagacctggcactccaatgaaaataagtgcatagtgagtgccttccagaaacaaagacttcatccactgaggtgttacttctcatttgaccctgaacttaattcagaaagacagctttccagagacctccctctcattagctgccctgcaccactcccctcctcactgccagttctgccaaaacaaggcaatctgcataagcatattgaaggaaggaaatcgtctttcctttctgtttgccctgagcctgttatctggaaccactaaccagagctcgctgtctctgaaaatgcccgacctctgcctcagatacggaataataacctcatttcatttatatcaattacgtgaacaaattaagttaattgccccaatatcatgaaatcattgaaaattaccagatcattagaaaacaaggatgaaagaattggctgctcagaaatttctccacgcctaccattagtggagacagtgccatatgaaaaatcagccagaatgttcaggttatgtaagcagctctgttggctgccctaaaaggggaatgcagtctccaggcttgggggtgtatgtcttcagggaatcctacggcccctttcttccccaagaaagaccacagatgggagaaactacaaactaactcagggcaccggcagcaaatctgggaaggggtcagagattaatggcccaagtattgatggctaccaacaaattctgaatttacatccaaaggtagaactgatgctttgtagtttctcaaggggctgtacttggtatttaaagagagtggcaaaccacagaaactaaaagtgctgatcctgggataccacagatgtccaactccagcaagtccaatctctccttccatctcagcaggggattcatttgccaaggcgaaagggtaccaaagactctaaggatgacgtgggatcatgtaggaaacgcccagggcatcagtagacctcgggggccttgggggcaggggctgtggcttaggctgcttcctattgttaccatgtagaaatcactcagggattgctctctgatttcatcgcgagtggttattcatttatgagaccacggaccttgtaaacagctcctcatgtggaaacaggtgtgagcggtggtagaggcaacagtgtcctagctactcaaaaatgccctgtgaacagcatggcttaaggctcaagaaaaacttaatctttgagtctctagattcttccaaagttggtctctttggagagttgtcattaccggggcaggagaatgccacacagacatctcagagcgtcctcattcttcctctttctactgtcctcatagctgctcctgactttctcttgtctgccattatagagacatgccataggaaatgttaaatcaatacatgttactaaaatacaaaatactatcaagattatctgaacagatccaaagtcaagtcttgaagtgaaatatgacttaaataaatgaggtcttaaatgggagctataaaatgcaacaagagaaaagacagttaagacaaatgtttaaaaatcccaaatgaaggattctgaatgtttaagaagtaaaacaggttttttttggttttgttttgttttgtttttgtttttttgatgcctagaggttggttcaattaggccaggcaagccaagtacctgggtgcgttgtcagaattatctccattttggtcctgttcaggctgggattgacccagaagaccttcaagcatttgcccagggttcttagaagtgatgagcagctgtgatggttttcaggatggatccaagaggccagcaatggctcaagcttcctgggagctctgcccaacactcaggagttaacatggtgtaggttacctccctctggacctccctccctgccccactgaagcctgagaaacacagaactccttgtccatgagcaagggagctcaagcactgggccaggagcggggcagaaaggtgccagtggatagctagacctgaccatcctgggcaactatcacacaccagagcaaaaggggtttaggtgctttgccaagaaatttcttctgtgcatgcctgtatgagagagagagagagaaagagagagagagagagagagagtgtgtgtgtgcgcgtgtgtgtgtctgcctatgtttgtctctgtgttcaatctcagtctgctagccaaatcctagggaccccacaccctgcaatcacaaggactgacctggcaggtggaatcttcatgaagcagaagctgagatctagagatccagatttagagtgttctgtaaagcctagagaagtgtccctttctttctcctccctcacctcaccctatatctccaccatcccctaaaagggcatcctaccaactagctatgaaaaaaaaaagaatttgctgagaaatctgttacccaagaaatattttcaggctgcaagcaaatgtctagttgtgcacatttccatccttcaaaaattccataacacattttccttgtttgtaccttaaaaacagaaatacaagagcaaccatctgaaagtggagagtaaaagccaagtcctgactttctagaaagagttagcagctcagatggtcaagatcagtcggggctgagccctctgtgctggagcccaaaacgtaagggcaccttcccagatccaggctccaggaactcggggagagggctggccctgggatactcaccagaggccagtttcctcagctcctacccccaaatgagttcagcagtcagacccgtgagaacagcttcctggggtgttagtgtcctaaattgtgtgcagggctttcaagtttagaaaacaattcaacagtcattatttcatgccaacggtcagggctcgccgcacctatagaccaacagctaagcaaggccatctcctgcctgagcctgagctttcagaacaagccccattatggagtgggttgaggccacctctggaggccctcctcagtgttgacttgaagtcggtctcccctaaacctgagaggccactgcccttgctttgtttaaatatatgtgggcaaggataggctctggggtcagcaaggcctctgtccttcagctggccctgcctggggtaagctaaagtgcacaaagcctaagtcctcataggttaacaatggctaataaaaaacaaattaaaacaggcttggcacagtggcttacaccggtaatcccagtactttgggaggccaaggcaggaggatcgcttgaggccagcccacgagtttgagaccagcctgggcagtatagtgagaccctgtctctaaaaaaattaaaataaaaaatttaaattagccgggcatggtggcacgttcctatagtcctaactactagggaggctgatgtgggaggatcatttgagcccaggagttcaaggctgcagtgagctgtgattatgccactgcactccagcctgggcaacagagctgagaccctgtctctaaaaccaaaccaaacaaaaaaattataaacctccatccacaaaatcccaaagacctcatctgcttatctaataatattatgaatgtgagttatttaaagggcataggtaggagaatgcctgtgggtccttgattgacatgagacccagcaacacagaccccacactcatggggacgccccaggacctgccaggcctacgctttcacgtttctttcacttgtttccttttgccctcttctgccactgtgttgctcccgtgtcagccaagacctagaataccgggcatcttcatgggagactcattacagcttatctctatctgcctttctttaaagccagctgaacatacccaatgctctccctctatggtaagaccaaccctcccgaccatgctcccggcttccgtgtccccctctaacacccccactctccccaccccgaactccagagtccctgggagccctgcctggctctcactgcatgtggccactgtgtctgccgtgtgccttgcctgcctgttcccttctcgtgtgagctgtgaagatgctgtttgtgcagtggtggtgttttacccctgagctttccttggggtggtaattcactgtgatcttgactatctaacaagccactgggagagaatgggacccgaggtccatttcctgttaaacaccctgaggactccaccggccaaagcctctaaccttaatctgataggagaaatttgcagagggtacctatgagagccatggtagggctccagggtaaggagggaagacaggtgctctaggcaggagatggaagggtggacgatgattcctgttaatcagtgtctgtggctcctagcttccctgtgcttcaagtgaaaggccaccataaaaggtttcagctgggatttgttactgagcgcgtgattgaatttccagtcactccaaccttgctatcccttgcatttttctaaattcctgaagtccgttaaaattaggctgcagccactgttccgcagcaagctggaagcagaaaaacaagctccgttgattggaccactcctgttgtaggagtctctgattcgcgttggttgaagtgataaaagagacgccattcagtgtgaccttgaagcctccttggcccagccgcctccaaaaggctgccgttatgcatttctaaccgggccaagtatgagtttttagaaggaccagtggggttgattgaccaagccaccaagtctgcaggccgaggcaagcttgggtgggttgatgtgttccccagtgcagcctggcgctgcctggccacaaggctgccacaggaaaggctgagcccgggtgctctaccccgcttcctggggactctgcttctgggatcagccatctggatctgcctcctttttgcattgttatttggtttattagagcaaattggtgcatccgaatggcagtgagtttattctccttctcgagcagcattaggaaactgcagccacaggggagggctctgaacagtggaatggaattcacgctgcaagcttggtgtttggcgttttttgggtttttttgtttgtttattttgtttttttaactgagcagatccagatgcccctgtggcaccaacttctcaaactcttgacacttgcagctaaagttctccacttaagcttgttcttttttttctcctttctcgaacacggtggaactgacagctgagttataaaatcctaagcctcctctgcatactcctctggggaaacacaacctccttttaaggagtgaaaatagaagttcaagcagatacacaggtgatagaaatacagagattaaggtcatcaaaggcttcagaacacacaggcagggaagagcccagggcaggacagggctgctgcctgcagctcttgacccagcccctcaggtacccgtgcagcaggtcccgagtcccacctgtctgtcccctgccttgaggggaacgggagccttaggaggaactgaggcagctctaattttgaaatataagaaatatttttgctcttctcctgtttggaagatctggaaagcaggagaggtctctggcttgcttctgggcagagtggtggctgccttcgggtctccctgcttccctcataatctcctgtcctgcatagtgaggggagcggcctctgacgcctcatcagggtgggccagagcaggcagcgcagttagaagggctttagcgctggatattgccagtgagagtctgacctagaaataattaaagataaaaggcaaggtaaagcaaggagtggggagggcccaggtggccctagtaacaacctgagccctcccacctcgcgggaggtgtggacgggaccagtaacaggaagccccgagggtccattctctcccggtgcccgcaggtctgggtgagctgcactagctccggatttggcagtggcttcctcctgggttcctgctcaccaggccgatgtgggcaggaggagggccaagtggggagtcagctcatgttctcaggtttggaggcagaggaccgcagggcagcccgtcctgccccctgagccctggccaggcatgtgcccaagcccccaggctcccccaggtccaacagcagcagcccaagcacctccagtcaccttggcctgcactccacccttcctccccttcaccttccctctccccttccccagggcccctgagggagaccatctgcagaagcgtcacttgcaagggaggcctcccctcccttacgctgcccctctcccttccagggtcttgtacagcctgaagggttggagcctcctagaggccccagggcagaggggagtaggagggcaacagcttcggagcaagggctgcaaaccagaccctctccagcactgagtagcacccgtaatccctccctttgggacaggggctgtggaaagtagaaggaggtgatacaaggaaagtgctggagtcccaagcagctggggcatgaggtccttcagggggcagcccaccaggacccccaaatccacgcatacctacagctgggagagaggccagccaccaacccacgtcctcggagagtgctgggctccacttaggacacaggactgtctgcccagacaaacgggagacaggctaggactgcttcctcagcagtgcagaggaggggttcccagggcagctggctctgggcctagaagattccaaagcctatggtagttcctgatggagtcgtctgtcctccatccagggcattaagaactaggaatgaaggggaatcggggagaataaaaacacaggaccacagcccagcggcctgggcacagtctagctctgcagagaccatggggctgggctgtccactcattaaagtgggcggccgccctcccatcggagggggaagtctagtgcagcaaaccctggcctgccttccgccactgccactgaggtctgtatttctcggaggggccctcctgttctcacccccctcttgctgtgctaactgcacctcctgttgccgacgggttccagaacgcagaggaaaactcccgcatctccatcaccttcttccgcctgttccgggtcatgcgtctggtgaagctgctgagccgtggggagggcatccggacgctgctgtggaccttcatcaagtccttccaggtagccgcccctcatgtcctgcggcccggggatcgcagggctgccgcgtggcccagaacacagctgacacaaggaggagccctccactctggggccctgctccttcctctgtgtggcagaactcggccgctctgcctggctccctgtttccgcaccgagaggcctagacgaagcatgtggtttccaaggcaggctcagagccccagaaggccaggtggtaaaggagggatgggagctaaggggaggcagaaagggtctgccttacttttaaccatcgtttatgtctttctgcacaagaatttactggacaaaggggttttgtggtaaggaacaaacctgaaaaacacgggcctggacaacctggtgaccgctatggcccttcgagttcagcatttccagaatctggccatcgccctcctccccgtaggcgtttcagcagcatctgctgacagcacctgtcatgtcctcggccagagtcgcaggaccctggtgtcctccgctcggctagagaggcccttcgaatgggcccaggactgcctggccatgtgatcagttcctccgctcagccattgttttcccattaaaacagagtgacaatcagcccctgccagctcggaggagtctttgtaggtttgaagttaaggagaagcaaagcgcttgggtcacttgacttcccccagatgagcgcagaacccgtgaaggcggtttcatgcttccctgggctggcggaacgcaggcttctctccccccatggaggggccgctctcagcctttccaagacgagaatctgtcagggaagatggtctttgtgtgccccaccctggccagtccctgcccggggacagggcatgcctgggcctggtccaggtgaggaaagatgcccgtccccgctctgcccccagcagcctcctgccagggactgaccatccaaggctctcgagggagctcccaatggccaggctgacccctgcctagtgatgagctggggctcctgcactctgagcccagctcagcccaggctctggggattcggaatagtagacaccagcggaagcaggactgccgctgactctgtacttgggtgcacgcggaacccacggctgtgagttgccatactctccctgcccccccgacatctcctggggctgggaagaggcacagaccgggtgactgcgagggcctgatggcggcgcaggcgttcgggccaggcagctggcgcctgctctgacggcaccctctagtgaccggtggccacggctgaagcggcgcccgggaacacgggctgggcctcccatcctggggaccatggcctgtccccagaagtcacgggggctctggaaaattagttgtctgagttgccaggcagataatgcatggagcgaatagagcgtatggaacccagctctgcaaggcattgcactaagcactttataagccttaaatcttttcaaccacaaaaccgctgagaggtattattattgtttccatttttctgatgaggagactgaagttcagagaagttaagtgccccaaccctcacagatagaaagtggcagaaacaggatttgaacccatgatctttcttttaaatttttccttattaaatgtttccattgcaatagtaatacccgctcactacaactagtgggatggaattaagctgtgtaaagaaagggtgtaacttgccaccaccccactcctccacaggtaaccacagtcagcggggtgctgtcctccacgatttctcctgcctcgtacagacacaccgcacatgtgtagtcggaggaggttttgctcgttcttgattgttttgcccaggtagtgtcgcactatatcgttactctgcggcctgctttgaaaaccaagctgaaatgggaagtcagttccggtttctcagaccttctcgcaggttccccgtagtcctgtgggactcttggaagtgtcccccggcccaaaccgggcaatagctgatggctgcagagacagggatgcggcgctccctgggaaggggcccagctggcctctgcactccagcctcatgggagtctcctgcacttccttccaggccctgccctatgtggccctcctgatcgtgatgctgttcttcatctacgcggtgatcgggatgcaggtagggaggctcccaccacggggctcctggcctcccgctctgtctctccccagttcccagcaccacattccctaacgccttcctccctcccttctccctttcattcctgactgtccctctccctcctcttccattttctgaggcccaaaaagccacaggaattggaactttccccaaatggatctcctgtaggtagcaggagaatgtcccggtacagaatacacagcccagagagcctccctccccgaggcctgggttctgctcttggtagaggaaagacactctccagttatgcaaggggcctcgggacagacacagccccttctcaagaaacagcagcaaggtgtgtctgtttgtgtccagcacccctgtttgtgtccaggtctgatgggcctgagagttaccccaaccagattcatttgaagctaatggctgagagggagggagggaagaaggaagcaaggaagggccaaatcaacacaaggttcaccgcatcaaatgtgcagcagttttctggggcctcccctcccaggtgcccactgcaccattcaccgcaaacctagggctctccattcccgtcttggggctccagcttgagtcccaaggccaaacttggcagggcgcccacactagcccaaagcgcttcctcggccgctccttcaggaagtcccctacttgctcatcgcagaaagacccaagattcagttgccaaaaccttttgagactaaaagagctaccttgatacctgataaaggtggcagtttctaagataagcacagctttaaaagaccaggaagaaaagggatttcaggaatgcattaagcttgccctagcctcagatcactcactccacatcactccaaaatgcaagaactaaatttgaaagagtgcttggacatgcagaactgaaatagcaaagaaaataacgcagtgcatcctgtgtcctgtcagaagcaggatcccggtcccagcatccaccgctctcagccccagctcccactgggctgcagggaccttcctgaggctgtgggcactttgattctcatgcttgtccagtgtagggatttgggctcaggggctgggtggggcagcaggtgcctgccaggttgcatgggaagactgttcagcttgtggcagccagttccagggacacctgagacccctgaagagaccattgaacaatggtgggaaattaggaccctatctgtccacaaatcactgaacacctcttccttctctctcctaggtgtttgggaaaattgccctgaatgataccacagagatcaaccggaacaacaactttcagaccttcccccaggccgtgctgctcctcttcaggtgggtccctgaagacataggtgcacagatacacacacacctgcatggtgccacactgtggcctggtggtagaatgaaagggaactgcttcccggggagtaggaagggagaggatgtgttgcttgctctctgcctgacaaggaggccagtgggtccattgtcatttatgataactttccacagagcaacccactatgcactggcacacctgctggaaaccagacaaaaccattaggggagcaaaagtcacatgctaaaagcagcctggcttggaatctgaacaggcccaaagccaacctgccgacacgctttgtgaccttgagtgagatatctaacttctctgaacctcagttttcttgtccaataagtacagatatctatcactataccagcacctgtgccatttgccgtgctgggcgcttatgtccacatgcactgggcgtcatcctcacttaatcctcaacacaatactagcaaactgaatccaatagtacatgagaaagatgatacatcatgatcaagtgggtttcattccaggggtggttcaacatatgcacatcaataaatgtaagacaccatattaacagaatgaaggaaaaaagacccacatgatcatctcaatagatgcagaaaaagcatttgacaaaattcaacatcctttcatgataaaaactctcaacaaattaggcatagaaggatggtactgcaacacaataaaggccacgtatgacaaggccacagctaacatcatacttagtggtgaaaagttgaaaacttttcctttaagatgaggaacaagacaaagatgcccactctcaccacttctattcaacataataatactggaagtcctagccagagcaattaagcaagttttaaaaagttatccaaataggaaaggaagaagtgaaattttctctgtttgctgataacatgatcttatatatagaaaatcctaaagaccaccaaaatctattacaactgataaactaattcagtaaagttgcaggacacaaaatcaacccacaaaaatgagtagcatttatttacactaacaatgaactatctgaaagagaaattaagaaatcagtcccttttacaatagcatcaaaaaactaaaataaaatacttaggaataaatttaatgatctaaactgagaactcataaaacattgataaaagaaatagttggtgacacaaataaatggaaagatatcttgtgttcatggattggaataattaatattgttaaaatgaccatactacccaaagcaatctacaaattcaatgcaattgctatcaaaatgccaatgtcattttttatggaaatggaaaaaacaatcctaaaattcatatggaaccacaaaagaccctgaatagccaaagcaatcttgagcaagaagaacaaagctggaggcaccacaatgcatgatataaaaatctgttacaaagctacagtaaccaaaacagcatggtactggcataaaaacggacacatagagcaatggctcaggagagaaacctgagaaataaacccactcatttacagccagttgattttcgacaaaggtgccaagaacacacagtggagaaagaacagccttgttaataaatagtgttgccaaagaggaaaaagggaattactttcaaaatcatcattagcattagacttctcattaacaaaagtatatatgtaatagaagacaatggaataatatgttcaaaattatgaggaaaaatgtatttttgaatctggccctctaaatacagtctaatcagcattccagtagtcaagcaaaatagagacatttccaagtgtttaaggacccataaagtttactccccaacataagtcttccctggagcaattactcaggctgtacttccacagaatgaaaaatgaatcaaagaaatagaatgagcagagtaatgatatgagtaaaaaataatgaagtttatagttatgagttatgaacaaggacattataaagtttatataaagtctagatacttgttaaggggaaaatgtacaaaaccttaatgacaatttggaagtaatattttatgttatctctacaaggtaggaagtgaggtggtagaagaatgagaaacatgaaaccatgctaagattcttctcttgtttggggataagagtatatactgtttaattctgtacataactaagggaaaagtgtgtatacatatatatgttaaagatttaaaggtcaatcactaaaaaaatagaaatggaatgtatatattctaaaccactagaggaaaaaaatggatggataaaacttagcaatccatcaaaaggaagctaaagtaaaagtagaaaaataaataaaacatggaaattagaataataaaatgagatggcaggaataagaacaaagataataattgctaaacttattgaggtaaagttcactattaaaacatagatactctgatgttggctttaagaaatctagctctagcctgtttataacagctacagtaaaacaaaatggcctaaagaaaatgcaaataaaaggatggaaaaacgaataccatgtaaggctcacaatgtagacgtaataatagcagtagcagaagaaatagaattccaggtgaaaggcattaaacaagacaaagagggattttatattgataaaaggtataatccatcaaaaatatataatagtcataaaactacatgagcctaacaatatagtttggaaatgtatcaattacataccaatagaagtataaggagaacacacacacacacacacactggaagatttaatacaggtagagcatgacagaccaaatagaccaaaatagaaaaaagggtaaagaatatctaaataatacaattaacagacttgaacttatcgagttatactcagtaaatggccaaaaaaaacacattctttttaaacacctcagaaacattcacaaaaattagccaagatttaagtcacaaagaatttaacaaattctacaactgcccctactttgatatagccaaattagaaattagccataaaaacaaaaacccctccaaaatctacttaaaaatttggcactcttcttagtaactcaaagctgaaactacaatctacagtcatgcaccacatgatgacatttcagccaatgacagactgcctaaaattaaaatggagctgaaaacttcctatcacccagtgacgctatagcatcaaaatgcagtgcagtgccttactcaggtgttcgtggtgctgccagtcatagataagtatggcccatacaattatgtacagtacataatatttgataatgagaataaatgactgtgtcaccggtttatgtctttactgcactatacttttatcattattttgcagtgtactgcttctacttattttttttaagttaaccgtaaaacagccttaggcaggtcctgcaggaggtattccagaagaaggcattgttatcataggagatgacagctccatgcatgttagtgcccctgaagaccttccgataggacaagatgtggaggtggaagacagtgatgttgatgatcctgaccttgagtaggcctaggctaatgtgtgggtttgtgtctcagcttttaacaaaaaaactaaaattaaaaaaaaaaagttcaatattaaaaaaacataaaataaggatatgaagaaaaatattctgcacagctgtacaatgtgtattttaagttgcgttattacaaaagagtccaaaagttaaaaaaaatttaaaagtttataaagtaaaaatgttacattaagctgaagttaatttattactgaagaaagaaaagtactttttataaatttgtgtagcctaagtttatagtgtttctagtctccagtggtgtacggtagcgtgcagtcatgtcctaggccctcacagtcactcaccactcactcactgccccacccagaacaactttcagtcctgcaagctccactcatggtatgtgccctctacaggtgcaccgtatttaaatattttttactgttccttttttactgttcctatttttactgttccttttcagtgtttagatatgtttagatacacaaatacttaccattgtgttccagtttcctgcaatattcagtacagtcacatgctgtataagcttgtagcctaggagcagtaggctgtaccacagagctgaggtgtgtaatagctacggcatctaggtttgtgtgagtccactctatgctgtttgcacaacagaattgcctaaccatgcatctccccactgttaagtgacacaggactgtacttagaaatgagggccagggcaccagatcttaaacgtatgagatgcatcaatcagcaccaaagaaaaaattcagagcctgaaatttatttatttatctaaaaagctgtatattaaataagctaatagatggggaaaagaatagtaaaataatcccagaatatgaaggaatgcatttttaaaaataaaagcataaattaataaaatatggattttatcaataaaccctaaagctgatcctttgaaaagaccaataaacagacaaaccatcaaatccaatttttttaaaaaaaaacacaacaacatcagaaatgcaaaaagcaacataattacagatgtggaagtgatttttagaatgataagagaatttcatgcctctgttttgtggcacttcagaggtgatcatctacttcaagatgaagcagaaagtctccttcccagccagtggctgccagaaactcattgaagtggacagtgaatgcaaaccataccttttatgagaagcatatggcctcagaagtcgctggtgccactctgggtgaagaatggaaggcttatgtgggtggaatcaatggtacaaatgacaagcgaggtttccctatgaagcagtgtgtcctgacctgtggttgtgtccacctgctactgcatacggggcattctgttatagaccaaggagaactgcagaaggaaagcacagattgttcagagttgcattgtgggtgccagtctgacttcttaatttggtttttgtacaaaaagatgggggggagagaaagatatttctagactgactgatactactgtgccttttcacctggggtccaaaagagatggcacggtccgataacttttcattctccataaagatgatgtccatcagtgagtaaacccctaaacaaaggatgtcaggaacccaggaccaaagcacccaagactcggcatcttcttactccacatgtcctgcaacacaaatgctgacgtattgctctgaagaaacagaacactaaaaaaaaaaataagtaaggcccggtgcggtggctcacacctgtaatcctagcactttggaaagccgaggcaggtggatcatgaggtcaggagttcgagaccagcctggccaagatggtgaaaccccgtctctactaaaaatacaaaaattagccaggcacggtggcgggcacctgtaatcccagctactcgggaggctgaggcaggagaattgcttgaacccgggaggtggaggttgcagtgagccgagattgttccactacactctagcctgggcgacagagcaagactctgtctccaaataaataaatataaggaagaggttaaacaatatgctaaacttttggccaagagaatgaaggagaccaaagaaaaatgccaggaacagatttccaagacatggaggctatgctcactgagagcttctgagtctatcaaaaataagattttcaccaggcatggcagctcacacctgtaatctcaacaacttgggaggctgaggtgggaggatcagttaagaccaggagtatgagaccagcctgagcaacacagcaaaaccccatctctaaaaataaaaaataaaaatattagccaggtgtggtgccatgtgcctgtagtcccagctacttgagaagctgtagcgggaggatcacttgggcccaggagtttgaggttacagtgagctaagatggctccactgcactccagcctgggtgatgaagtgacatcccatctctaaacacatacacacacatacacacacacacacacacacacacacacacgatttttctaagagtagcagacaaataatatcagacttttaaaaagaagacagagaacatcatgaacaaatatgcaaatatatttgaaaacctaaatgaagcagacgcttttatgtagaaaataagaattataaaattatcttaagaattaaaaaaaaacaactacaacagaaattgaaaaggtagttgaaaatttagcctttgaaaaggcccaaggttcaatatttttatttgtgaggtctaccagactatcaaggagtggatcattccaatgttatataaactttccaggaacagaaagatgtagaaaacctcttcacccactccataagactaatataaagctaatgccaatgagaaaaagagaaaaaagcaagcagttataaatatgaaaatatgtacacataactgtcattgtttgcagacaacaggctaattcaagtagaaaatccatgcaaattaactaaaaaccctttaggacaatagaattaataaagtggaagattaaaagattaacaaagaaaaataattgctttcctgtactggtaataactaattagtaaatgtaatagacaagatcttatgctatcactttttcaatgttattattttgtaactcttacccaataaaataagacaggaaaggccgggcgcagtggctcacgcctgtaatcccagcacttcgggaggccaaggcgggtggatcacgaggtcaggagatcgagaccatcctggctaacaccgtgaaaccccgtctctactaaaaatacaaaaaattagccgggcgtggtagcaggcgcctgtagtcccagctactcaggaggctaaggtgggagaatctcttgaacccaggagatggaggttgcagtgagccaagattgcgccactgcactgcagtctgggggacagagaaagaccccatctcaaaaaaaaaaaacaagacaggaaaaataaatcaaaggataagaattggagaggaagaaacaaaattaaatgccaaaaaagttgattgcctgtgtatatatacaagaaaaattacagaaaattgctaaaactgataggatagtttagcaaatattctgtaatatgaaatcaattgtattccctctatatcagcagcaaatggacatagcttttaaaatataatgttgaaactataccattttaaatgtacaacaaaataaaaggagagagatgccacgtttctggccaggagacttaatatcataaagatgtcaggattctgcaaatgaattgacatctcagtgcaattctaataagactcccaacaggattattcacagaggctgaaactgattctacggtgtctatggaatagaaaaggaaactgaatagccaagacaaatgttgaagaacaacaggttggcaggactcctgcactgtgagagggcaggacttactataaggcaacttactatgcagacaacacagtacttctgtaccaagataaacaaataaacctgaggaatgcaatgacaaggctagaacaagacccacacatctacgcaaatacaacttacggcagaagaaatatttcaattaagtaggtgaagatgtactattcaataaatagtattaacaaaatgacttatctatgcagaaaaaataaaagcatatttctacctcatatcaaacatgaaaataaatttcaggtcaataagttattgcggaaaaacaaaactttagaacctttagaagaacacagaaaagaatgtctttatgacctaaaatagagaaagattttttaaacgtgatgcaaaaagcacagaacatagaggaaaaaactataaatttgacctcattgaaataaaaaacttagattcaccaaaatacaccgtaaataataccagagacaacccacaaattggaagaagatatttctgttgcatataactaacaaagggttaagaatagacacgaaaccaccatgagactccaccttcctcctgcaagaatggctgcaatttaaaaaataaaaaataatagatgttggcatggatgtggtggaaagggaacacttttaccccgctggtgggaatgtgaactagtacagccactatggaaaacagtatgaagattccttaaagaactaaaagtagacctaccattccatccagcagtcccactcctgggtatccacccagaggaaaagaagtcattatgtgaaagagacacctgcacacacacatttatagcagcaccatttgcaaaatgatgtaatggactttggggactcggagaagggcaggaggatggtagggatcaaagacgactgcttgggtgatgggtgcagcgaaatgtcagagatcaccactgaagggcttgtccgtgtaagcaaaaaccacctgttcccaaaaaactattggaaattttaaaaaagaatagagaatagagtatcttttttttttttttttttgagatggagtctcgctctgtcgcccaggctggagtacagtggtgtgatctcggctcactgcaaactccgcctcccgggttcacgccattctcctgcctcagcttcccaagtagctgggactacaggcgcccaccaccgcgcccggctaatttttgtatttttagtagagacggggctccaccatgttagccaggatggtctccatctcctgacctcgtgatccgcccacctcggcctcccaaagtgctgggattacaggcgtgagccaccgcgcccggccagagaatagagtatcttaagcaccctacaaacgaacaagaagacaacctgaatcaaacaagcaaaaacatgaacatgcaatttaatggaagataaaatttaagttctcaacccactaatcattttataaccaaattaaaacagcagtgacatattatctcacacaaattatatgagcaacatttaaaacaattcactaatgaactgatgagtttgtacagtagtgttatttctcctacactggtaataggagtctaagttggacaaatccttggaggtcatggaatatctagtaaaaataaagatgcatgtagtttaactggcaattccacttctaagtggatacccaagatataaatctgcatgtttattgcagtgttatttgtactagtaaaagaaaaaatgaaaaacctaaatgttccttaacaggacagtggatttttttacggtaagttcatagagcatactcctgtacagcagttaaggtgaatgaactggaactaaaatacatccaaagggctaagtctcaaaaacatcacatggattgcaaaaacagcaagttttcggaaaaggtgcaatttgttactgtttatataaaattttaataatgctatgtgtttcatatttagcaaatatatcagagcattcagggaatgatgaacatcaagttcattttagtaactccctctggggaaggaggaaagggacaggtggggagggatgcagagggccctccttggcatctgtaggatgggctgcatgaacgtggctctccctcccctccaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctggtaagccaagggggaactcaacagccagcagccatgactgcccagttccagggcagtctgaaccgtccatctctgcagctcatggtcagggcaaccctatcagaggagctggcttgggaagactaagttggcaggagtgtccagccacatggagagaaaggcagaaagccctgggccagagtgagctccaccagcatcttgcttgtctgttcttggctgttgtcatggtggcattgtcccagaggacaacggggacatgtgggggcctagaaagaactgtacttttttggcatcttgctgaggagtgaggaaaaggggataaagtccccctctgtcctgcacagccctgcccagcagctcggtaggagggaagctgtccagcccacctgtgggttcatcacacacaactctcagggaaactgtgtcaagtttatgtccaagagacccaggttctcaggctggtaggatggatgactggtctttagaaatgttggcttctgccatcagtaggccccagctggcaagggggttccagaggcaggtgtgtaggaaggtcttctcacagcacctcattgtactgttccccacagatcatcaacctctttgtagctgtcatcatggacaactttgactacctgacaagggactggtccatccttggtccccaccacctggatgagtttaaaagaatctgggcagagtatgaccctgaagccaagtaagttcccagagggaaatcctgattccccaagctgagagagggtatagctgaccatacctgcaggaggggctcaaggttggccaacactgggtggatcaattagaaacactggattgtatcacaccctagggtgaaaggtcaagggccagcaggaggaggcccggcaccttcaattaagtcaagaatgtatctactaggttgggtggggtggctcacacctgtaatcccagcattttagaaggcaaaggtggttgaatcactcgaggccaggagttcaagaccagcctggccaacacagtgaaccccatctctactaaaaatacaaaaattagccggacatggtggcacatgcctataatcccagctactcaggaggccaaggcatgagaattgcctgaacctgggaggtggaggttgcagcgagctgagatcacaccactgcactccagcctgggcgacagagcaagactccatctaaaaaagaaaaagaaaataatatatctactatattcagttgaatggaaggataggaaattctagtatcaggaataactagtaagtgctcaagttaggataggtagggccggggaaaatcttgattcccattcccgcttctggtctaaagatcaatcacattcggctgaccctcagtaaataccttttggtcagaaggttagttcattcaatcagcaagtatatattgagaattttgttgcactgctaaaatcccttccaccttgaacatagcatgggcagaaaatgattcattaaaatctaaacacgtgtatatgtatattggtttggggctgtgtcatgcaattctgcaactctgtactgagtgtgactaatagggctaccacactgtgcagtgttgcccatatgagtgggccctacccctcaggcgcatgcgtcctgggctgctggcagagaccgtggctctctgatgccctgtccctcctctccctcctcttctaggggtcgtatcaaacacctggatgtggtgaccctcctccggcggattcagccgccactaggttttgggaagctgtgccctcaccgcgtggcttgcaaagtaagagataacggggttcatgggagggagagggaaaataggggaagtgaagtgcccatttcttgtgatcctttaagggaatgaacatactagtttatgtgcctaaagattacattttaagggtccttccagctctaaattctcagactctatgagggaataacagagtgaatgcctcctgtcctactgagccagggacccagtcctggataaaggacttgttcagtccatcccactgcaccatccgggcatcctggggtgggagacttcccagcctaggctagaggggttcggcgttcttttcctggagttggaaggccattagaaagcccaggcattgacttcaggggtctttgagtcctaaaatttttcataaaatcactaaaatacaaagtttaccagggagaggatttctcactttaatcagattccttagtgagaccatgacccaaaaaaaaagtgtcgtttccatttctccctcctctccaccatggccactccacgctccttttctccctcctctccaccgtggccactccacgctccttgttggggcaataatgagctgacagagagctgggggaagggagaccagagggctggagagaggaggaaactcagatggcaggaggattcggctctgtgagaatccactcatggaaaacgcagattgagggaacatagaaccttctacttgtgctctgtttactgagtttcttctcatttgtgcctccactttgctccaaaaacaaacaaacaacaacaacaacaaaaacagattttaagagatttccaagggcatagaaaatatcagaaaagagcataaaataaatgcaaggtacaaacaccatgcaaggcaagggtggggaggggtgcagcctggagggggctaaagtgcgtccgttgtggcctccggacgggcctgggcaggctgaagcctgggtgcgaaactttccggtggccaagatacagttcacaccgtccatgaggctcatcaagatctggtcactcaggagaagtgtaacccttctagacactgagattagcaggaggtcaccgtgtgagctgacaaatagccccccttgagcatgcccttggcatggacgctgtggtgagcttcacaccgcgcttgctcgtcatgacccattgcatgctgaaggccccacaccagagctccgtgccagggaagcctgttctgggggtgtgtgctgggaaagaagagggcaagacagcactatccagtgtcagcaagcttctgctccaacttgatgcagaagcatatttgtcaatacacagagaggacatgtagcatctcctgcaggcaaagctcctgtgatcctttctcttcttctctgggctgtggacaaatgctgcctggcaggtgggctcccagcacatgctggcgtacagccggtctttgctgccagtggagagcacacctgcacgcctgagcagactttcgagcagggcgcaaagttgggtggccttcacatccttttgtggaagtgaaggtctaatgaggacaaatttcatacctctcccactccacgaggagggtcaaaagtagttgtggcaaaggcaagattctccctggaatgcttcagggagcattcactccctgcccactccagcaacacccacacaagctgcgtgtcacccccagcatcctctgtgtattaggccatccttgcactgctgtaaagaaatacctgagactgggtaatttataagaaaacaggtttaattggcccacagttcagcaggctgtacaggaagcatggcactagcattctgcttctggggaggcctcaggaagcttccagtcaatcatggtggaaggcaaaggggaggcaggtacgtcacatggacagacagggagcaagagagaagggggagggaccacacacttacttaaacaagcagatctcatgagtactcactcaccaaggggatggtaccaaaccatttatgagaaatccaccccatgatgcaatcaccttccatcaggccccacctccaattctggggattacaattcaacatgagatttgggcgaggacacagagccaaaccatatcactctgccacggtgttctgcggtcccctaagcaccgcctgccatcatcaccagctttgcttctcttcgcctgcagcgcctggtctccatgaacatgcctctgaacagcgacgggacagtcatgttcaatgccaccctgtttgccctggtcaggacggccctgaggatcaaaacagaaggtaaggtcgcccgtgggcactgggagagacactcagaaggtctagcagacaatcagagaggagctcggcagcctgcaaagtgctcaagggaacttcctgccccagacagcatccgagctgggatacgggggtaacgtgcgctccaggacatcgcagggccccagcctgctcatgacttctttgctcctgaatggtctccctgcctctagctcaggggtttccaatcttttggcttctctgggccacattggaagaattgtcttgggccacacataaaatacactaacgatagctgatgaactgaaaaaaaaaaattgcaaaatactcaatgttttaagaaagtttacgaatatgtgttgggccacattcaaagccgtcctgggccgcatgtggcccatgggctgcaggttagacaagcctgctctagcttattcattttgaactctagctttccatgaaactctgggactcattctgggtggtatcttgaagtcagagggtatagctcacaaaacagaaggagacgggtgttacctgaagcaggaccaacccctgtctaaaagaacttacactggctacaggtgggtgtctcaaatgctcaactcattaaattaataggactgtgctgggaagacgtgtgggaaaggggacacagtgacaagtggtggccgtggtggaggtcatcgcacacattgtgcgggctgagcctggcttaaggctcttagccagcggacaggtgaggattcagacctcacctgtgccacctagtcagaccgggctccctcagggctgcgtccacctggaggggcccttctagttttcacaaggcaccctaagggctagcagcagcctgagtgagataatctgcttgctttatgatggataagagtttgcgaaccactatgggaaaggctgtattaaacacacctaacaagataccatttctctccaagagtgtccagccttggagtgtctagtgtttcttagagcgtggtcaaaagaccaccgctgcagaatcagctttgggtacctgtttaagctactgagtcccaggcacccacacagacctgctgatgccaaatccctgagcatggggcccaggaatctgcatcttgaaccaactacagagatgattcaaacccactggtgtagtaattacagaaaacacagatgagacaagcagtatgcttccttccccttcctacacttccagcttaaagctcaggctgtccgtcagtgtgttcctcggggcaacagaaggagccccgggcaggtgggaggctcgaatccgagtccctgctctctcactaatgacatgagtatgagccatttactctctctctacttcagttgctccattggtagactagagaaaggtgatgacatctgggaatttaattcattgaataacccagacatgggccttctctccgttagatccttcaaaaacaataacagaaacatttcaaatgaagtgaaacaagaaccagtccaccaagacacaagtcaaaataattagctgatttttaaaaaataaaaataggggccaggcgtgctggctcgtgcctgtaattccagcactttgagaggcccagtcgggcagatcccgaggtcaggagattgagaccatcctggccaacatggtgaaacctcgtctctactaaaaatacaaaaattagccgggcgtggtggcacgtgcctgtaatcccagctactcaggaggctgaggcaggagaatcgcttgaacctgggaggcagaggttgcagtgagccgagatcaccccactctagcctgggcgacagagtgaggctccatctgaaaaaataaaataaaataataaaaataggacaagttctgctactaaattaaaaaaaaaaaaaagagcaaaggcttaaaaaatataccatcagtagccaatgcaatcactcaatctgaaatgggtgtaaataggcctatttctgactgccagaaaaccaaaacacactttttttttttttttaaatggaatctcgctctgtcgccaggctggagtgcagtggcacaatctcggcctgctgcaacctctgactccctagttcaagccattctcctgcctcagcctctcaagtagctgggattacaggcacgtgccaccacgcccggctaatttttgtatttttagtagagacagggtttcaccatgttggccaggatggtctcaatctcctgaccttgtgatctgcccgactgggcctcccaaagtgctgggatgacaggcatgagccaccgcgcccggccaaaacacacatttaattcacacatatgtgtgtataacaaggaagaaaactgggaaggaaatgtgttcgtatgctaacactgattatcatgagtagaaagatcagcagtgacatccaccttactcctttagtttttttactttccaaatgttctgcaaggaatgttactcccctatgttcagagggaaggagaggcgatataaatgactgccaggaggaatatgctgtaatacttaaagattgatgtaaattaaggatgtgagattttgttccctagaggaacaaaaggcagggaggtatggaagcaagaattcagcagggtcgaaggttcactgtcagagccaaccacatgccaactaaggaagaccaatagctagtaacaatgcgaaagactgaccagtcaaatgcagggacccaattctgaggaaataagagttccagagaaaagaggagaagccagccatgtgggaactacaatcctgtcaagaattacagactatcttttaaacacaaagacatttcagaacagctaccaaagggcccgaaacgcccccacccaagggtgagccttcatcagacatgggccctccataaacttgttaaaatcgaaacgcccccacccaagggtgagccttcatcagacacgggccctccacaaacttgttaaaatcctaagaaagaaagacaaagtcaagtcttggaagcaactagaaagaaatgtgagaagacatctacatttgtgaagatgaggcttgcatcagtcctcacccttcagacttctcagcgtggaaggaattggggcgaaattaacacctacctcagagaagcagagctgtcatcccaagtccagtaccaagccaaagaagcttctctcttggaacgtagaaggaagagctctcatcccaagtccagtaccaagccaaacaagcttctctcttggaacataaaaggaagatagtgaaaaatacttagatgacatgaaacaattgtcggtgaacttcaacaattacatagaccatcatgagaataaattaaggctgataaaaaaaaatgaaaggtccttttggaaactatgttaatttcttaggtctgctgtaacaaatgatcacaaactgggcagctggaaacaagagaaagttctctcagtttaggagaccagagacctaaaactaaggtgtcagcagagttggttctttctggaggctctggggagagtctgttccaccctttctcccagattctgagggctgtggatgatgcctggtgtgcactggctcacagcacatcacgccatctgtgcctccatcttcaaatagcctccagggtcttgtgtcctctcctcttcttggaaggacaccagccacattggacttagggcccaccctcatccaggatgacctcaccttaactaattacattggtgaaaatcctatttccaactaaggccacattctgaggttctaggcagacatgaattttgggaggacactattcagcccagtaccgaagctaagtatatttgaataccatgtgtgttaggatcttgcactgcgtgtgtcagaaacctccagctacctctcccgtgatggggattgatcatctgtgcagctggaaggcccaggagtcgtcccctgccttcaggtcctgtttggatctggcatttggggagctcgggattccgtcaatccctctactgccacctctgcatgctctgccctgtggccccagaggtggatttgaacccaggcagtctgacacaagagccctcaaccacaatactggactgccggtcctatgcgagagcagtaaacatcccgtgttggtttcctactgctgcaaagcaaattactacaagcttttcagcttaaaaagacaccccgttggctgggcacggtggctcacacatgtaatcccagcactttgggaggctgaggcaggtagattacctgaggttgggagttcgagaccaacatggagaaaccccatctctactaaaaatataaaattagctgggcatggtggcccatgcctgtaatcccagctacttgggaggctgaggcaggagaatcacttgaacccaggaggtggaggttgcagtgagccaagatcgcgccattgcactccagcctgggcaacaagagcaaacttccgtctaaaaaaaaaaaaaaaaaaagacaccccgttagtagctcatggttttgcaggtcagaagtccagcagtggtgaagctgggctttcataaggcaaatccaggatattgatcaggccatggtctcttctggaggctctgggggagatcatgttgttggtggaattcatttgttgcaattgtaggcctgagatcctcactttcctgctggctgacagctggggaccccctctgctcctagaggctgcctctctcagttcagcccacatgactgtttgctttcttccaggccggctggagagaactctgcctttaaagggctcatgtgactaggtcaggcctgcctaacctccctgtcttaggtcataggtgccgtgtgccatataacctaatctcaggagtaaaatctatgatggtcaggggcccagggctttggcagcatgtgtaccctgatgaggagcatcttagaatcctgtcccctacatctgcccttacagctgtaaggctcagctttcctttttcatcactgtaaggctaggaccccagaggctgcataaggcaggcatctaagtaggggaactcgggacagagccctcatcgacagatgtaccctccaatcatccatgttccctgtgactgccgaaggaggtccatgagaaatgccacccatggggaccagccccccactgcccgtggcagggccatacgtgttccagctggtgagcgcatggccgccattgttcctgcccaggggctgggctcagtctacaaggaagagcactgagtgccggtggaggggccccctggctggcctgagccacaggcagggggaaggggacaggaatggcattggacggggcacaagagggaagggggaaggaaggaaggtggacagaggaaggggaagaggaaggaggtggaaaatgggaagactggggagaagtgaagcaagcaagaaagaaactgatgagtcagggttgcgtggggcagatgccaccatctgtggcttcctaccttacgcagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtggtgagtgctccctggactcccgcaccttggccactgcctggccgtgcccccctctgcctgcctctcctccagctgtggcacccttagaatgcggaagcatcccctgagacttgcttcttgagtcccctaggcttgctggaggtctgccttcagacccttcctgtggggctcagaggccctgttggttagaagggaggcaggtgcaacgccctgcacaaactcagaaacagaaagtcaggttggaaatctggtacaaccctgctttttacatagggtaacaggcaagtccctgatgcttaggggtttggcagaacttctaaagaaactccacaaagtataggtttcccataaacctgattgctgtaggattgctctaaggccctcaaacgagaatcccctgagattcctcccctcttggatgacattctttttgttcttccaagagcagtgtttcttgaccctatcaagcctcaaatccctttttatagcaaagagtttatattgcctttactatgatcctgaatgaaaattataggtaatataactttcctatacatataatttccaaaatattaatataatgccttcactctaacataaaatctattaaaagcagatgtttccaatatgtaaatactcaggcataactataccagcaggtacatttaattgatgagatcttctcatgcacccacttacaacacatacggctgggttcacaggaagcaagacaatactgaatactgtcaacactttgatttgccattttgaaataaggggtaaatcagtatattaaataagtgtgtgtataaatagccccccacacataaacacacacacatacttacacatatgcagaacaaccgtgatgtgacacttacggtgagtgacccacacaccctaaagagcattgccatcaggaatacagttttccaaaatgcgaacctctcttggccaagtttaaataatccaaagtatagttttcctcaatttacacagcagttgtattcctggaaattgtcaggtgtgttaaaaccatgcaaaacaatgtcctgtgttcatttgcaaaatgaaattatgttccgagcccagagactcctaagcagaatcatggatgtgtggcataagcttgagagccatgcagagtgcaaagctgtgattgcagaacatgcctgcactttaagggacaggtctggagctacttaatgctagtggcacccccacagtaccccgacaactaaaaaccaccccacacatttactgtgccctccttaagaggcaacaccacttgtgttgagaaccatttgccagagggaaagccggatttgggctaagcgaaaatctcgccagtgccatgtgatgtttacatacatcgttttattgaatcctgacaacatttctgtgaagtttgctcagggaactaaagttcttagaagctaagttgctggcccaaggttacctggagagtccacagcagattcaggattcaaacccaggccccagggaacctaggactccaggtaggactccaggcttgtcccaccatgcagttcttccttcctgactatgctggacaggggaccctgggtttttccctcccacgtggaaagggggtgcttgccagagaagggaggggtcatcactgctatggatgtggctattttggagggacaggtaggaggaggagaaccctcaccagcccctagatttaatccccagctgtctcttgggcccgtggcatctcttcacaaagaaccaggaggtagatccaaggggctcctccccaggcatgaaatgtttcctctaagaacttatggcttctccaccatcaggtttactcccaggaaagggactgatgatgtcacatataatcttgggtatccagcccagcagggatgcagccaagccacctggcacaaaaactcaatcgggtttgaaagaaaaatccaaacttccatgggaagaaagccctccttccaccagcccctccctccgagctaagctgaaccgttttgcacttgcacttggaagagtggccagttgatgagggacatttgaagctctggaatcaaatgtatcagttcagttaaaaaaaaaaaagcgggaaataattttgatggtaggctaccttttgcataaaaaaaacaggagataatatgtttgatgatttacataactaatttgcactaagaatctctgagaaaatactcaagaaactagatgatctacaggaggtggtgactaggcagataagggctgtggtgggagagacttttgaccataagcctttttatggttttttttctctctttttaagccatgtgaatgtattacctctccaaaaatattaaagttttaaaaagttttggatgctgaaaaaaaaaatgaatgaagttcaactgaattcccctgctcccctcttaccccctctcccctctccatacgtctcagatgatgaggtcaccgttggcaagttctacgccacgttcctgatccaggagtacttccggaagttcaagaagcgcaaagagcagggccttgtgggcaagccctcccagaggaacgcgctgtctctgcaggtgagggcctgggggcgggcccacactccaggaaggtcctggtcattgcctctgacctccagtcagggtcccggtccctccccagcaggctggaggccaggtccctgcagagggaacctttcagagagctccagacctttccaaagatggctgtgagaagggggtgatgtgcccttccctacctgccacccaccgactgccctccatggttctgcctgctgtcatagcccccagatctctcaaatacttcactgaggctcccgtgacagcccctgacccctggtgccccgtcctaatgagccttcatccctcctggatgggcgagtggattgttccatcagagggcagcccagcccccagttcacacacacacaaaccttccggagggtcgactggctgggtggaggatgccagggccctggagggacaggtcttggcccgaggctgtggctggctggggagcttggaggaaagggagcgtggtcctcaccatcctccccttggattccaggctggcttgcgcacactgcatgacatcgggcctgagatccgacgggccatctctggagatctcaccgctgaggaggagctggacaaggccatgaaggaggctgtgtccgctgcttctgaagatgacatcttcagggtgggtggtgccatggcgcactctcgacccctataaagttcagtttggagcaagaggttgggctggggttttgcggggaacgtccaggggaaggagctgcaccagaggaaagggctacttccaggctcttcctgatgagctgtctcctcacccctttgccttttccaagcctgactccatcccaaggcagggctccctggaaacagcagctctcagtgtcactggctctcagagaagcgggaaggaaccgccttcctaagggaaatgtttcctaggagaaacttctgcattagaagttgcagagtggtcacccctggggcacatctaatctgcaggcttgttttgtttgttaatatttgaaaatcaagacttctggcattctttggaaaagtcaggagacctggtaatattaagcttgcattcccacagggcagcagagggccggagcctagaggcggtggccctttgagatggagcatagcgtgtgttctccaggtctccaagacccctccagaactcccctttccctctcctttcctggagactgaagctgcccagcagttgcaatagtgaaaattaaaacggctgtaccagaataaggggcgtttatcactcatttgtgttgcctgcctcaccacgctggtgtttggttacaaatccttctatagcaagggagaagctgccagccataattgtgcaggaccctgctcacacctctctctcccggccgcgggcccagttcccaggctgtggaacacacagggggcaagctgagcccatcctgcccctgctccgtctcttcctcatccttattctcgtcactgggagacattcgtcactgagtggcctcagggacatggcatggtggtgacacaacccgacaagacaccagaaaccaaagcctcagtcaccaaggcccagggatgctctgatgtcaagggttggaacaaccgtgcaaatagctacttgcccacttccccaggacaaggaaaagaatactggggaaaaacattggctcctggttttaaatctctctgagtccccgaggggaaaaagaccatcatgcaggaaattcttcattttcaaaaccgtttggccaaccagcttttagctctgtgagcacactgggtttccattttttaaatctggttagaatcttctggtcgctctcccagcccccgccctcacggtgtgctggctgctcttagggaccaccatcctagacgtgccctggaaactcactcccagccttcaggggcttcactggaaacctccagggcagctcgtaccagcggcagccccttgcccaatcccatccccactggtgggtgggttctcccagctgctgcagaggggagtccagagccttgagactccgggtccctccctctctggagcagccaggcatgaagaaggtcctcaggtgctcctggctcccagcagggctgtgcctacccgaaagaaggcagcccgccttcccaggccctgcacttccctgacctggctgtggaggctgctctctgggaggagtgggtgctaaggggcttctccacccacccctccttcttgcctacagagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtaagtgggaggctggccaccccaggcggcacacagggcccacgtgctgcaaccctcaggagacagtggaggagacggaggcctcggccagccacttgtccctcaagcttccaggaggttgctgccccagactccagcaagagcaggaggcactatgctgtctcccaagtcctgcccttgatcagacctggcaggctcagggcaagtcagcagtggcctgcggcgctggttctcccacagggccctctcctctcccacacttcctgagtggcagaatgtgatcatcagatgtttgtgttccggcttcacaacagaaaccatcccgtctgcccttccccgagtctctgcccaaacctggcctttctcccagccgagatgggaatggtgtttccattgcttccctggagcccctttgccagcctcccggagagggcatcccactgtgggaggcgccatctgtagcactggcccattctgcccagcacaggatcattcctggaggtcttgactgtacctcttactcctgactcactcttttctccttgtcctctcatccctgtgctctaggatgcactgctgtgacatgctggatggtgggaccttccctcccgccctgggcccccgcagggctcctccctgtctgcatcagcagctccagggttccctggcggggctgagagaggacacaccctgcatcgtgcctggccacgcttcactgtgctgctcttccagagtaggagagtggctcccagcaggctgcacagccccccagcatgccaggttcttgacatgctcgccctccagctcagaaaataatagagaagtgggagcttccctctaaacccctggaaaagtgtccatccaaggagcaggcacacctgccgctggcctgcctgtccctgcagagggcccatttcaagagggctgcatgcaagcccatgggactcaggcatttaattgtgtcagacgacaggccagttaaaaggaccatctccctgtctgctttcctttctgcaaggttggctggtttagccacccagaagcagcactgggggcatccttcaattcatgaggcctgcactgctgccttctgtgtgcacagggcagtgtgctgggcactggattttatgtgccggcctgaagggctggctttgcataggagaggatctaatctaggcatctagtcttgggggcctgcacctgttgtgggggcctcatccttctctgcaacctcactccccttccacggcctttgaggacccaagtactgggtccccatacccccttctcccctctggcctcatgaagcttctgcttaaggagggctccacgtccgtctttagcatctcagggtgaactaattccccaccctctaagggcattttcatgtgaagctttgttctctgtgacataaggggagagggatgtttagaggagctgggggaggagaccccaggggatttccttgtccccacagatatatctctccacatagcaaaatacatgcaaagcacccggcacagtgcccagcacacagtcggtgctcatgaaatgtcggttccctctgcccactgcagatggtacaaacaacacacagggcatcaagcttcagcttggtgaagaggaggagcatagcccacgtcccagctcccttgtccccgtgtcacagctcaaggctaacggcagctctagtgccagcattgcttgtgctgaggatgggccagcacgtcctgtgcccggtggcccccaaaagtgctgctgcctgcctgctgctgctctgcgtctccagctcctccctccgtgcttcaccaaagcccactccacctccctcccctcccagtcctcctggagctcccacctctcatctttccttccactgcggggcgggtggcagtctgcagtcctcctcctcgagagagagaattgcttctaccctgcctgggatgctcagagccagggcactgatttagcactcggctctgagaggatggaccaggatctttctctgatgccctcaggggtctgaggataaagtgggcccagcatgcaaggtctatagaaagcaagacaaagggaggcactgagctgagctcagacaggaaaaggaagaggccttggtccagagctaaagatgacctgaccctgtcccagcagggaaaggcacgttccggtgtgtgaggatctggagctcaggagggattcaggctcagcagggactcaggctcactgccttctgctcaggagagcaaacccctctaggtgaggcttcctctctgtgcctttaccccagggtgccagtgtcagaatcaagggcaccatcaaaataagaggccaaggacttctcagctatgccaaatgccaaagacccaggtgtcatagctggaggtgagtggggggcagcctctaagttaggcagggcatatgtcattccaatttcatagggaaactgaggcatgaggtggaccaagtgacttggaccagagggtaagtggattggggtcaggactcctggatccacagcagacatccttctcccaaatgggaccctcaccctaatctgaacacttctatggatccatcagcaatcacaggagaacaaagcaccagcaactgtatgcctgttcacgtgtgtgtgcttgtgtttgtgcacgtgtgtacacctgcatgtgtgtgcgtgtgtgatgctttacttgctgaaggaagtggaggaaggttggcagtttctgatgtttttcttcatcttggatattgtaggtgccactcccgggagagccaggcagccatggcgggtcaggaggagacgtctcaggatgagacctatgaagtgaagatgaaccatgacacggaggcctgcagtgagcccagcctgctctccacagagatgtgagctctgctgccctctgctgaggctgacccaagtgtgggaacaaatgtggggaggcagaggcaggtccctgagatccctcctctggggctgattgcaggaggagaggagatcacagagaaaacatctgcaccgcctctttcatctcctcagtgaaatgggagccccccaacacacacacacacaccacacaaacacaacacacacacacacaaacaacacacaacacacacaaacacaacacagcacacaacacacacaaacaccacacaacacacacacaacacacacacacacacacaacacacacaccacacaacacacacacagaaacacacacaacacacaaacacacaaacacacacacacacacacacacacacacacacacacacacacacacacacacacacacacacagacacacacacacacacaaacacacacacacacacacacacacagacacacacacacacacacacacacacacagacacagacacacacacnnnnnnnnnnnnnnnnnnnntagtgattgctgttgatcaaacacacagcacacaacacacaaacgcacacacacaacacacaatacacaaacacgcacgcacacacaacaaacaacacgcgcgtgcacacacacaccacacgcaatacacacgcacccacacaccacacacacaacacacacaaaacacaacacacacaacacaaccacacaacacacacacacaaaacacgcacaaacatacatgcacgcacacaatgcacgcacacacacaaacacacgcacccacacacaacacacgcacccacacacaacacacacaccacacagacacacacacagaaacacacacaacacacaaacacacaaacacaacacacaaacatgcgcgcacacacacacaaaacacacacaaacacacacaacacacaacacagacacacacaacacacacaaacacacacacaccacacacacacacagacacacacaacacacacatacacgatgccctttttagcttggggtttcctcgccaggaaaatttctgaacattgttttataaacattgtaggctgtaagacacagtcataaatatattttctggtgagactcagtatgcacatacatatatagataattaaacaagtgtttcaagacactgcttataatgaagctgcccagaagagggcactggtggcaaagccaggcctgagatttttgtccttgctgccattcttagagtatttttagctgcagttctagatcctttagaaggtggtgacatccatttggtcactaatgactagcccttaaaagcaggtgcagcacagcacaatatcagaaactatcagaatgcgtcaaacgtcacaaaggtaagcgctgtgctgggaaacacttgcttaattgccaacagatgtggctatctgggggtctccttgagaaacatctttatgactctgagtcacatccacagaagtttgagacacagagtgacatccacagaagtttgagacacagtgtttccgaagcttttctggctcttttcaccctcaaagccctgtctcatctgttactgtatacatgactcacaacaggcctctgagacagagagggcatatgtcatttcaattttgtagaaagggaaattgaggcatggggttttccccagggggtaatgcctgggtcccatgggcttgcgtgcagccacttgaaaatgggccctctggagggacaggcaggccagcggcaggtgtgcctgctccttggatggacacttttccaggggtttagagagaagctcccacttctctattattttctgagctggagggcaggcatgtcaagaacctgggatgctggggggctgtgccacctgctgggagccactgtcccactctggaacggcagcacagtgaagcgtggccaggcacgatgcagggtgtgtcctctctcagccccgccagggaaccctggagctgccgatgcagacagggaggagccccacgggggcccagggcgggagggaagccctcaccgacccctcccagcatgtcagtccattcagttcctgaaaggacttcagagtgaggaaggactagccttgcaggcttttgaagacaggaaaggtgtggctggaggtggtgggaggggacaccaggtgccccaccctgaggagtgtggggagaatggcagccaggccagcacagcatgcggcttcctggggtccagtgctttctgctcgggaactggatgggaagagtagcagaagcacctccttttccccagcatagaaagaagaatcgagtgagtaaggaaaagcatggaaagagtcccaaccagcggcacttgacaaatcactcaactgccctgtgccttcgtgtccccatcagcaaaatgggacggtgggggtgacaggccttctacttttctgactcagtgaaacacggtcaatataaaaaagggaaatacctgaagctccttatgagataactgtctctaaattgattcttagagaatacaaacgaatgcctgaccacctaccctagaaatcaggaagagcatatattttaaactatttcggttattctagagtgcttggtgcaccaggcactctgctaggttgttaagaacccagtctccatcctcaaggaaattccacaaactaggaaactaagagggtctcaggagaggaagataacacagagtttctcactacccccagagtggtacaacccccaggggtacaggcgttcagagaaagttgagggcagggtgacctgaactggtaccacgcacaaggtgaaatggaagctggatctgcaagagccagggtgatttgcataagaagaaaatacaatagggaggccttagctagctgagagtaagagctagtcttgaaggtataaatactgcggtctgcactctaccagccttcctgcacatctataaatcatccaagtctctgtgctgtaccatgagcaggcatggagtcaccctcagaggtgtggggtggcaccagggaccagtgagtcagtggtctcatctgggaatgaggttggaatgcagctgtgcttcttgaactgcaggctgacccagcagagattgtgaatcaaaattttaataaaaatagaacagactaaagtggactgggactcaccagggtgcaatgcatgcactgagggtaagcaaagggcatgaggcttcattccatcaggtgtgtctgtgcgtgatgagaagctgtcaaatctacttctcatcgagtttccatcaaaggcctggaagccatagactagatgccccatgaggtccctcacagccctgctgttcacctactgagtgaccgtagagtggttgtaggcagctgcttatgtgctcttgctgatgagggggtggcagggcgggagaaatcgggggacgggcataagtttgggtgaaagttgagggtcactggggaaaacagcatcagctcatgcaaacacgggagccaaggccattccccaaaagaacttcatgggcctaggattctttccgctttctcaacacctttgaccccagagtgccttcactgccccaagtcagaactgcaggcttatgagacaggctgcgggtgaggagctggccattcccactgagcaggcctggaagacgtcaggggcaggccagaacttcttggggtggcaattccccaaacctgcatgtaagcacaaagtgtgcgtcccttcactaaggatcagagcaaagtgctttccgggggtgcagctgtccctgtgggtggccacttctcagcctccaggaacaagccccatgagctctctgttccaggctctcctaccaggatgacgaaaatcggcaactgacgctcccagaggaggacaagagggacatccggcaatctccgaagaggggtttcctccgctctgcctcactaggtaaatgcaccgctcgctctctggatgtggtcggcggttactccctagagaacactggtcagggatgattgggaaatcgttgtggcctgcctcaaatcagccccacacagtgggggcatttccaaagcaaggagacaacattccaaaggcagggtgtgcagggatgagccctggacaccagaatacgtctcagacgaggggaggggaaaggaggagcgtctcgggccatagttactgctcctggcaccccaccagggtgtaaactgtcacaggccagtgccctgttttcctgccctgatggtggctctctggctggctttgcaggtcgaagggcctccttccacctggaatgtctgaagcgacagaaggaccgagggggagacatctctcagaagacagtcctgcccttgcatctggttcatcatcaggtagctcacacttttggacaggccactgtcacctgccagcaggccagacagtccccagggtgacggacaaatcctgaagacttcagtgggtcttgcctgtctcagatggctggcacgtcctgcccctgccctaagagccatccctgtagggcttcacactcctgtgcaggtgagggccacggcaaggtctgcagcatcacaggtgggggcctaggaagtgctggtgcacaggagctctttgtgtgatcctgaggacccacagctgcaggttccacctgagctttcttcttaggctgccacagatgccactgacgcctctgacactggcctatgcctcagggcactcaggaagatgtacttgtacctagagtttgaatatacctggaaattttgccacacaaaaatccatccagtgacataaagaagtgattaaagaacccaccagcaacatggtcaagagtagggaatgacatccgtgggaagcaggtccagggagattccataaatgaaatgtctcttggcatggctgactccagctgagacagtgaaatccaagatgccaggaccaaacatgccttagtatctttgaacttcagtgttatctaaggccagtctattaaccccaggcaaactgaggtctaaacctgggtttcccaacattctgaccttattaaagttatactcttttatagcatggacctatgttttaaatagacctatgctttgtacccaaaggcattcaactgccaatcaaaagtcataatcagcatgagatggccagtgtggcctggctgagttgatagtacttcagctccaaaaaataaacaggttttcttagcctgtgtggtgttgtcttccactgggctttctgaaataatgaatatggccttacacttttctcagattcccagggacccaggagccccaggctgaggaccaccatgggcaggggcaggaggtggaaggatgtggggacactgtgtgtgctatcttaaaagatttctagaagtcgatttcacctatctgttcttgtcgtactggtaggcacgaaactctcctcttcatctctttctcctcctgtactctgtgaccctagaggtggtctttccccaccacagtgtcgctctctcccgggagcacatcccatcagagcagctcaccctgcagagcctctgccctggcaggttgtcatggcaacagccagacaggcctggtccctaccctcaggatgctcaagaatattcagggacagagggcgtaccgtgtgacttttttttttttttttttgagacagagttttgctcttgttgcccaggctggagtgcaatggcacgatctcggctcaccacaacctccacctcccgggttcaagtgattctcctgcctcagcctcccaagtagctgggattacaggcatgcaccaccatgcctggctaattttgcatttgtagtagagactgggttactccgtgttggtcaggctggtcttgaactcccgacctcaggtgatctgcccgccttggcctcccaaagtcctgggattacaggcatgagccactgctcccagccctgaatcttttaatcacaatacagcaccggatttaacaatggctcaaagacaacctgagctagagactggcagggcattatgaatggccccattaactgtgagaactaaaaccacaaatactggttttcccaactctttgtgaggtgcacagcgcttcttcacagacctcattgcgcttgagcctcacaccagccccacagggcagatggatagacagcattcgttttctggctttacagacatgcaggcctcaccctgctctccattctattgaggacaaaaccaagagcgagagaatgcacagctgacaggtgaccaggccagggctaaaagcaggttaccacgacttcacccaatcccagctttcagaagttacaggagaaagagatcacttcagacccagatgatcctaagatgtattttgagatagttgaaagtcatgccaggttgagataggaccgacaggggaaaataatggcatgggaataccaggcaggtggagctagctggacacagcagctgcaaagcagtgcttgctcagaagcaggggcctgccttgtttggggtcggccactcctattaactcacactccttgtgtgtccgcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtaggtgactcgcagatgggcaggggggagaggccacgggcaacaaggggacttggcatgcggggctgagaagggagcacctggctcttgccaaattcattgcagtcaatatctgagcccgaaagaccctccctctcagggctgcaggagggctcgtgtgcggaaagccatgactgcacaagatgctatgggctctcttgaggctaggcccactgcagagggcggcagaaaccactgagcaacttatcccttatactgcagctgctcgacatgcaaatgtgagcctggctgcctttatacacagacaggcaagatccaaggtgctcaggcctgactgcccgtgagcatcacctggggagctttggaaacccgggacagattaactgatgattgttaaagctcttcgatgattttaacgtgtagcaaggttgagagccactagcctagaacaagcgagctttcagtcccactgtgctctgcctggtcagagcatctagtgcaatcccggcaccacattattagggacctttgacacactggaacaaacccaacagaggatgaccaggatggcaaggttcctagaaaccatttcctaggagaaccgtttcagggaattcgggaagaaaacctggagaggaggtgactttggagggtgcgatacacctctcacacctgcaacgggtgggatggggaaagggtggcaggctcagcccaccagcggacagatttcagctcacatggggaagaccttcccaaatgagctcttccaagatgagaggggcttgcctgaaaggtagtgagccccccatcatcagacataaccaagcagagactgtgctcatccgggcgtcaggctgtggtgcaggaggtggggcgttaaaccaggtggcttccaaggtttacctctcaaagtctggtattcctgtggcctcgatcatcctgcattcatttcacagaccttccctgagcgcctaccatgtgcaggccctgttctaggtacagggacacagctgagaaacagagcttctgctctcatgagctcacatcatggtgaggagagacagataataaacacatacatatataacacatcaggaaggtcaggagtgccaaagaaaaactaagcagggcaaggagagaatgagtggcgtgggcaaggagcaagacaaacagatgcctgaaaggagcgagtgccaggctgcactcagcttcccccgacccgctggctcaggagccgattttcccatagccaggcactaagcagccggtagggaggacagagaagcttaagggtcacctgctggcccttcccagcagaagcaaggcaggggcatgcgccgtgtttgcacagatacctcacccctggaaaggcagcagcaggcaatgggcagtgggcctgtctcagcagtttcaccagggagaatggtttctctgaaagaatagtataaaggttcagtgggtgtcagaaaggagagaggcaggctgggatctgctgatacagcatcagggcaaccccccggcccctctgagagccaaaccttctctggtttttgttttggttgttttttgagacagggtctcgctctgtcacccaggctggagtgtagtggtacaatcacagctcagtgcagcctggcgctgctggggtcaaatgatcctcccacctcagtctctggccttgctaagatcacaggtgtgcatcaccacacccagctaattattcttaaattttttgtagagacgaagtttccctgtgttgcctgggcctggtctcgaactcctgggctcaagcagtccttctgcctgggcttcccaaagtgctgggtgacaggtgtgagccaccgtgctgggccataagcaagtcttcatatatttgatgacagtgtttgaccaccccagccaaaacttctctggcctgcacatccctaattctggcagatgctccatctccacttgttccccatgggtgcccctcccaacacacacacgtacacgtgcacacacgcacacttccccaagtgacctaccagataccccctcgctctagccctcaagggaagagctgggctccaggagtaatgttcctttggttcttcatggctcccaccccgctccttcaggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccgggaaggggccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagctttacctttgaactcaagtgcttttctatatgtggttgggggaaagggaacaagttttctttagtttgcacaatgagcaaaggtatcaccagtgtagtcattattctgctctccacaaacaggtttggacattactgttttgcatatcttgtgtttgcttacatttccctcaatttttccaaaatcgtttgctgggtatgtttgtaccgcctcttgctgtgagagaccaggacctattttattccagtcttcactctgtccactctgctctggtcatctgatttggtacttctccaagaacagcccttcactgtgaggtgcagggaggcgttctgatgagc

SEQ ID NO: 14194 - DNA, 46843 bp, Human
  misc_feature (1)...(46843): n = A,T,C or G
atgcatccactgagcgctcaaatatagaccatattagaagttaagcaatgggttgagtggccaaccacattttggccagtcctacaagactttctttgacctaccaaatggggtataaatgcttctcgtattctccccgccagtagggactcaaaatcttaatagctcggggtagtaaaaaggatgctaggtttgaatcttggctttaagaaaactgtgctgaggtgttttgtttgtttgagacagggtttcactctatcacccaagctggagtgcagtggcgtgatcatagctcactcccaggctgaagggatcctcccaccacagacttctgagtagctgggacgaccggtgcatgccaccatgcccggctaattttttgtacttttggtacagacagtgtttcgccatgttgtcgaggctggtctcaaactcatgagctcaaagagatccacctgcctcgacctcccaaagtgctgggattacaggcacgagccactgcgcccggccagctttttttcttttatcagaattgatattaaactatatgctgagcttccatgtccttatcttccttttggcatggctatggccatttgaaatgtgtgggatttgctaaagtgctcaacatacgttgtttccttttttagatctaagtatgtagagggctctgatttgcaatatttagaaagttcttctaagctgggaagaaaagtcaagactaagaatcattgccaacagggccgggcgcggtggctcacgcctgtactcccagcattttgggaggccgaggcaggcggatcacgaggtcaggagttcgagaccagcctggccaatatggtgaaaccccttctctaataataatacaaaaattagccgggcatggtggcgtgcgcctgtaatcccaggtactcaagaggctgaggcaggagactcacttgaacccgggaggcgaaggttgcagtgagccgacatcgtgccactgcactccatcatgggcaacacagtgagactctgtctcaaaaaaaaaaaaaaaaaaaaatcgccaataggtagggaataagttaccccctgctaaataagttacactcacctaggcaaggaaggaactcataaaccaccttctaaactgcttgccttcctccccgaagttctgtaatttagaggcggtcactaccactgcttgaacaccccttcccaagtctgtaccacaaaaggagctcttgtgtagcccagcccctccttctcaggaccccaggagcccagacacactaatggggacattagttgcttacttttccagctactgcttaagctaggcaggccatgaagaaataacggtctcagtaacctccatgctcgggatacgactcccgggaagacgtgggtgggtgcggggaatgcggactgatccctcccagcggccgttgggggctggcccacaatccctcgcgagggcgggaaaagcaatgtggtcgttgcggggggggggggtcagaaaagggggacggtcagcgggaagagccaagagactgcaactctacaaagagcacgcagattaattctaatgattgttccctgagcttttcacaccaaaataatggtaactggctagtgtgtgcccgttacgctcactactcccactcgagatcattcctattaatgactctgaggcttcacctaacaggccacggtggaggcaaggaaatgtggcgtggagaacccactgggcctggctctccgtcctatggtctccgtccatcgttttacagtcagggtgtacatttgatgaggaatctctaaatgggattttggggaatcaaaacggaatggtgcataagtgtgaaaatttacaagactgcgcaaagctgcaaggcccggagccccgtgcggccaggccgcagagccggccccttccgctttacgtctgacgtcacgccgcacgccccagcgagggcgtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactgatatcttggggagcttaggtaacttttcatgctaactgggttaggaaatactggagtcagaattggttgtctaatttttgctgttccaagatccaaggggtaagggttaaatttcagaaatgcaggattttgtgtaggactagagacactaagaatgagaaagagagtagaatccccggaatcttgaggaagcatagaaagaatattctcttacgtaattaactgaaacacccaaaacctcatattccagagcattgcagatgggaaccactgcatcctgagacatacaaatatgaggctggcggtggtcacttgttgtgcacatctctctatgacatgtctggacctgtgctattcactgaagaagatggaacagaattttaagttactgcccttactgatggaaaatacagaggtttcaattcgcctctaaagaataagtctcgtggacccagccttaactgtttaagtcataccgcgcgcagactgtgtcccccaagatttgatgggctcttttttcttcaacaagttggcttttcaaagaagaaatgtgagaccctgaataataatgatcactaacaactattgactactttagatggtcttgatattctaccaagctttttacatgtatcgtctcattcccattttatagacgaaaaaaatctgagcaaaaaagaaaaagtgaagtaacttgcccaaagtcatgcagtaagtggtgccaggatttacaaacccaggcaatctaattccagcattcaggctcttgataggattttcatttcctaaatgctgtcatcaccattgtcttttattagccccatatttatggctcatattcttatcagatcaagcactgatatatcaaactgataagtgatgtcatcctcaccattatttcttcaccagcttgttttgtaattgccattttcttttctcaggccacactgtcagatgggtgaaattgtgtagtcgaggaagcataaatgtattctttaaaatgcttgtgccttgaataattgttctcattagtttggagtgatacatgaattttttacatcagttatttccatgaaaagtttttattataaataatacatgcatatgtgcttcttaaagttgtaccttgttttaggcagttaaaacatctattttcattctcatctgaaaaataatttgtataccttatgagagcgagataattatggcttcataagaccaaaagggatagtaaaaatatggtaatagtgagtacatttttatttctgcttcctgagacacttgtaggtactcagaaatgctttagttgaattgtttctgaggtaataggtaattctttatgtgatgactaagaaaacgaatacctttattaagctgaatttttttttttttttttttgagacggagtctcgcactgtcatccaggctggaatgcagtggtgcgatccaggctggagtgcagtggtgcaggttcaagtgattgtcctgcctcagcctcccaagtagctggaattataacgcgtgccaccatgcccggctaatttttgtatttttagtagagacggagtttcaccatgttggccaggctggtcttcaactcctgacctcaggtgatctggctgcctcagcctcccaaagtactgggattttaggcatgagccactgtgtccggccaaactgaaaaattaaatggttgatagaatgttgcatttttatgtttctccactcctagcatcactgttgtctacaaattaataaagacaatcgattatcatgttacacttttaaatctctaaaattagggttctttttttcttattttactttcagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttactatttgtgttacttcattatcccttcttgataaatgtatgcaattattctgatgtgaaaaagtgtttcttttgcaaattgtactgcagtcataaggttaaacaggaagtttctgcgttattcattcctgagactatatttgaaagtcagatgtttgaaagtagatttatggctaggggtagtggctcatgcctataatcccagcactttgggaggccgaggcaggaggattgcttgagcccaggagtttgaggcctgcctgggcaacatagtgagacctcgtctctactaaaaatggaaaattagctgagtgtggtggcacatgcctgtggtcctagctacttgggaggctgaggcaggaggatagcttgagccggggaggtcaaaactgcagtgagccttaatcacatcactgggcagcagagtgagaccctatctcaaaaaaaaaagaggccggggatggtggctcacacctgtaatcccagcactttgggaggctgaggcgggtggatcacctgagatcaggagttcaagaccagcctggtcaacatggcgaaaccccatctctactaaaaataaaaaaattagccaggcatggtggttcacgcctatagtctcagctcctcgggaggctgaggcaggagaatcgcttgtacttgggaggtggaggttgcagtgagccgagatcatgccactgcactccagcttgggtgacagagcaagactctgtctcaaaagaaaaaaaaaaaaggtagatttatgtataataaggggctccattttgagaggcctggaaatgattaaaatattcttaattggctgggcgcagtggctgacgcttgtaatcccagcactttgggaggccaaggcaggcagatcatgaggtcaggagatcgagaccatcctggctaacacggtgaaaccccgtttctactaaaaaatacaaagaattagccgggcgtggtggcgggtgcttgtagtcctagctactcgggcagctgaggcaggagaatggcgtaaacctgggaggcggagcttgcagtgagcctggatcacgtcactgcactccagcctgggcgacagagcgagactccgtctcaaaacataaataaaataaaataaaatatccttaatcttggttttataggcatgccctccccgaatccagttgatttacatatagtcgattggttcacattatatctggagtcatgaagagttagacatttctgttgccttggggagtatatttacatttataaaactttagtgatacctaacttgtcattatctggagttcaaaaacactaccttagatcatcatcatgatttggttgtttgtcatctttctgttgacagtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagagggtaagttagtaaatgatcttctttttttctgtattaataaaagtaatttgcatttgtgcccatctgagacctcagcaacactccatttggaatgtgaagcctaattactggacagttaactagtgttaaactcttttactactgttacaaaatgagaaatgccacagcctggactggcttttttttgttccccttttatggccctcacttcttcctgtaggagctttgggacaaaacctatgtatgtatttcagtcatcatactccatcttatcaggtgtaagttaacggtgccggacaccttaatataagcaactgttgttaaatgctttccaatgtataaggacttccatattggttttccaaaaaccaaaggtagctttgaaaaccacgtctgaggccggatgcagtgctcatgcctgtaatcccagccctttgggaggccaaggcgggtggatcacgaggtcaggagttcaagaccagcctggccaacatgatgaaaccctatctgtactaaaaataccaaaattagccaggtgtgatggcacatgcctgtaatctcagctactaaggaggctgaggcaggagaatcacttgaactcaggagttggagattgcagtgagcccagattacgccactgcactccagcctaggcaacagagtgagactactctgtctcttaaaaaaaaaaaaaaaaaaccaaaaaaaaaaaccacgtctgaaatgtttggattgttaagcagattgacttgggggctttgattatatagctgatttcataactgcactaattgttaaagtgtttgggaggtgttgttttggtgcttgttatgtgaaaataaagtgactgtaaaacgatttttttttttttgagacaaagtttcgcttttgctgcccaggctggagtgcagtggcacaatcttggctcactgcaacttccacctcctgggttcaagggattctcctgcctcagcctcccgagtagctggaattacaggcatgtgccaccacgcccagttaattttgtatttttagtacagacagggtttctccatgttgatcaggctggtctcaaactcctgacctcaggtgatcctcccgcctcagcctcccaaagtgctgggattacgggcgtgagccaccgcacccggccaatttttttttcttttttgagacagagtcttgctctgtggcccaggctagagtacagtggcgcgatctcggctcactgcagcctctgcctcccaggttcaagcaattctcctgccttagcctcctgagtagctggaattataggcatgtgttaccatgcccagctaattttttttttttttttttttttgagacagggtctcactctgtcgcccaggctagagtgtaatggcacaatctcggctcactgcaagctctgcctcctgggttcatgccattctcctgcctcagcctcccaagtagctgggactacaggcacccaccaccatgcccagctaattttttttgtatttttagtagagacagggtttcactatgttagccaggatggtctcgatctcctgacctcatgatctgcctgccttggcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggaggacagagcaagactccgtctcaaaaaaatgaaaaagaaaaaatgcagtaactgattggtttctctctgaaatatgtgcaaaatcaaacttttttttttttctgagacagagtcttgctctgtcgcccaggctggagtgcagtggcgggatctcagctcactacaacctccgtctcccgggttcaagccagtctcctgcctcagcctcccgagtacctgggattacaggcatgcaccaccacaccaagctaatctttatatttttagtcgagatgtgttttaccatgttggccaggctggtcttgaactcctgacctagtgatccacccagcttcccaaagtgctgtgattacaagtgtgagccaccacgcccagcctcaaactgtttgttttaaacatccaatctaagaaagattttatataattgttgccagttaaatatcaaattatactatagcattcaagagaaaaaatgcttcatttgaacattttttctaactgtgttttatttttttgtttttttttttgagacagagttttcattctgtcacccaggttggagtacagtgccgctatcattgcttactgcagccttgacctcccaggctcaagcaatcctctcaccttaacctcctgagtagctacgaccagagttgcacaccatcacacctgactaatttctgtattttttgcagagatggggttttccatgttgcccaggctgccgttaactcttaatttgtagtcctatagaaaaaagcaagaaagagaaacttccattatgttacttctgttcaatgaagccagtgactagaaatatgaaaaggcaggcattaaaacactagttgtatatgtttataaataattttacatagcctaatatgtaaggaaacagtggaaaaatgtgaaaataatagatcaggtcgggtgtggtggttcatgcctgtaatcccaggcgtgaatttgggaagctgaggtgagcagatcacttgaggtcaggagttcaagaccggcctggccaacaaggtgaaaccccgtctctactaaaaatacaaaaattagctgggcatggtggcgagtgactgtaatcccagctactcaagaggctgaggcaggacagtcgcttgagcccaggaggcagaggttgcagtgtgccaagatcgcatcactgcactccagcctgggtgacagagtgagactttatctaaaaaaaaaaaaaaaaaatcaagtggctgggcacagtggtttatgcctgtaatcccagtgctttgggaggctggggcaggaggatcccttgagcctaggaattcgaggttgcagcgagctatgattgtgccactgtgctccagcctgggcgtcagagtgagaccttatctctaaacagattaagagagacatcaggtggggggcggcgacggatagcattaggagatatacctaatataaatgacgagttaatgggtacagcacaccaaaatggcacatgtatacatatgtaacctgcacgttgtgcacatgtaccctagaactttaattaaaagatcaggaattatgaactgtttatagtaattttgctataatttgtcatctttcagttaaagaattttgttatccaaaggagaacattttgttattaaaaagcattgtttttctacaattgccaatacatccaaacaggtaaaactaattaagagtgttttgttgtttcagaacaccgaaaagctttggaggatttcactcttgataatattctttctcatatttattattttcgctgtcgtgactacacagagttactggcacaagtttatcttcttccagatttcctttcagaacactcaaaggtatgagtcagactactgaaatgtaactaaccaagtattttttgaggtgtttgataagcatgaaaaaataaccagtacagtagcataaaatcaaagtcaaagccaattgagaaaatctcttccttccttgacctacaatttatttatatttatatttgttttgtgtatgtatatgtatatatagtttatgctcagagtaagaaattgaaataatatagaagtttcatttccagtaatagtggaatagctcctatcaaaccacattgtatagaaaggtatgaaatgaaaaataaaaacttccttgtgctactgttttctagtgcctctccccaaaggtgatcactattggccaggtgcagtggctcatacttgtaatcccagcacttagggaggccatggtgggaggatcatttgagcccagtagttcaaaaccagcctgggcaacatagtaagacattgtccccaccaaaaaaaaaattagccgtgtgtggtgtagctgtagtctcagctaccaagggctgggtggagcaggcctgaggtgggaggattgcttgagcccagcagttcaaggctacattgagctaccgtgccatcatgtatcacctttttttttttttttttttttttttttttttgggtagaaatggagtcaactcctggggttaagcgattctcccacctcagcctcccagagtgctgggattataggcatgagccactgtgcctggccctttaattttggtaaacattatcagtgacaaagattctccttgactgaacttggccccatcctgtctttggcctacccagtccagtcttagcaaagaatcctgctgtcagttcagagagattctctcacatttgatagtctgagcacctttgatacctgatcacgttcctcattccccacctttgatatttaaatccttggcttgcctttatttatttattttttattttttaatttgatggagtctggctctgtcgcccaggctggagtgcattggcgtgatcttggttcactgcaacctctgcttcccgggttaaggcaattctcctgcctcagcctcccaagtagctgggactacaggcatgcgccacaacgcctggctaatttttttttttttttatatttttggtagaaacagggttttgcatgttggccaggctgctcacctggctggcctgccattagtaagaatcctgttcggtcagtttagcaagaatttccctacccttgatgtctcactgttagtaattgttcatccactgaccccttcaccttgctcttggttgtgaatccccagttgtccttgtattctgatttgaacccagtctctctcccctattgtgatacccctattagaatagtcttgaatacagtctccttactgttttaagaagtgttagaataattttttcttgaacacatatcgcccttcagaaagactgcaccaatttctactcttactgacaatatatgagaatgcctattacccatcatcctgaccttttgaatatttttgccaagattctgcatggaaaatgccatctctttgttattttatttattttaattaattaattaattttttttttgagtcgcccagcctgactaacatggcaaaaccccgtctctacctaaaaatacaaaaattagcctggtgtgttggcatgcacctgtgatcccagctacttgggaggctgagacaggagaatcgcttgaacctgggaagcagaggttgcagtgtgctgagatcgtgacactgcactccagcctgggagacagagagagactctgtctcaaaattaataaataaaaattaaataaataaatacaatagaaattaattttcttagagttctggagcctaaaagttcaagatcaaagttctagctgattcagtttctggcaagggctttcttcctggcttgcagacagccatcttttctctgtgtcctcatatgatagggaggaaaagaaggagagagtgaattccctggtgttttttcttttttttggggggggggtggagtttcgcttttgtcacccaggctggagtgcaatggcgtgatctcagctcactacaacctccacctcccggattcaagcgattctcctgcctcagcctccagagtagctgggactacaggcgcatgccaccacgcctggctaatttttgtatttttagtagagacagggtttccccatgttggccaagatgttctcgatctcctgatcttgtgatccgcccacctcggcctcccaaagtgctgggattacaggcgtgagccaccgtgcctgacccctaatatttcttcttacaaggacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttcttacaaggacgctaatcatcttagattagggtcccatctttatgaacttatttgattacttccttagaagtcctttctccacatacattcacattggggtttagggattcaacatacgaattttaaggggacataattgagttcccaggaagtttgcccctggccccttgcccccctaccccctacctgcccgccaaattcatgtttttcttgtatccattccatccacacagccccaaacgtcttaaccggttccatcatcaactctaaaagtcccaggcttcatctaaatattatctaaatcagagattggtgagactcaagttataattcatcctgaagtgaaattcccttccagctgtgaacgtttgaaatcaggcaagttatatgctttcaaaatacaatagtaggaaatgcataggatgaacattcccaaaaggattatgggtgcctagcaaggcaaatttcattggaccataaggctcaagaataatcctttgctggccaggcacggtggctcatgcctgtaatcccagcactttgggaggctgaggcaggcagatcacgaagtcaggagtttgagaccaccctggccaatatggtgaaaccctgtctctgctaaaaatacaaaaattagccgggcatggtggtgcgtgcctgtagtcccagctactagggaggctgaggcagaagaatcacttcaacgcaggaggcagaggagattgcagtgacatgagatcatgccactgcactccagcctgagtgacagagtgagactccatctcaaaaaaataataataattaaaaaaagaatgatcctttgctttgatgctctgccttccaggcccactgcagtagcagaatcaccctactgctctgtggggtggccctgccccttcctctctctgcaagggccccaccctctgaaaccaaggacgacatagcattgccccctgggcttatggtaagagtgacagctctgaggatctgtgatcccctttggcaccattctttccttttcttgaggaatagggcacattcacagtcaagtagctcatggttttctcttgtggaatcaaggaagtccaacagccttcgttcattctttcccacttactctgtcctctttacttcaaactagcagtgtttctgctgttataatcccttatctatcactggcttctgctgagatggctgattaacatcatggataatctatttatagagtcattgttcaaccgtacctttggtcttctctctagagcaagctttcttatttttagcaatatggataggctgagaattttctacatctctaagttctggttccttcttgctgaacaattccttcttcaattcatctgtctcctctttcatttttactataagtggtctaggagaaaccaagccacttcctctacactttgcttagaaatctcctgagataaatagccaatttcatttctcacaagttttaccttccataaaatactagaacacagccaagttctttgccactttatactaagcaccagctttccttcagtttccagtaacttgttcctcatttctgtataaatcctcaccagaatagccgggcatggtggctcacacctgtaatcccagcactttgggaggctgaggtgggcggattgcctgaggtcaggagttcaagaccagtctggccaacatggtgaaaccccgtctctactaaaaatacaaaaaaattagctgggtgtggtggcgtgtgcctgttaatcccagctactagggagtctgaggcgggagaattgcttgaaccagggaggtggaggttgcagtgagccaagaacgcaccactgcactccagcctgggcaacagagcgagactccatctgaaaaaaaaaaaaagcctcaccagaattgcccttaatgtccatattttcagtatgtgcctcaaaactgttccagcctttgcttattacccaatttgaaaatcacttccacattttaggtatttgttatagtagtaccttgcttctctcactacctaacccaccatacctcatttcttgatactaaaatttgttgtggtcacctcaggctgccataacaaaaatactatagtctgagtggcttgaacaacagaaattttattttcttacagttctggagactagaagctcaagataaggttctggctgattggtctctggtgagagctctctccctggcatgtagatggccaccttcttgctgtgtcctcatggggaggaaggaggaagagtgagctctttggtgtcttttcttcaaggacactaatcctctcaaatcaggatgtcattctcatgacctaattttacgttaattactaccttagaggccctctctccaaatacagtcacactgggagatagggcttcaatttacgaatattggggggacacagcagtggtcatgtgtggagtcatgaaaaatcgaatcaacctgtgcacatattcccagctgacgttgaacaaggtcatgttctgcctttttatttcagctctctactgtaaacaagtgtccttttcacagtctttataatgccacttttttttgcatttttgtgctttttattagtgttcacctgttcttcatcacttcaaccagtttcattttcttataattatcggaaattaccttatttgtgtgtttgtttgcatattaatggtcccttactccactaaaacataacctccaagagagcagggaccttctctcttatttactatattcttctctcttatttactatatcatccccaatgcctggaacagtaaatagcatataggaaaggaggtgtcaattaatacttgctaaatgaagaaacaaatactctaaataaaacaacttacttaggcattgcttcataaaagcctcttgtttaatccaacccttactagatagaaaaaaacatagcattggagtcttttgtttgtttacatttgggttagtttccagattctttttgatttggggatcttaaggtttatatattggtttatttttctaacttcactgtttattttttgctttggggggggctttcttttgaaagggttttgctctgtcccccaggctggagtgcatggcagggtttcaccacgttggccaggctggtctcaaactcctgacctcgtgatccacctgcttcggcctcccaaagtgctgggattacagatgtgagccaccgcgcccagcctgaaggtttttttgttttttgttttttgttttaggaaacataaaaagaacccggaaggtaaaattggtatatttaattgacaaatgtgttgttttaccaagactttttctttaagccttttcagaatgttttacaaagactttaaatgtgctttttatcagtaaagactgtgtacagtggcaagttaaagaaaattataattattcctttttctttttgaattacttttttttttttttttttttgagacaaagtctcactctgtcgcccaggctggagtacagtggcgcaacctctgccaccagggttcaagagattctcctgcctcagcctcctgagtacctgggattacaggtgcctgccactgtgcctggctaatttttgtagttttagcagagatggggtttcaccatcttggccaggctggtcttgaactcctgacctcgtgatccacctgcctcggcctcccaaagtgctgggattacaggtgtgagccaccgcgcccagcctttgaattacttttttaaagttgagaaattatcaaagcagagtccgttttaacttttagtgattattgcagaaagcactggctgaacagctttgtaactttccaaaagaaagccatactttagacagttggaaataaagccctgggttttaaggttttttcctgtaatggactatggtttttccaatgctatgtttttttctatctagtaagggttggattaaagaagaggcttttatgaagcaatgtctaagtaagttgttttatttagagtatttgtttcttcatttagcaagtattaattgacacctcctttcctatatgctatttactgttccaggcattggggatgatatagtaaataagacagaagaatatagtaaataagagagaaggtccctgctctcttggagagagagagcatttttattattattattttatttttcgtaacaaatctaatattatctcttctgtatttaggttcgactagtgatagtggatggtattgcttttccatttcgtcatgacctagatgacctgtctcttcgtactcggttattaaatggcctagcccagcaaatgatcagccttgcaaataatcacagattagctgtaagtattaactagtgaagagagttttataacaaagtcaagactgtataaaatgttaatgtctagaaatgtcaaaatagcgtttgcctgacaaataatatagacatgcagttttgagtaaagttacgtttggttggtttccattaaaaaattctggtcataagtgtcagttttcctggaaaataacaagcataattaatggactttgtggttgagcgcggtagctcgtgcctgtaatcccagcactttgggaggccgaggcaggtggatcatgaggtcaggagtttgagaccaccctcgccaacatggtgaaaccctgtctctactaaaaaaaaaaaaaaaaaaaaaaaaccaaaaattagcccggtgtggtggcatgcccctgtaatcccacctactcgggaggctgaggtaggagaatcacttgaacccaggaggcggaggttacagtgggtggagaacgcgccatcacactccagcctgggcagcagcaagactccgtctcaaggcaaaaaaaaaaaaaaaggactttgtttgataaagaaatgccacctttgttaattgcagtgtcttctttgtttaaatatactttggatgtttttcaggttaactcttccaacatccctggttttcttctcctttgagtctttgattattatgtggtatgtaatcacagattcagatggattgaaacataaccggtgtaaacaacctagatgctttgaggtagagctaaataactcttgaagatttgaaatgtgaggagagaagtaaatatcggctcagaagggaagagatttttttttttaaagttttacctcactcctctttaactgcttgtttgccattacttcccaccctgaatccacatcccaccactgacacaaatacacacatttgtctgggagtaagatgtaaggtcaaactgcttaacttgatttctttgtctttaccttaattagagagaccttagcacatacctgtaatacatcataagtaaataaagaacttcctcagtaaagtcattttaaagcatacttttttctttgaatttccaattttttttgccatatgctgaaaagcatagtgccctgtgtttgaattactttttgcttaaattaattgtaatttagccttttgttaatatcagtgaagagcctccagtagggggcactcaagactaataggttgcatagttccttatgtttttaacagaaatagcttcaccttttccgactaaaaaagcaatccaaacaataacatcaaatagtaggtagtgtttaagaagagtgatgtaaatataaacgtcctaacatggaagaagatatatacatatatgttattgagtgaagaaatttaagttgtatataaaatatatttaatgttacctcagtttagagaaaacttataattatatgtatgcatttatatttgtatatatgaagagaaagatctgaaaggaccaaaacattaacagtggctacttcttttttatttttttggagacagaatcttactgaagtgcagtggtacaatcagggctcgccacagcctcgacatctcgggctcaagtgatcctgccacctcagcctccctagtagctgagactagaggcacatgccaccatgcccggctaatttttgtatttttttttttgtagagatggggtttcaccatgttgcccagctggtcagaaggcggaggttgggctcaagcgatcatctgccggcctcagcctcctaaagtactaggattacatgcataagccactgtgcccagacttggcttcttcaaaggatgggattttgtagggttagggacacactttccctctcttactttataatttctttgcttgaaggttttttttcccaattaacatatatataacatgtatggcttttgataatgtattttataattttaaggccagatgtggtaactcacacctgtaatcccagcacttttggaaggccaaagtgggaggaccgcctgaagccaggagtttgagaccagcctgaacaacaaagcttgaccccatctctaaaaaaaaaaatacataaaataagaataattggccgggcacggcggctcacatctgtaatgccagcactttgggagactgaggtgggcggatcatgaggtcaggagttcgagaccagcctgaccaacatggtgaaaccccatctctactaaaaatacaaaaaatagtcaggcgtggtggcatgcctgtaatcccagctactcaggaggctgaggcaggggaatcatttgaacccagaaggcggaggttgcagtgagccaagattgcgccactgcactccatcctgggcgagagagcaacactccatctcaaaaaaaaaaaaaaaaaaaagaaattttaagttatgtatgctttttgtaaaagaaaaaaaaagttctaaacaataaaaaatgtaggaagcgattattcattactcagagattgtgtaaatattgttgtctggtgtaaatatttttgcagacttcatgcatatacaaacttacgttttagaaaatgaggtcataggccaggtgtggtggctcacgcctgtaatcccagcactttgggaggccaaggcgggcagatcacgaggtcaggagatcgagaccatcctggctaacacggtgaaaccccatctctactaaaaatacaaaaaagtagctaggcttgatggcgggcgcctgtaatttcagctactcgggaggctgaggcaggagaatggcatgaacccgggaggcggagcttgcagtgagctgagatacgccactgcactccagcctgggcgacagagcaagactccgtctcaaaaaaaaaagaaaatgaggtcatgccaccgcagtggctcacgcctgtaatcccagcactttgggaggccaaggtgggaggatcacttgagcccatgagtttgagaccagcctgggaaatatagtgagacttcatcgctacaaatttttaaaaaaatcttagccaagcatagtggcatgcacctatagttctagctacttaagcggctgaggtgggagtattgcttgaggctgggaggcaaaggttgcagtgagctgagatcgcaccactgcactccagcctaggcagcagagcaagaccctgtcttcaaaaacacaaaaagaaatgaaaatgaggtcatattatacatgctattatgcaaagcagttttctgtttttcacttaatatattgtgaacatctttccatgtatactactttttttttccatgtacactacttataagtctgctttacactaacagctgcatagtattttgctgtatgactgtagcataggttttttttgtatttgtatttgtttttgggttttcttttttatgagacagggtctcgctctgtcatccaggctagagtgcagtggcatgatcttggttcactgtagcctcaatctcctgggcttaagcaatcctttcacctcagcctcttgagtaactgagaccacaggcacacaccaccacacccagccaatttttaaattttttgtagaggctgggcacggtggctcacacctataacccaccactgtgggaggccagggcaagcagatcacttgaggtcaggagttcaagaccagccttgccaacatggtgaaaccttgtctctactaataatacaaaaattagccaggtgtgttggtgctcacctgtagtcctagctacttgggaggctgaggcaggagaatcacttgaactcgggaggtggaggttgcagtgagccaagatcacactgttgcactccagcctgggagacacagtgagactctagctccaaaataaataaataaataagttttttgtagagatgaggtctcactatgttgcctaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggccaggcacagtggctcatgcctataatcccagcactttgggaggccaaggtgggaggatcacttgaggccaggagttcgaagttaatctgggcaacatagcaaaaccctgtttctacaaataatttaaaaattagttaggcatgcctatagttctagctagtagaacttgtgcttgaactatagttctagctactggggaagctaaggcaggaagattgtttgagtccacaacttcaaggctgcagtaagctatgattgtgtcattgccccccagcctgggtgacagagtgagaccccatttctaaaaactattcttaagaaaagctgccggccgggtgtggtggctcatgcctgtaatcctagcactttgggaggccgaggtggagatcacctgaggtcaggagttcgagaccagcctgaccaacatggagaaaccccgtctttaccaaaaatacaagcttaaccaggcatggtagctcacacctgtaatcccagctactcatgaggctgaggcaggggaatcgcttgaactcaggaggcggaggttgcagtgagccaagatcatgccattgcactccagcctgagcaacagagtgagaccttgtctcaaagaaaaaaagaaaaagaaagaaaagctgccaatttaaattcctgcttagctttttctaaggtgcccgatgagaggtaacaaatggagaatgccctgtggcatgtaaggggaggggagctagaagaaaatcatgtcatccacttggtatctaattgagatctagatggatcacagatttctcctttgcggtgaaacagaaattttagggtgttaccactgcagtgggaacagccaaacaaccttttttctttcgcagttttctttttctttttttttgagttggagtcttgctcctgttgcccaggctggagcgcaatggtgcaatattggctcactgcaacctctgcctcctggatttcagtgattctcctgtctcagcctcccgagtagctggggttacaggtgcccgccccaacgttcggctaattttttgtaattttggtagagatggggtatcgccatgttggcctggctggtctcgaactcctgacctcaggtgatctacctgcctcggcctcccaaagtgctgggattataggcatgagccaccgcgcctgggctgtttctcggttttcttacataaaaaactcattttcagagtagacacctttttcttactgcttttcatggaatttcattatcagttttagtttgcaatattaactctttttttctggagggaagatatgtattagaagagtatataaagtaaccatttctggagatttggggatggaaagataacagatctgacttctgtgttaagtcagccttaaacgcttttgttttccctgctttatttaaaattactgtctttcaaaacctggaaccttttttgtaggtcagtatttatacaaagagaattagcaatatgaaaccttgagggccatctgtgagttgcaaagcaacacctgtggctgttaatagctgagtagcataatcataatttggagtcatttgacctgactactaggattttttttttcctagttcatctacttatattgtaccttctttatgagttttaagtctcttctcataatttgttgcctcagtttctttttttcctataaaattataaacagtaatactatatttgcttccttcctaaaagtataaacattgaggtatttgttaaggatttcatattcctttcaataaaaatattctagggaggcaatagtgataaagaacatggactcaggccaggcacagtgacacatgcttataatcccggccctttgggaggccgaggtgggtggatcacttgaggtcaggagttcgagaccaggccggccaacatggtaaaaccccatctttactaaaaatgcaaaaaattagccaggcatggtggcaggcacctgtaatcctagctacttgggaggctgaggcaggagaatagcttgaacccgggaggcggagattgcagtgagccgagatcgcgccattgcactccagcctgggcaacagagcgagactcagtctttcttttttgagacaaggtcttgcttggtcatcaggctggggtacggtgacagaatcatggctcactgctgcttcaacctcctgggctcaaccaattcctcctgcctcagcctcctgagtagctgggactacagttgtgcaccaccatgcccagctaattttttaaaaagttttttgtaggtcaggtacagtggcttatgcctgtaatcccagcattttgggaggctgaggcaggaggattgtgtgagcccaggagttcaagatcagcctgggcaacatagcaagaccctgtctcttaaaaaaaaagttttatgagctagatgtggcaaacacctctagtcccagctgttcaagaggctgaggtgggaggatcatgtgagtctaggacttcaaggaccacctgggcaacatagcaagaccccatctctaaagtatgaaaataaaatactttatgatcagtagaatcatattttcaggtaactacatctttttatgggtggatttttaatttttttttttttttttgagatggagtctcactctgttgcccaggctggagtgcagtagcgctatctcagctcactgcaggctctgctccccgggttcacagccattctcctgtctcagcctcctgagcaactgggactacaggcgcccgccaccacgcccagctgattttttatatttttagtagagacagggtttcaccgtgttagccaggatggtctcgatctcctgacctcgtgatccgctcaccctgttagccaggatggtctcgatctcctgacctcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccatgtctggttaatttttgtatttttagtagagatggggtttcacaatcttggccagactggtctacttgataattttcaaagagactcacctaattttcttacattttgtttttgtaggtaattttaaccaatcagatgacaacaaagattgatagaaatcaggccttgcttgttcctgcattaggtgggtaattaatcagataaacattttagtttatcacagtttttcttatctctttcatttgattctcattgagtactatacgcttcatgaaagcagactgtatttgtcttgttcactggttaatcttagcactaagcacagtaccgttagatactgattgttccttttagttatttaacatttattgagtggccagacacagtgtcccacacctgtaatcccaacaccttgggaggccgaggcggatcacttgaggccaggagttcaagaccagcctggccaatatggtgaaaccccatctctactaaaaatacaaaaaattagccaggcatggtggcacacacttgtaatcccacctacttgggaggctgaggagtgagaattgcttgaacttgggaggcgcaggctgcagtgagctgggatcgtgcatctgcactccagcctgggggacagagtaagactctctcaaaaaattgcgtatctactgtctggcaactgttgtgtcaaagattcttgcccccagggagttcacagtgttagggagaaggaaaggtgaatccacttaaatacaaatcacactacagtgaatatcgtggttttgttagaatgtagtgcttcaagatttatttccactaaaatcttaaagaatattctaccagagtcttggccaggtacagtggcttatgcctgtaatctcagcactttgggaggctgaggcgggtggatcacctgaggtcgggagtttgagagcagcctgaccaacatggagaaaccccatctctattaaaaatacaaaattagatgagcatggtggcacattcctgtaatcccagctacttgggaggctgaggcaggagaatcgcttgaacctggggggcagaggttgcagtaagccacggtcgcgccattgcactccagcctgggcaacaagagtgaaactctgtctcaaaaaaaaaaaaaatgtatctgcccttgactagttttcaactaatggcatagatcattctataaacagataatgtagtaaaggttacaatagaaagtacagggtactgtacaaaggacggattctaacctggcccaggtgagcaggatgaaaaggaggaaggttagggaagggagtgtaatagtctgtcatgtttcttccagctgtttttgtcattttctatcacccacttaagcaagagcttcctaatgtttggatccgctcaggggtaatcaaactcagcctttctcaaactcatgccctcagcacactatgataaatcagaaagcaaatttataaatttagtgagaattacagttgtcaagcagaatgaagtttatgttttctagtcagtttattttcttcccagataccaggaagttgggaaagcaggggttcagagttggtaagcagagaagcaaataaatggaaatggatgccctcaggaatattatgcttaagttgtgataattctgatgccctccttggtttactagcagaacgccctttaccttggatattgctaggatattgttcaatagaatggtcagttatgatagaagtgttctatgtctgtgctcttcagtacagtagcccttgctacatgtggctattgaggcatttaaaatgtggctaatgcagctgtggaatggaatgtttaattgaattttacttaaatttaaattgcacatgtggcaagtgactgccctgttgtgtagtgcagcactggataaacataactcctgtgctctagactccaatcccaccattagctttctgtttttgacagtgtttgctagtatgataggtcactgctcattttacattactatcagtttagtttcctttatatttcagaggctccctaatcccttaaagagatttaaaaatcaacgtagaccacttctgtatgaaaataagatggctgaatttgctttgattggaattaggaactggcgctctctttgctagttctggaatttggccaggatgcacatcaaaatctcattcctaccctcctgatttgcctcatgcaaactttgttgctgtgtctgttctttggtcttctattgctgtgtctcagctttagattatatgtcttgcgtagaaatggatcatcagaatgcaacaggcagaagacttagaattgcaaatcagtagggtaatgacaaaccctttgagctgagtgggactgaaaagtaacctaacatataacctattagtaattgttaaccatgaagattttcagtgctggacacataaattgctgagttcaactgccctctttgccctccaaatctagcataaaacaaattggtgatctcaggccagtttcacacctaatatgactaataataaaagtcttgtgtttcaggaactcagtttgtccaaacctgagcccatcatctctacctcacaaattatatccaccttttcatttccttgcactgtgtctgcatgatatgataatactcccaagcactattgcttaaatcttgagttacacttaatgcttttttttttggtcttttttctttttaatgtgaaatagaatatacaaatgaaaatgtatatttagaagaacaataataaatgtccaggtgcccattgctcagactgacaaatggaacattactaccccccaggagcctcgtatgctctccccccaagaggcaaccactatcctgaattttgtgtaattgtcacctagcttttatagattttactgtctgtgtatccctaatagttgcttatttctagcctttatataaatagaattatactgtatatgactgacaacttttgctcattattattttttgattcatccatgttgatgtgtgacactgtagttcatttcgatgacatgaatatgccacaacttaattatatattctgttgatgtcaaaaaaaaaaaaagaatattctaccagagtttttacttttcttctggaggtcagaaatacgttaggcttgatgatatggaaaattgacacatatatggactcagacaataaagttttctaaaagcaaatagagaataatgatttgcagtatttccctagataggtaaaaaccttgtaatctcaggatattactcattttccaggttttttgaaagcaagtatactttcgttatgttaaattaataaagtaagattatatttgatcagaggcgttctgagaaatgtataaccaagtcagtaaggccatatacagttattatgttttttactctcaggggaaagttggggacatgctgctacaatacggctaatctttcattgggaccgaaagcaaaggtcagtacagaaacaagttaataactccgaatattgggttaattatactgaatgaacacttacaggtttcttagagctagtcctgtggatgagatatacagtgacccatgaagtgacacttttgttgccttgtctgatatcacctagagcaaacatagaaatgtgttgttattactgcatatttagctacataggaaattctctggaatatttaaatgatggggcgcatgcacctgaaatgagtaggtggccaaggaatgccattttctaaagctcttcgaaataatttattagccatgtagaaggaggtgagtactctgtgttcctggaagagattgaaaaaaaaaagaataaaatcaggacaaaaggaaaattgttgaggttacctttaaaattaatttatttggaacatacgatggtttctcttatttgcttagtatatttcttgtatgaaattgtgtctgtttttttttttattttgtattttgctgtccagcttttattatccagttacttacctgcatttcacaagtattgttctttaaaagtatggcagcatgaaatctttgtatttgtttttaaagctgctgagcaagtgaacaaaccagcttttattttcttgaaaatagaccattgaaagctgtgaagtcttttctacacttctagaaaatgtcagatttatgctagcctctccgctttgtgattaattggtataacctagaggtcttggtttggaaatgctctaataaagggagaaattaaaatggcatgtgggcaaagatggaataaaaggtcacttaaatacatattgggcctagccagtgaaaatgtctattttttaatctatatttctttgttgttctacaaactgaaaaaaatcctgcctgaccaagttaggttttacggacctgaagctcataacagaatgattacacttctgtatatatcttttgcaactgatcgtgcagtttgggtcttctttaaaaatggtatttgcaaagagctcaggtagtgttttttttcccccacaatacgtagtgctttactattgactgtcgccccctaatttaaacacattttttactctaaaccagtatgactggtaaatcctccccctaattttttttctatgatcacaatttaaggtagttcctcctagttttgtaagtaagttgctgtatactagagtcacaaaaggagttattttctcggcaccaaaccttattgtaaagatttggcaacagttctccagctgtcttttgaacatattgcttatactttcccagttttaggttattctgtaaagcacattccgtcatttattttttcataggaattacgcctgagttagtatacagtagtcttcttcagactataattaaatatttactaataaaatgcatttaagaagaaaaataataggaacagagcaagatatttcatctttttatgaactcaacaggaggaaaagtttgccttctttgtcaagttctagaagttagcattgataagttatccaagagatcagaaaatcacgcttaccatgagttaaccattgtatgaattcaccttcttacaaatccttcccaagaaattagaaactaaagtacatggccggatgcagtggctcacacctgtaatctcatcactttgggaggctgaggtaggtggatcatggggtcaagagatcaagaccatcctggccaacatggtgaaaccccatctctactaaaaataaaaaattagctgggcgtgatggcacacacctttagtcccagctactcaggaggctgaggcaggagaatcacttgaacccaggaggcggaggttgcagtgagccaagattgtgccactgccctccagcctggttacagagtgagactccatccaccccctgcaaaaaaaaaaaaaaaaaacaagaaaatgatgtacaacaccaacactgaatatagatagattgggggaaatctgctgttctataatattttttctacatctcataagatcatttttttaattcttatttttattttatttatttttcatactctcattttagtgagtgcttgcttgtgctaggtattttactaggcactttaaatataacatttcagataatcttttcaataattatttgcagaatgtatacctattattattaaaagaaaaccaaggcccagaaaggttaactgaataagtagtaaataatagctactatttattgaatatttcttaactgtcctttattgtgcaaagcactgtatgtatatatgtgtacatatatacgtgtatgtatatatgtgtatatatatagattatatgtatatatgtgtatacgtatagatgtatatacatatgtatatatgtgtatacgtatagatgtatatacatatgtatatatgtgtatacgtatagatgtatatacatatgtatatatgtgtatacgtatagatgtatatacatatgtatatatgtgtatacgtatagatgtatatacatatgtatatatgtgtatacgtatagatgtatatacatatgtatatatgtgtatacgtatagatgtatatacatatgtatatatgtgtatacgtatagatgtatatacatatgtatatacgtgtatacgtatatatgtatatacatatagatatatatgtgtatacgtatagatgtatatacatatacgtatgtatatgtgtatacgtatagatgtatatatgtatatacgtgtatgtatatatgtgtatacgtatagatgtatatacgtatacgtatagatgtatatacatatacgtatgtatatgtgtgtgtatatatataatttcatgttattttccacgtaaatctttgaaatagtgttaccagatgagatcaggcacattcagggtggtatggctgtagactgaaaatagtattatctacattttatagctgactttataaacttttttattttttttgagacggagtctcgctctgtcgcccaggctagagtgcagtggcgcgatctcggctcactgcaagctctgcctcccaggttcacgccattctcctgcctcagcctcccgagtagctggtactacaggcgcctgccaccacgcccagctaattttttgtatttttagtagagacggggtttcaccgtgttagccaggatggtctcgatcttctgacctcgtgatccacccgcctcggcctcccaaagtgctgggattacaggcatgagcccccgcacccggccttataaacttttttttttttttgagagggagtttcgctctttttgcccaggctggggtgcaatggcgagatcttggctcacttcaacctccacttcctggggtcaagtgattctcttgtctcagcctgccgagtagctgggattgtaggcgcctgccaccacaccttgctaattttgtatttttagtagaggtgggatttcactatgttggccaggctggtcttgaactcctgatgtcaggtgacctgcccacctcagcctctcaaagtgctgggattacaggcatgagccaccgcactcggccatagctgactttatggagttcatttcttttcttctataataactgtttctagaaggtaattgtagtattgtgttgattgccagccaatctgaatatgtagcttactcctttttttaggtaaaatcttttttcttcaaacttttttttttcgggctgtggatatatgataaataatgtacatactttatgtaatcaaaataaattgacctcatttaatagcattaaagtagttttgttctttatcatttgaaacctgacatctttaagttgttaaagttgcatgaacttgagcccagaagttggagaacagcctggccgaaatggcaagacaccacctctatagataataaaaaattagccaggtgtggtggtgcacacctatagttctagctgtttgggaggccagagttgggaaaatcacttgagccctggaagtcagggtggcagtgagctatgattgagctattatacttcaggctgggccgcaaaatgggaccccatctctaagatattaaaaaaaaaaaaaaagttacatgaaattttgtatgctttatgctttttaaattttaggttattttaaaaggatggaaatagaaattcatatcagggaaaaatagttgtaaaaatgaacatttttcatttggagaggaagactaaaaatcttttttttttttctttttttttttgagacaggatctcactctgttgcccaggctagagtgcagtggtgcaatctcagctcactgcaacctcaacctcctgggctcaagcagtcctcccacctcagcctcccaagtagctgggaccacaggcatgtaccaccacacccagctaatttttgtaatttttgtagagatggggttttgccgtgttgcccaggctggcctcgaactcctaaactcagtcagtccacctacctcgnnnnnnnnnnnnnnnnnnnntagttttgttctttatcatttgaaacctgacatctttaagttgttaaagttgcatgaacttgagcccagaagttggagaacagcctggccgaaatggcaagacaccacctctatagataataaaaaattagccaggtgtggtggtgcacacctatagttctagctgtttgggaggccagagttgggaaaatcacttgagccctggaagtcagggtggcagtgagctatgattgagctattatacttcaggctgggccgcaaaatgggaccccatctctaagatattaaaaaaaaaaaaaaagttacatgaggccgggcgcagtggctgacacctgtaatcccagcactttgggaggccaaggcaggtggatcacctgaggttgggagttctagaccagcctggccaatatggggaaactgtgtctctactaaaaatacaaaaaaattagccaggcatggtggcgggcacctgtaatcccaactactcaagaggctgaggtaggataatcacttgaacccaggaagcagaggttgcagtgagccaagattgcaccactgcactccagcctgggcagcagagtaagactctgtctcaaaaaaaaaaaaagttgcatgaaattttgtatgctttatgctttttaaattttaggttattttaaaaggatggaaatagaaattcatatcagggaaaaatagttataaaaatgaacatttttcatttggagaggaagactaaaaatcttttttttttttcttttttttttgagacaggatctcactctgttgcccaggctagagtgcagtggtgcaatctcagctcactgcaacctcaacctcctgggctcaagcagtcctcccacctcagcctcccaagtagctgggaccacaggcatgtaccaccacacccagctaatttttgtaatttttgtagagatggggttttgccgtgttgcccaggctggcctcgaactcctaaactcagtcagtccacctacctcggcctcctaaagtactgggattataggcgtgagccacagcacccgtccagaaactaaaaatcttgaatagccaaattatattgggcattgaacttaggtgtgctgtctcatgccccagcccctgtccttcaccagtaacacctgatttttacccttagactaatgatggaataatattccaacagttattaaaagaaatacttttgtctatgtccttatattatgtgagttttcctccaatttgcatattcatggttatatgaggccaagattattcagaattacactactctttgccaagacgatctggtggtagagtggagtaataaatcaacacccccacacagtgtttcatatgtgtgctcagttttagagcacaaattgtgcttctgtcttatttcttcctgacccaaactatgtagttcagccatatgttaagctacatctcagctggggccatgagccaagtgattctttggtttagttttcattttaaaagatctctgaagagacatgatgcataaaagtggtatttttacctagaaatttgaggatgatttttttgttttgtttggttttgtttttgagatggagtttcgcttttgttgcccaggctggagtgcagtggcgcaatctcagctcactacaacctcggcctcccgggttcaatcgattcttctgcctcagcctcccgagtagctgggattacaggcatgcaccaccacgcctggctaattttttgtatttttagttgagatggggtttctccatgttggtcaggctggcctcgaattctcgacctcaggtgatccacctcggcctcccaaagggctgggattacaggtgtgagccaccgcgcccggcctgaggatgattttcaacctgaataattaatgcccctttgactttaggattctttttttgttttgttttgttttttgagatggagtctcactctgtcacccaggctggagtgcagtggcgccatatcggctccctgcaacctccacctccctgattcaagtgattctcttgcctcagcctcccaagtagctgggattataggcatgcgccaccacacttggctaacttttgtatttttagtagagacagggtttcaccattttgaccaggctggtctcggatgcctgacctcaagtgacctgcccacctcagcctcccaaagtgctggattatagacatgagccactgtgcccggccgactttaggattcttaacaagcatgtaaatgcttcttaaaagcttttcactttttaataatttcctcaggatagatgtactaggcaccttttttggacatactgttgatatgaggtgatttagataccaatttttcagaaggctagctgattttcatcattcaaaaaatgacttcttaataaggcaggttaaaatacaccttgcctctctttttctgtgaatttttgcattaaagatagattatcaaccctagggaattataaaagtttataattccactcaacacagctgttcttttttttttttttttttgagatggagtctcgccctgtcgcccaggctggagtgcagaggcacgatctcggctcactgcaacctccacctccccagttcaagtgattctcctacctcagcctcctcagtagctgggattacaggtgcgtgccaccacgcccagctaattttttttttttttttttgtatctttagtagagatgggggtttcaccgtgttggccaggctggtcttgaactcctgacctcgtgatctgcctgcctcagcctcccaaagtgctgggattacaggcgtgagccaccgcacccagcctcaacatagctattcttgtattacatattacttagcaattatttatgtttaaagttgcaattacagagtatagaacattttggattctgctgtattttggtctgtgtttttcttttgaattgtgtctgagaagaggggcaatttcaaaattaagagagtaacagatcatagccaaaatgtcctttttgaattgtctttgaaaacaaatcattctattttgtgtaagtaaatgacccttataactctgagaatcttattttcctctaggttagaatctgtattttttagatcagtttcattacattgtgctaaaacatgtatataacataaaatttaccattttatgtttacatatagttcactggcattaggtacattcatattgtgcagccatcatcatccattttcagacctttttcatcttcccatactgaaactctgtacccattaaatgctaactcattcttttttacccccagcccctgacaatcaccattctaccttctgtctctgaattttactcctctagcaaccccatataattggaatcatataatacttgttctgatgtgactggcttatttcacttagtataatgtcttcaaggctcatttatgttgtagcatgtgtcagaattttcttccttaagtctgcatattccattgtatgtacataccacattttgtttattcgtctgtggatgcacacttgggttgcttccaccttctggctattgtgaataagttacagtgtatcagttttaaagtaattcttaaaagcagtttttttttttttttttgagatggagtttcactcttttttgcccaggctggagtgcaatggcatgatctcagctcaccgcaacctctgcctcacaggttcaagcgattctcctgcctcagcctcccgagtagctgggattacaggcatgcgccaccacacccggctaattttgtatttttagtagagatggggtttctccatgttggtcaggctggtctcgaactcccgacctcaggtgatctgcctgccttggcctcccaaagtgctgggattgcaggcgtgagccaccgcgcccagccaaaaagcagtcttaaaggtttttgtttatatttgttgctgttacagtacttgaatatagttaataagagcttagaattttatttctcagctacttttagctttcagttttatattaattgtataagacataataaaatcccacctaagcagatcttgttctgtcatgacttatttttgggacataatcattttatattattatttttgtagagatgggggtctcactatgttgcccaggatggcttcaaactcctggtctcaagtgatcctcatgccttgccctcctaaagagctgggattacagacatgagccaccatgcctaggtgcatcattttaaaacaatgtcgtcctagctatttttattgggtgtaatatgagtaagtgtttctcatttgtagtataagaaattatcataattcttcagcaataattaaaaaaacatgattactgcagacagtttggaaaatataagcaagcaacctttaccttgtgataacagcttttaacttcttgattgtagtcttctatcaattcttttagatgtgcgtatacatacttataaatatgggataatacagtataactattatttagtatattattaatactttcctatctcattgaatattttcttccacgtttagtttttagcataagtaatatctcatcatatgtaaaataatttatttgaatcagtcattggacttttaggttgctttaaaatttcatataaactctgttatatacatacgggtaatttgaagggtgtatttttaatatttctctcctttttgtgttcttagagaaaaaatagaattattaatataataaacctatacatttaaataatgagtttggtcatctgaacttttaattaattaagttcatgtgtttgtatgtatttattctttttctttaagcaggttggcaacattgtacaagtcacccagccagaaggaatgcacagtactgtttcaaatcaaagtcagtattatttgattagagtgggattttgatattgatgggcggtaattatctaaagagagaatttacaacttgcttctgtcaacttctgtaggcagcaagcatatttgaggacagcttttgatgcttagaacattgtccccaaaatagtagtatatacagaatattgtagtcacaaatggactgaaatttattcttaagagcagaggaaatacttattttggggtagtgtgttccatgccatatgtaatgtcaggatattaaaaatctttaaagtgaaagttgttgaagatttccagaaaagaaaaaatactaacattacttattttggtctgtaggtattatagatctattgtagcaccaaatatagcccactttaagatgttaattcttctgtgaatttacatcatagaacacacattttttggctgaaatatgcatatttatcaatagtgttgagccaaatatatttttggcatctctttttttttgagatggagtctctgcgtcgcccaggctggagtgcagcggtgcaatcttggctcactgcagcctccgccctactggtttaagcaattctcctgcctcagcctccctagtagctgggattataggcgtgtgctaccacgcctggctaatttttgtgtttttagtagagatggggtttcgccatgttggccagactagtctcaaactcctgacctcaagtgatccgcccttctcagccttccaaaattctgggattacaggcgtgagccaccgagcccggctttatctcatttttataacaacaaaaacagaaatagagattctgaaactgaattatccacttagtctttgcagtacccaggtgtacttgaaatatcctagttggggaaaaaaaagagagagagaaatatcatagttggaaaactttagagtatttaattatgaaaataaatctgtaaagtacctaagacttaggttatttccttttacttctaacaaagctatcgtaaagtttgttaggattgacctttagagaacatttttataatgcaatgttatttctgtgcgtgtgtatgcaagggtataaataagtatatataaaatactcttaatatagcccgggctttggcacgtatccatgaggtttattctcttcattcacagtggttgataaatttctatctcaagaactttctttttttttgagacgaagtctcactatttcgcccaggctagagtgcagtggcacaatcttgtctcactgcaacctccgcctcccaggttcaagcgattctcctgcctcagcctccagagtagctgggactagaggtgtgtgccaccatgcccagctaatttttatatttttggtagagataggggtcaccatgttggccaggctggtcttgaactcctgacctcatgatctgcccacctcagcctcccaaagtgctgggattacaggtgtgagccactgcgcctggccctagaataaagtagctttcttattagttacttaaaaatatttctaagatcagtcttcaaatgttcttaaagcatatttgtatatatattttttatctttcagcctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccagatcatatgaagtgaatgggaaaaatacctaaatatgattctgtgaaagtttttctaaagcagtattctgcaattatattttaccctgttttcattttcagtaacattcagtagagatgattattatatttcacaaatgtggaaagctgatctcatgtggccagtctgaatttaccattcatactgttttcacccctttctttcccagttgcctataaaatcttaggaagaaacatatcatattcttattgtgtttttttttttttttttttttttggagatggattctcgctctgtagtccaggctggagtgcaatggcgcaatctctgctcactgcaacctccgcctcccaggttcaagcgattcatctgcctcagcctcccgagtagctggggttacaggcacctgccatcgtgcctggctaattttttgtatttttgtagagacagagttttaccatgttggccaagctggtcttgaactcctgacctcaggtgatctgcctgcccctgcctcccaaagtgctgggattacagtcgtgagccactgtgcccagccatgttctttttaaatgtaaatttgataattctttaaaattacccgcttttataattataaaagagaagccagcaccatgagtcagcatattattctgttcagttttataggtaagatacaaattttaggtgaccaaactgattttagtgacctcaatcctaaaatctaagccatttgtttagcttttaatgacattttataatgttaaagggaggactttggagctgttatctcatctagagattgtttggaacatatgtcttccagaataggttgataagctcacaatcatttattgctacgtttttgtttttgttttgagacaaggtctcactccgtcacccaggctggagtgcagtggcatgatcatagctcactgcagcctcgacctcccgggctcaagcaatcctctcacttcagcctcctgagtagctgggactacagggaggcactaccatgccctgctaatttttggatttttttgtagagacaaggtctcactatgttgcccaggctggtctcaaactcctggtctcaagcgatcctcttgccttgtcttcccaaagtgctgggattacagatgtgagccaccacacctggcctcatttctatattttgaaacacggtatgatccattctagaattctagttgttatgttgacatttttctttgaataatcttaactttgcttaaataaattaaagatttcaattctcgatggtttcaaaatcacctaaaaatattttcacacttggctcttagtacttttcaacttactcacaaaatttactttggttccctgtgggggaaaaaataattaattttgggacagaatctcgctctgtcacccagactgcagtgcagtggcacaatcttggctcaccgcaacctctgcttccagggtttaggcgattcttgtgcctcagcctcccaagtagctgggattacaggcatgcaccaccgtgccaagctaatagtttgtaattttagtagagacaggtttctctatgttggctagggtggtcgcgaactcctggggctcaagtgacccgcccacctctgcctcccaaagtgctggaattaacaggtgtgagactgcgcgcccagccatatttatatatttatttttaaactattattttaggttcaggggtacgtgtgaaggttggttacgtaggtaaactcatgtcacgggtttattgtacagattatttcatcacccaggagttaaactcagtacccaatagttaccttttctgcttctctccttcctcccaccttccacccttaggtagtagaccccagtgtttgtctgttttgttttgttttgttttgttttttaaatgcaagcttgctctgtcacccaggttggagtgcagtggcaggatcttggctcactgcaacttccacctcctgggttcaagcgattatcccgc

SEQ ID NO: 14195 - DNA, 5114 bp, Human
tgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaacttcctgtatcctgttgtttgtgttgctctctccagggctgggggtaggaggatgcaaggacttcctggcctagctcaccctggagaggtttgttgagtgcaaaggactagcttgtgccccacctcccacccacccagcagctaatctggtccctcccaacaacatggaaatgattaccctgtaccgcattctggttcagatttgggggtagggtgaatgcagcctgaggaggccagggagggaggactccggcagcgtttccttggcctcggcgagctactgggctccacttaaggaggctggggcagagcttccaggactctgcccggttagaaaacccgcacgagggcggtgccgctttggagacagggaggagggagaccggaagcctagatccctctggctgtcccctgcactgccggtaacatggcacaggagaggagggctgtttgtgcacgggcagctcctgcagctgctgccgtcgcccaccagcctcctatgccaaaccccacatcctaactcaggaacctctgagaaaaaacggagccctcgagggccccagcccttggaagggtaacctggaccgctgccgcctggttgcctgggccagaccagacatgcctgctgctccttccggcttaggaggagcacgcgtcccgctcgggcgcactctccagccttttcctggctgaggaggggccgagccctccgggtagggcgggggccggatgaggcgggaccctcaggcccggaaaactgcctgtgccacgtgacccgccgccggccagttaaaaggaggcgcctgctggcctccccttatagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggtgcgccgggcggagcggggcggggcgggggcggacgtgcagtagtggctgggggcgccggcggtgtgctggtgggtgccgtcggctccatgcgcggagagtctggctactctctcgtttcctttctgttgctcgtagctgctgaaattcctctccgcccttgggattgcgcatggagggcaaaatcccggtgactcatagaaaatctcccttgtttgtggttagaacgtttctctcctcctcttgaccccgggttctagctgcccttctctcctgtaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaactgtgtgtatgtcctgtgtcattgtcatttgggaattctttttcttttctttttttttttttttttttgagacggagttttttgctctattgcccaggctggagtgcagtggcgcaatctaggctcactgcaagctccgcctcccgggttcacgccattctcctgcctcaacctcctgagtagctgggactacaggtgcctgccaccacgcccggctaattttttgtatttttagtagagacagggtttcaccgtgttagccaggatggtatcgatctcctgacctcgtgatccacccgcctcggcctcccaaagtgctgggattacaggtatgagccaccgcacccggcctggcgatactttttctaacctcattgtcatagtggtgggaacttaatcctccttcccttatcctagccaagtctgaactttctgtccttttgtctgcagcgtgtaggatccactctttcctttgtgggaagtctggctcctggcctgcatttctgccttcaccagaacatgcaaagggccatctcaagacccagttacaacaaagtccttacttcaaaaaagacacaaggcaatggttgactgcctaactcaaatgatagacttctgactacttgctgcacgctgaaatgactgtcacaaaataacatgagcccccactcacatttggagtcatggcctctccaattgttaggtccacacaatcccattttacacggaagctcatgcaatgttataaattctgttatctggctagatctttccatgttgctaccaagtgcctgtatctgctgtgacgatgatcttacaagtttctgcctcatatattcaagagtgagaaaactataatttaactggcccttctgactatgccctgcccaacacttaacgtgcaattaattgcacattcaggcccaggataagggcttgtctttgaagccagctgctgcttctcgggcaccactcaggtccagcctctccatctgttgaccctgctgccaataatctttaattttttttttttttttttttttttttgagacagtcttgctctgttgcgcaggctggagtgcagtggtgtaatctcggctcactgcaagctccgcctcccgggttcacgccattctgcctcagcctcccgagtagctgggactacaggcgcccgccaccacgcccggctaatttttttctattttttagtagacggggtttcaccgtgttagccaggatggtctcgatctcctgacctcgtgatccacccgccttggcctcccaaagtgctgggattacaggcttgagcagcaataatctttcaagacagatttggagccatttcctaacgcagtgcaggggactgcagggcctgggtgtagcttccgcttgtgcaaacaggtacccagagacatggtagtgctgttcacccgctgactgtggaccagaggttctggagtcccagcatttgtgttcaaattcgtgactcaaggtccttcttagtctgaaccaactctcaaggacttttcctcttgccctaagcagtgatctttgctgctgctttccccctttgtctgcccttaggtcactaaggattgtagggccttctggacctgctctggctccatcctgagaactcctgaacaggcccacctccctctggttctctctgccccagcctttgagtcccccttggggtgacccaggtagaactatcagcttcccctttggacctcactctacttgtgttgttccttggaactctcaggagtctcactcttgcccaggctggggtgcagtggcatgatctcagctcactgcagcctccacctcccaagtttaagcgattctcctgcctcagcctccccagtggctgggattacaggtgcctaccaccatgcctggctactttttaatatttttagtagagatgggatttcgccatgttggccaggctggtctcaaactcctgacctcaggtgatctgcccgcctaggcctc

SEQ ID NO: 14196 - DNA, 111454 bp, Human
  misc_feature (1)...(111454): n = A,T,C or G
taaagaattaagattgacatgaaaaagcatttataattgatagtatctttgagttcaaagctctgcatatctcattatcaagttcaaagtaatgctgtcattttttctcagtaacgatgctcttatctccaagatgacaaagctgacgggaacaagatcaggaagccgagtctgggggttgggagttgaaccctacatctcctgactcccagaccccttttctggtgcctctttgtcactcaagctgtcaaacacctttgcacgcagcagtgtcccttggctgggtgtggtggctcatgcctgtaatcccagcacttcgggaggtcaaggtgggaggatcgcttgagtccagaagtttgagacaagcatgggcaaacatggcaagatctcgtctctaaaaaagaatacaaaaattaaccgatgcatggtggcatgtacctatggtcccagctatttgggaggctgaagtgtgaggatcactcgagacactgcatgccagactgggcaatagagcgagaccctgtctcaaaaaaaaagtgtccctcgtgggtttggttgcatgagaatgcttggtgttcaattcttgaggttattagaagattgaactttgaaatcatcccgcaaccttgaaccaaaaggtgaaattgtccactttgatagatgacaacggaaggatcctttggttcaatggacagcttgtaaatataaaacagttgctggaaaattatattagagatgagctatctcctccattacaatgtttgcttttctttaatgcgattgagttccaacagaaaggcttgggaggggccacaagcaatgcttcaggagttactggaagagagatatggggagtgagagaggagatccatcgatgtggagcaggggccaggggaggccttctgcccaggaggcctgtgctgaggaccctggctgtgcccaagggaaactgaattcagagctcctcctgcatcataaatccaggacagctggcagctctccaaggaagactggcgctaaactccaagggcatcagccgccagattggccaacccctacaatgccctttgagagctgagccccaggtgtgttgaatcgggattccgttccaacctcatgaccacattcatttacaagccctgcattttgttaatttaaaaatgcactcaccaggagggaaggaggagaggctccattaaatataagacagctgaaaggctggaattcttctgacatgcatgtcttaggaaggagaaggcctgaccttgttctttttttttttgagacagggtctcactctgtcacccagactggagtgcagtggtgcaataataactcactgcagcctctacctactgggctcaagtgacgtgacctcccacctcagcctccccagtagctggaactacaggcacatgccaccatgcctgggtcgctatgttatcggggctggtctccaacttttgttctccagcgatcctcccacctcagcctctcaaagtattggaatacaggtgtgagccaccgagcctggccaggcctgacttctgaatgcattcgtttcttgatcttttaccccgagtgcacgtgcaagttgcacccctggccactgggttttgcagagtgtggcgttccagtgtccggggccccacgcccgtccgcaggctactggaatgctgagggcgaggaggcttcgctccacgcacaccggatcggcctgcacttcaggggccaggtctacagccttccccagcgcagacgccgccggcccggccggttcccgagggcggggctgcgcggcctcacgccccgcccaccgcgggcagaggcggggcatgggtcacgtgacggcacgccgaccagcgaggccccgcccggcgggaggaggcccggccgcgacccgggccgcgcgctgaggagccgcccggtcgcctgcgcgctccctccggcggcgtccccagcccgcggcccctctgctgccggcccccggctcgccggctgcgggagtggcctcaagatggatgaagacggcggcggcgagggtggtggcggtgagtgtcggaggtgtggtgggctcgccggcggcctggggtcgggggccgggggctgggggtcgagggcgcggcgctgggccggggttcgccggaggagacggggtcgggggcagcggcagcggcgtccgctggaggcctgaggcacgccgggccagggccgaggctgggtctccgggggccgagggagggggcgggccggggtcgccgttcggcgctggcgagggtctgggtaccaggccggggctgccgcgggctggggtcgccccggagtctcgggccggggtttgggtgtcgctcctctggggcgggggaccttgcggggcgaccttccccgcatcttgtcgccaagggcgttcatgccctccggagcccggcgtttcggacgccccctttcagctcaggtgggcggaagcggctgagccggtgggaaaccgggaggggaaagttttgcactggaggctcctcgagtgtacaggacgggagggcaggggaaacggttggaaagcgtgacagtctgcttggctttgggtcagaaacggtcgctggatttgctcgaacggggagggggccagctggagttcagttcagggtagacgttttaggaaacggcagacgcgacagattgagcaaaaaactccgtggagccgagggtgggagacacgagctgcacccagcacagaggcaagaccggagagccaggtgtgcccggagccaggtgtgctcccgagtgggtcgggtcgatgcgcgtcgtggcccaggtggtctgtgtctgacgttcggtttcctcttgctggaggaatcgtgtttgttggaaattatttagtggaatacaaatgactgctgggtcatgctgggaattagattttaaaaacagaggaacgtgcctctgtatggagtgggtgttcgctttggaaagcaaagggttaatgcccgtgtttttacaggaacagccgaagttgaggttctctagactttttttttttttcctgaagatctcctttgagctgacagagaaatcatcagaatcatcagaaccccatgtaataagggagcagtttagagaaatcttaattacaggctgccggtgcagctgcctgtaagaatcagcagtattgaatgcttcaggatgaagtggttcatcatcaaggtgccttccagaattcaagtgctgctcagagggagatgtttttttgctgaaagacgcgatgcagccaggatggtgggaagttggcacccgtcatggcatttggcgagttcagttcttatagttgaagctaggggtagcactgtggcaccgagtgggtgtgttgatgggagcgctgtggaacgaaggcgcccagttgcgaaccctcctacagtcaggctgtctggagccatgagatcctaaggaatgggttcccggtggatgtcgtgtttcctgcctgtcacaatttgggcatagctgttttcccttgttagaaaagaaagacaactgtaatatgcagacgttggacattagcgtcaaggcagctagctggcttggcagttttgtttgtaaggtgctttgggctctgtgagtaaagaaatgtagacttgaagattaaagcaggaataaagaggaaaagaggaggctttaatgtgctccagcaatttgcaggtcttgagtactataacaaaggatgatatgaagtatcaaaagtcttaaaattgtccttgggttgttagtatctcttctgggaatatatcacagggaagcaaccttgaaataaacccctcacgtataaagatgtgtattatgctgtttaaaatagcaaaaaattggaaacagcaacgccaacagcaggggcatggtgaggtaaattatgggaagtttattgaagtattttacaaccattaaaataagcagttttatacatcatggtttaaacaacataaacattggtgacattatggattattttattttctttttatattttccaggtttctggaataagtgtgtatttcagattggaaaaaaaccatcaaagacgtgaatgttttaagtgtatcatttaattcatctcactggaacattcaacaatgaagatttatttattgattgcccatcaaaatgctagccagcatgttaggtgctggaaaataacttttaacctttattgatttagtttatgactagctttctcccttgctttgtgacagacacttaaaaatatttttggcaatattaggatatttatttttgaaacaggtgaaaagcaaagttttgaaatatgagtgatattgtaattattgtataaactttatgtgcttacatttaactcttggctgttgtaagttttgaagttaacatacctctttacagttaataccgtttagatttttaaatgctttaaaattcatgtttaaaaaaataaagttgagctcttttaaagaaaaccgtttcagctgccagcagattataaagcataacattttttggtatatttttagagtgtagtacataatgttgaactgtatctgggggagtcagttaaagcttgtttaaaagatagggtaaataatctattcaaacagtagttatggtagaagccaaagataattgaaaaggtcttttttttgttaatggtcaggttaaaagacttgaaaaattgattcctacttgctatttttataagttaatttagctttttgtccactgtattgttctttcaatgcaagataaggagagagaggatggtggcatgaatggctggaaggcagttacaagaggagcgagtggggggcacaagattacaagaacacattgttccttacagtgtgtgcagagtgtagttaagtcgtttttaattcctatgggactttgttgcctttcagtttttcgagaacagttcttgagctaattggagggtagctggctagtttggctcattgggattgtcttcgtgtcctgtttgggcatttgtctgattgatggtcctgaatggaccatccctggcagatgaggtgaattaactataattggcattcttctctctgaccccttcactccctgatcaatgtaggtgtctgtgcttcaggtgaagagatgctgagccttgttcataataaaatacatgcaaattaagactagattgagctcccacctttcaccttcagacaggtgataacccccaagtatacaaagtctgtttcaagtttgaaatatttgaacggcaaggtcgtttcaaacatttacgggtaagagtgtaaagtagccacaggcagggtcagcccatgtcctgttggctcagatccgtttcttgccctttccctgcagggactcacccctgcaggcaacatttcccaggcccttggtcagctggcttccggctgggattggccactgggagccactggcaggaggaatggcaggaagaaggacaaaaacaggttatttcccttaggcctgcctcagggagtgtctctggcaggtaccttgtctccttttggctccagctcctgccccttggtcctagcctttgagtcttggaaatacctcctcccttttaccctctatttgagaagtggtaacagcagcttgctcttgataatctttgtattatcatttcctgtttggcttttcagtttttccatcacccctgtcactaattccttatattaaattccctctatatcagattcttaaagggatggtttctctggatgtctctgtttctctgggtggaccctgatagatacaggtgctttaggcagtagctttaaaaattacaggcgtgtaaatcctttgacccagcaatccagttctaggaatttaacctgcagatatatttgtacacgtgtgagataacataggtacaagattatttattgccttgagtgtccatcagcaagcaagagacttatcagataaatccatgcccagatggttaatgaggttgtaaagttgtagaaaggaacgaggaagctcttttcttagttgacatggagagatctccaaaatatcttaagttacaagagcaggccgggcgcggcggctctcacctataatcctagcactttgggaggccgaggcgggtggatcatttgaggtcaggaattcaagaccagcctgggcagcatggtgaaactccgtttctactaaaaaaatacaaaaattagccgggagtggtggtgcgtgcctgtaatctcagctacgcgggaggctgaggcaggagaatcgcttgagcctgggaggtgcaggttgcggtgagtgagattgcgccactgcattccagtctgggcaacagagtgagaccctgtctcaaaaaaacaaaacaaaattacaagagcaaagtgtaggaaagtgtgcattgcgtgctcccattcttgtgttttgaaagaggaggtaatggctgatgcatgcagattccctggaaggtgaaaggaggaaccaataacaatggttacctgattggggaagatgatgggaactgagtggatggggaatataggtgggaaggaaacttttcactatgcgcctttttattttttgaaattcaaaaaagtttgaataatctgtcttcactttttctaaaattggaaagcagtttcatagaaaaatagtatgatggtaagaaaatacccattttacaccttttttgagggaatttttatagattaaaaaatacagctgggcgcaatggctcacgcctgtaatcccagcactttgggaggccaaggcgggtagatcatgaggtcaggagttcgagaccagtctggccaatgtggtgaaaccccgtctctactaaaaatacaaaaattagccgggcatagtgatgcgcacctgtagtcccagctgctcgagaggctgaggcaggagaattgcttgaaccctggaggcagaggttgcaatgagccgagatagcgccactgcctggcgacagagtgagactcggtctcaaaacaaacaaacaaaatattctgggaagaccgcaacaaaaagataatgtgatatgcaatgtaaggttataaaatgttacctatttttcattctgtagtaagttaactactgtatttttgagagtttaaaaagtggatgcttttagattatgcttagagtatattcttttgtagtcatttactcaaatgttgatggtgtctctaccaaataccaggttctatgcatggcacaagagctattagtgcctgtgtcatgccgtttttgcattgctataaagaagtacctgagcctgggttatatataaaggaaagaggtttcatggactcatggttgtgcaggctgtagctgtacaggcatggtgccagcatctgctcggctcctggggaggcctcagggagctttttactcataatggaaggtgaagcaggatcaggcacatcacatggctagagcaggagcaagagggaagagatgccacgcccttaaacgaccagatctcaggagtcctcactcactattgcaagggcagcactgagccatgagggatctgcctccatgatcctgtcgcctcccctccaagtcctgcctccagcattggggattacagttcaacatgagatttgggcggggcatatatccaaactgtatcagtgcctaacagtggtgaatacggcagataaatttcccacgttcatggagctcatgtttagatggagagacagacaaaagaggtaaacagctatatataaaataatcatgtattatgctagatgtgttaaaggaaatcaacaagaggttgaggaagagaaagtgtgggatgggagaggtgtagggaaagcccgtggccagggaaggcctctgaggaaatgcccttcgaggtgcaatctataggggtagtggaccagacagaagggaaggcatggagctggcaagagctgagtattctagagaattaaaagcagctttgtgtggcttgaacagacagtgaagcgggagagatagactggggccatgtcaggctttcagtagctaaggaatgcagattttattctaagtacatgaagccgctgaaagatttttaaacggggaaatctcatttgatttacatttcaataattttagctaatatttacttgatgctgtatgtcctgtgtactttctgcgtcttaatttattgactcttcatcatattgctattttcagattggaaaatggaggcatagggaagctaagtaattggtctgaaatttcacagctagcaggtgatggagctgtgattggaacccaagccttccatttcagaatccgtattctcaaccactgccccctgctttttaaagaagcatattcttgactcctgagtggagagtggtttggaggagaagggaggacttgggagaagggaggtgttgcagtggttcaggtgagagttacggggcttggtgggttagggtggtagtgggaaatatggagggaaggatatatataaaacacatctgtataaaacatacagaaaagtacaaagaataatgaaaccagcactcttgttcccactactcagaattgacataatagctgtcaatgttctgttgcattttttaggtccgttttttaaaaaataaagcattactggtaagtctctccatctcagtatattgtggtgttcttccagttgctcaggccaaaattttggtgccatctttcacttcttttgccttaagccttctcatggttctcccattgtcatccttgttcacactgcagccagggcgattccctttgacacgcaggtcatgtcactcctctctgaaagtttgctctttcctcggtttattgagaatcctattctcagaccaccttaccatggccatggcccacacgctgtagtttaggggctgcaagttcttcttcttcttttttttttttttttttttgaaatggagtcttgctctgtcacctgggctggagtgcagtggagcgatctcggctcactgcaacatccgcttcctgggctcaagtgattctcctgcctcagcctcctgagtagctgggactacaggcgcgtgccaccatgcccggctaattttttgtaattttttttttttaatagatacgggtttcaccatattggccaggctggtcttgaactcctgacctcgtgatctgcctgccttggcctcccaaagtgctgggattacaggcatgagccaccacgcccagccaagcttttttttcataaaagggccggatagtaaacctcataggctttgtgggccacatatgatctctgtcacaagtctttttttttttcataaccttttcaatatgtaaaaaacattctgaccttggggactgcccttgactactactctagtcccctgctatctctttgacattgtctgttgctcctctcccgtttcctccctgactctgctctgtctcattggtctccttgccaagcacactcctgcctcagtgcctgtgcacttgctgcccctgtagtggtttcctcttagatacctgcatgtggtgtatccttgcttcattcaagtttgtgctcaaatgtttccttatcacagaagtcttccttgaccaacctatctaaaatcacattcattgttactgtcagctctatttttctcccttagcacatgtcacgccttacctattacatatttgtttcttttctcttacaatgtgagttctgtgaaagtaagaatattttctgcttttatccagttatatctccaagatctagaacagtgcttggtacatagtagcctttcagtaaatatttgttaataaatactgaataaagttgaagtcacttgtgtctagcaatccctggtccttttgctctttgctttcaatgtttcttagaggcagccattatgaattcgatatggggccctctggtgtatggtgtttttgttagttttttgagatggagtctcactctgtcacccaggctggagtgcagtggtgtgatcgcagctcactgcaatctccatctcctgggtgcaagcgattcttctgcctcagccttccgagtagctgggattacaggcaggcgccaccacacccagctaatttttgtaattttactagagacagtgtctcaccttgttggctaggctgctctcgaactcctgaccgcaaatgatccacccgctttggcctcccaaagtgcttggattgcaggcatgagccaccgtgcccagcctggtatatatttcatacttcaacagatgtgcgtgtgcctctgtaagcaatgtacaggtctcctttttgtttttttttcttttgagacggagttttgcccttgttgcccaggctggagtgcaatggagccatcttggctcactgcaacctccgcttcctggattcaagcgattcttctgcctcaccctcctgagtagctgggattacaggtgcccgccatcatgcccagctaatttttgcatttttagtagcgatggggtttcaccatgttggccaggctggtcttgaacttctgacctcagatgatctgccggcctcagcctcccaaagtgctgggattacaggtgtgagcaaccgcacccggccctaattggttttaaaaagattataaagccgagatcacactgtatgtaatcttctgcagcttgcattagagattatccttgtgattatatatagaccttgtttaatttaactgcgatcacgttttgtctatcttgtcctgtgttgaactttttttttttttttcctgaagttagtgtcctcactctgtttcccaggctggagtgcagtggtgtgatcttggctcattgaaacctctacctcccaggttcaagcgattcttctgccttaaccacttgagtggctgggattacaggcttgcaacaccatgccctggtaaatttttagtatttttagtagagacaggtttttgctacgttggccaggctggtcttgaactcctgacctcaagtgatccgcctgcctcggccttccaaattctgggattacaggtgtgagccaccgggcctagccctgtgttcaactttttaatgtcaatgttacactggtggtgttacaaacggtactgaggtgagctccctagtcttctctcccctcacaaatgtgagtttatctagagtatatttctagaattgcagttgtgagttataggcatgcttcagttttaatagataacagattgctttctcattaggggcttgtgagtagtgtgatttcccagcattctaatcagcacacagtgtttgccttacttttaaatatttacctatctcatgggtaagaaatgatgtattgctttaatttgtgttgctttatagtgacaaaatatatattttaaaagctgttatattaggttcaggggtacatgtgaaggtttctcgtaagtgagctcttgttatgggatggaatgtattttggagaatcagatggacatactgtcagcttggagaaggttagaggtatagaaactgtaggaatcaaatatgactttaggtttctggcttggtagtggtgttgcttaatgaacaggggaaaaaactattgtgagggttcatttttttttttggtcaaaaatgcctttactttgcctccacttaaacacaatttttttattagagtcgcgctctgttgcccaggctggagagcagtgacgccatcatagctcactgcagccttgaactcctgggctcaagcagtcctcctgcctcagcctcccgagtagctaggactacaggcatgtgccactgtgctaagcttgcctctgtttttgaaggatagtttcatcaggattatagttggaggctttcaagttaatttattgcagtttttaattttttgtaaagatgggaggtctcactatgttgctcaggctggtgttgaactactggcctcaagtgatccaaagtgttgggattacaggcatcagccattgagcctggccttcctacagtgttttgaaggggtagttttactgctttctggcttccactgattctgtggagaagtcagctgcatcagtcttattgtcactcttttccagttagtgtgttttttcttccctttaggctgcttttaagatgttctctttgggtttggttttcagctgttatgtggtgtgtccagatgtggttttcctcaagtgtatcctgcttgggattagttgttctttttcttctctttggcagtgctgtgacaaagcttgatcttaaattagatttacagaattcttgttcattatctcttcattgattgcttctgctgcatttcctgtctcatctccttccaggactgtaattacctgtgcattaaacatgccctctgtgtcgtgtcctgtatgtcttagattcttttctgtgtcctttatccctttgcctctccatcgttcactctgtatcttcttctgacttatattccattgtagtaatcctttcttcagctgtaattgctgttgaactcgtttattgagttcctaatttccattattgtcttttccagttttcttgattttttttaaagattccaattttctgctggcattttttatcttgtcaactgctttattgtatgaatcagagttattttaaagtctgtgtctgataactccgatatttggatgccttgtaagtgtgttctgttgtctgttttatccttggttttcagtcatgtgatcttgattctagatatgcctgttgagctttaattaaattctggacaatgtatgtgaaaaattatagagataattcaagaccctgcctgttggcttcatttgaggatttggcaggcagttaaagtaagggaatatcactttgcccttttttttttttttttttttttttttgagacagggtctcactctgtcgcctaagctgaagcacagtcaggctcaaatgatcctatgatcctcctacctcagcctcccaagtagctgggactacaggcacatgccaccatgcccagctaattattttttatttttgtagagccagggtcccactatgtttcccagactggtcttgaactcctggcctcaaatgatctgcctgcctcagcctccaaaggtgctgggattacaggcctgagccacctcacctggccggaatatcactttaaaattatgaggcatggtctattctggtttacccttcttctaggttatagcctttagtggttcccactgaaagcttgggttgcttcccagggcctcttctacttggcagcccctgaactctaatttttgtcccctcagtcccctaagactggtggctattctgctgaccttcttggattctcagtcacttgtttctgtttggtattttggcttcccagcttctgctgtgaattggcgaatccctcaaggagaaaaggggccccggtgattgggctcacttttctgcactccccttttccctctggaatcctggcctccagagtcctcactgcatgggtagctctctgatgccttcaaacagttgtttctaataatttgttcagttttttaagttgttcttggcagaaatgttggtctgcagtgagctagtcagctttactggaagcagactctcaggaattcaattttgctatttaaaatggacttgttagtgagatatcctggtggagatggtaggtaggcagttggctgtgtcagtctgctgctcagaagactaatttgggtaggagataaacattggggagattttaattcatgcgggtggaagagctcacataggaaagagagttgagagaggagaaaaatcctaggactgaggacagcacagcaaaggggactgggagggtaaccagtgaggcctaggaagccttgaagattgtgtggcattgcagaagagagaaggagtgatcgatcagctgtgttgaatgcacttagagacggcctaaaatggggatggggacatgtctactggacttggtgatgttaaagaaaaacaatttggggagaggcagggagctagctagactggagtgggctaaggagctagtgggggaaggtgtgtctttgctgaaggaaaggcacgtgccatgggccttaattggaaatgtggcatgttatgagaatagaggggaagcctgagtggctggagctcagtgagggaagggtatgtttgttttgcagtgaaatacttctcaaggaagttttcacaggagaccaataatcatttctatcaggcatgttagaataataatgctgtttgcattttcacactcttagtataagtaactttgggagaggtagatatagttttaagaaattattggcagatcctttaaaaagcgggtttgtcagcttgtaatatgagactgttgaaacttttgaaatgaaatgaaattttaaaagtaggttttgtcaaagtaccctaaaagctgcttaagatatataaaatattggctgggcgcggtggcacacgcctgtaatcccagcactttgggaggccgaggagggtggatcacctgaggttgggagttccacaccagcctgaccacatggagaaaccctgtttctactaaaaatacaaaattagcctggtgtggtggtgcatgcctgcaatcccagctacttaggaggctgaggcaggagaatcacttgaacctgggaggcggaggttgtggtgagccgagatcacgccattgctctccagcctgggcaacaagagcgaaaatccgtcttaaaaaaaaaaaaaaatatatatatatatatatattatatatatatatatatatatatatatattatatatatataatatatatatatataatatatatatatattatatatatgtatgtaaaatattttgagtttgtggggaaaatagtaaatcatttaaatgagagtagaaaatacatgactctccatcctgtttttgaagttaacccaacataaactttttatagttaatgtcaggtacccaattaacatagaatagacatgagattctgtagtgctttataatttggctggagccaatacagcaagcatttatttcggataaatatcttttcactattatgtaaatattggaagagactcgcctgagtcaatttcagttggccaagaagatattttgatttactttcctcgagtaaatttactctttgagctgacttggtttttagtaagtcaccaggaacactgttcaaataggagagaataaaagttcctgctttaaactctcaacagggctattgttaattactgtagtcttcttttgaaaaacttatgtctgtaattaataaaatcagcaatttgctgtaaaacaaagcatttggatgatgatcagaaagtatttcccaatatctaggtaattagtgatttttttcccccaagttttcatccagatgtttggcaatgtgcagacacaggcttactgcaactttataattcactttcatgagaacatataatattctccgtttattttggacatcagagtttcctttttctctggacagatacgtatgaaacacatgctctttgagtggagtttgtggtcctctgagaattctctgaaggaggaaatgggttgacctatttggttgctatgaagtaaaaacaatcttgttttcattttttagtgaacatctgggttgcatttattatttcacattctggagattctgtaaaaccacaatttgataatatgagggttcatcaaagcggtaattattgagctatttttatagttgattcaagaattagggtggctgatagactttaaacaatattttttcgtttctataaaatgtaacttaaataacaactcttgatttgaaaccataaaatgggatgtagatatttgggggacagaagaaggattgaacaaccagtttatttctctgttgcctgttgccttgtagcttgtcgtcattgttacagccatatttgactctgtgtagaagacattgttgatgccctattgcaaatccacccttctttgcttccttgcccacagaaccatgaattgtttacatatttacccatcagggaagaggactttatcaccacaaagggctatatcttaaatagtcttagcaggtgggataatccctctttccttatccataagtggaggagaggtgaaagtgtcacccaagtctggccagtatgcagggcagtttgcagggggatgtctgcaagaagtttcttccttcacaaataaatatatgaggagttgcgtttcttttcttttcttttttttttttgagactgtgtcttgctctgtctcctatgccagagtgcagtggcatgatcatggctctttgcggtctcaacctccttggctccagtgatccccccacctcagcctctcaagtagctaggccctcaccaccacgctgcgctaatttaaaagtattttttggaaaaaaaagaaaaagcaaaccaaagaaacaaaaaatattttttgtagagacaagatcttgctacgttgctcaggctggtcctaaactcctggcctcaagtgatcctcccaggagtgagccaccgtgcccagccctgttgcatttcttatgctagactttgttggacctggatgagtagccagcttgcattcacaatggctcttaattaagcctgtccatttccaagcccacaccctgaggatgaccagcgggattctagatggtgctgttgctgaatttcacccacccaggaacctccctacctccacacttcctgtcatgtgggacagtaaatacccctcttgtttaaatgattgaacagcagtgtactgtaacttggagctcaaggcatctggtgtgatactggctgtagcagcaggtaggtttcattctgtcattcattcagtaaggatctcctcgccatagagtgcgaagagaaaaacaccttttctctgccataaatattcattaaccatataaatattactttaagaacttggctaggttatattttctttttgagactaacactttctccccttttaataaaacaaaatacgttttcgtattcttagaaatacattgtttcatttggcaaatctttatgtgtattttaacgtgtacatttagaagtatgcagtaatcaaaggtggcattggcaatttaatattctgttagaagacaggacttccttttagttctttacagagaggaaataaaataatcaagaatgtccttttccaagtttcagtaattagattaaaatttttttgagttgagaaaggatcagacaaatgaattcagttttgtttgtgttagagtatgggaaaattgaagaattttagtgtcttttgaatgtttggcctgttcacatgatgaggctgtatttcccaggcgtgggaagatgagtgattgtagactttgattcagtatatgaccacacttctgagagcatgacacatttcgagaataaatgatgcctttcattgccttatgtaaaaaaaaatcttcacgttggataagtcttcttctaaaatgttgcgttttctcgggaatcacagggtgtctgttatggactatgttcctgaaatttagttcaaagtagtggttaaactgtatactagtcagatggttactaggatgtttcagttttcacaaaagaaagtcaaatgccttctttccttcctttttgtggtcagactggtcttgaagtctgctagctcttgctcgccacacgttgtcccgccagcttcactcttgatgacagctctcagagggagcagagtccacatggatgtggtgtgtcctgccctcccttggctcccccagtagttgctctgcctgacaagtgcccagtaatttggctggacatgcagaacatgactttttaatttttttcatctggaaagaacataagctatttcccctgggttctgctgctgttagtacttggacatttgttttaggatttaagtctctattaccttcccactgcttccaccgctccccactttttccttctcaggagaggagtctgggggcttctctctttgcatgtcttcctgtcaagtattacctattatgattctggtgaagagcggactgtcttgcatctaaaggtaatgaagaccatctacttcagaagtcttgttaagttctgcgctaaaacatttatctcccatttctgttatacctgtaaaggggagcaaagaatttgtgtcttcagagagaagtccactatcctagtcctttcagcccccttgaggtttggtgcaggcctgcctgggagttccacaaatgggagtgtgctctagggccccctgcctgaaccagtggccagtgactccctttggagagaatatcccggcagaagttctcgagtctcaggacttgctgtaggcggttttatcttggtttcagccatcaagaaatgtagttgattggatcagtgactgggaatttcaagaacagattttacaggagtgctgtttccttagagttgtaaagttattgacagggccatttcaactttggttaaacagattaaaggttggccgggcgcaatggctcatgcctgtaatcccagcactttgggaggccgaggtgggtggatcacgaggtcaggagatcgagaccatcctggctaacacagtgaaaccctgtctctactaaaaatacaaaaaattagctgggcgtagtggcgggcgcctgtagtcccagctactcaggaggctgaggcaggagaatcgcgttaacctggaaggcggagcttgtagtgagcagagatcgcgccactgcacttcagcctgggtgacagagggagattccatctcaaaaaaaaaaaaaaaaaaaaaaacagattaaaggtcaaacttgggtagtcacactaacctgagcgtctcccccacatagggagtctgtaagtccttaatttcataagagacttgaagtagaagctgttttctcctgatgtccccaacatatccctccctccctatcttgatgaggtgctggacccccaggactactgcagtgctgtggtgggggcctttctggtcctcagcccagcttcttcacggccgactctgttgggatgcatcatgctggagataactatgtagccattccttcctaaatagtcttagtcctgtgggattggagaggccctcttttcccttggggtctctaggaattaggatttcagaacttttccctgtttgctatatcaggtcagccattgaggatatttcgggtaattccccttgttcaaggcagaatattgtcatctataatgttaatggttctgagaatttgtattcatactttctgtatgcttacataagtttgtttaaacatttgagcctgattggtgttgacaaatatttggtattgacatatttttaagtaaatatctgcagctctgtcatttctagccttgtgattttgtgtaagttacttaatctccctaagctgttaaaaaaccgaagtgaaattatttatatgaagaatttatcaaaaatctcgacgattgtaatagtaggcattcaaaactgttagtcatcagtgtgttaagcctctggcctgcctgtctttacatactgagtagagtgagttggaagaattgttttatttgggctgaggaataactgatgattggcaatatgattattatatcttttcttcccaactttgtattttgaaaatgttcaaatctacagaaaagttgaaggaatggtacgatgaatcctatatgtctttcacctaaattcaccagctgctaacatttggccacatttgcttgtctgtctttgtattacaatttgtgtgtgtgtgactgaacccatttgaaagcaagatacaaacatgggcaggtgcgatggctcacgcctataatcccagcactttgggaggccaaggtgcgcagattgtttgaggtcaggagttcgagaccagcctggccaacatggtgaaagcctgtctctactaaaaatacaaaaaattagccgagcattgtggtatgcgcctgtaatcccagcttcttgggaggctgaggcatgagaatagcttgagcctgggaggcggaggttgcagtgagctgagatcacgccactgcactccagcctagacgacagaacgagactccgtctcaaaaagttacaaacatcataacgcttttcaaagaaatactttagcactcgtcttctaaggacattctcctacataactacagccgttatcattcttaagataactaacagtcattccataatattgttccaaaatagtacacattctgctttccccagttgttaccaaaatgtttttatagctttcttttttttttaaacctatctaggctctaattaagatttacaccttctatttagttatcttttatcagtcttatttttgttgttgtttgtttgtttttgaggtggagtcttgctctgtggccagggctggagtgcagtggtgcgatctctcagctcacttcaacctccgtctcccgggttcacgtgattctcctgcctcaccctcctgagtagttgggattataggtgcctgccactgcacctggcctcctttctttattttttattttatttatttatttttatttttgagacagagtctcactctgtcacccaggctggagtgcagtggcatgatcttggctcactgcaaccgctgcctcccgggttcaagtgattctcctgcctcaccctcccgagtagttgggattacaggtgcctgccactgcacctggcctcttttgtttatttatttatttttatttttgagacagcatctcactctgtcacccaggctggagtgcagtctcatgatctcggctcactgcaacttccgcctcccgggttcaagtgattctcctgcctcaacctccccagtagctgggactacaggtgcctactaccacgcccggctaatttttgtatttttagtagagatagggtttcatcaaattggccaggctggtctcaaactcctgaccttgtgatctgcccgccttggcctcccaaagtgttgggattacaggcgtgagccaccgtgcccggctgtttttaattttaaaatgtgttttggtggctgggtgcgatggatcaggctggtaatttcagcactttgagaggccgaggcaggcggatcacttgaggccaggagttcaagaccagcctggccaacatggtgaaaccctatctctactaaaaatacaaaaaaattaactgggcatggtgctgcatacctgaaatctcaagctgaggcacgagaattgcttgaacccaggaggcagaggttgcagtgagccaaggttctgccagtgcactccagcctgggtgaacacagtatgactctgtctcaaaaaaaaaaaaaaaaattgttttcgtgacacctttttgaagagtccaggcttattgtctaatatcattatttgcatcctatagactagattgcatgtgtaagcagaattgataagtgcttcagtttctttaattttttaattgtaaatatgttaaaaatcattttgattcaaggtaaaagtgacattcatttttcttgttctttggtaagtgtggattaagttggtaaccagaaggagttacggagtggttcagatgtcagtggaatgtgtgtgtgggtaaatttggaacaagcatccacagtggtttctcagactcacacccatccggaggtagttatctggcttaacatagtgaggattttattttaatatttggccatggttttataaagaaatgaacttaacaattggaaaatttagtaagacaaactatatttacataattttcaagagatacttttgctgtcagatccttggatgaagactaaaccttaaatctctcaggaatgcatctttttcttcttccctccctcaacactttcctattgatttaaaaaaagagctttaactgcagctgagactaatacaggatccagctgtagcttttttgttgttgttcatgtatccggtgatgggcacagcaaactcattgtatgaaaagccaataaaggaaagggcagggtgggaaaaaaaatgacactcctctaaaagtattcaagaaatagcaacagggtctcggagtctccctttcagatgactgatttaaattccattctaaagtattaattttgttcgtgactagtctagaaggcattttaattttcccttttaattatgtacacgccacgtaaccagagagtatatgtgaggctgacacattattttccttggaggcagaaaatagtaaagcatgagaacccagagaactaaacgctcctcttgtaaaatagggcaaagattcttcaaaatactgttcatgttcatgctggtatagagatagcaaggatctgtgaaagaaagccagtttctcttaaatttgttcagtagtactcaaatttatgcatttaccatacagcaaataaattcagaatcagtagttcaatcaaactacattccacatttgcctatctgtttcagtgtaatttctataaaagatttgcatcttctgctctgtcttaacaggaccaggtccatatcaccatcctgtagctgaaaatgaattatgttttaaagtggtttttatgatcaatgtaatgatcataagactagtgattttcacatacttatctcaagcattttgtttttcttttttcacattaagggggtcagatttctcatatttcttgtaattgtagccagacgtcctgtttggggactattaaataccaatggtgcctgtgaagaactcatgcgattctgtggtaaccatctgagttattctttgtagatttgattttatggacaggcctctttgaagtcctgtactctatttttagaagctcttttttacgtttccgtggttcagggcatcagtcataaacatatttattattcagcacaaaaatgttgttcagtgtcttaaggctgtttaaactttacggaaataataaaccagtggcacttcagtggatgtaatatatgagcactactgaacaaatttaagggcggagaattttgcggtccttcacagattgctgctctgtctgcgccgccatgaacggtattttgaagaatcctttcctattttacactgagagggttccgtctccatgcttctcacacgttttgattttctgcctcccactgaaagaaacgcttttgtagcccttcaagaaacttcctacatgtctcccctccttctctcctgcctcattattactcctttaaagaaaaaaaaaaaaaagaatagtctgatagctttcttttcagatttattttattttatttattttttttgagacggtgtttcgctcttgttgcccaggctggagtgcaatggcgtgatctcggctcactgcaacctccgccacctggattcacgcgattctcctgcttcaacttctgaagtagctgagactacaggcgcccgccaccacgtccagctaatttttctatttttagtggagatggggttttaccatgttggccaggctggtcttgaactcctgacctcagtccacccgccttggcctcccaaagtgctgggattacaggcgtgagccactgagcccggctcttctcagatttatgtatgattggtttgctgctctgtgttgtagcagagaccctgtgctctgaagtaatttctgatccagtgaaatattacaggagcgagggactgtgcaccttcagtgtatttggtaataaagcacctattctctttttagaaatcactataatccacatgccattatagtcatccttttaaattacacaattgaatggcttttagtatattcataaagttgtgcgaccatcagcactatctaattttagaacatttttatcacttcaaaaagaacctgggccccattagctgtcatcccctcctctgcaacccctggcagtcattcattgactttttgtttccatggacatgtcacgtaaatggaatcatagaatatgtggtcttctgtgtttggcatttttcactcagcaggttcatccatgttgtggcatgagtcattttcccaggttcatccgtgttgcagctcgattcagtgtcagtgtctgtgcttctcctgtgggtggaactgagacttggattggttttagtgttgggagtggtcagagaggttttgctcacctctgtcacatggttgaatctgtggctgtgtgctatcttgaaggtttttaggtttgcttgtgttttcttcctattgaaaaggttgaagtttattttaacccgtattatttgaaggaccacatcaaatccttgctattgaaatcctttagttgataatcttatgaacagttgcatctggagtagaatcatgttgtctgtagaaagtttttactctctctgaagaccaatagtgggttcaagaaacagaattccccaagggagccatactgaaatctgttaacagaagcgtgaagagtctacttctcggggattccagtgtgatcccagtggtggacataggacaacaaatttccatcccctgttcaccccaaaatctcgacaaatgacagggaagagactgggatggggggcaagtggggagaagttggtcaaagcgtacagtcttgcatttgtaagatgaataaattctggagacctcatgtacagccctgtgactacagttagagataacgtattgtatgcttgaaatttgcagagtgattttaagtattctcactacacaagcacaaggtaactatgtgaggcgagaggtatgttaatcttcctgactgtggtcatcatttcacagtgtctccttaatcaagacatcgagatgtacaccttgaatatatccaatttttagttgtcaattgtatctcaacgtaggtggggaaaaaagagcctgggaagggaccttttgcaaaggatagagtgtaacacacttttggaaggaaactacaaatgggaaacctataagcagataaaacagaaggagggtttagagtaagcaggagcagcttctgggcagcccctcacggggctgtgctcagactagttagtgtttggattttgggttctgttggtgatcgtggaaattgtgctgcaaataaggagaattcaaaggccctccgaagccactgtgctgggagggttttctacactcttctctgtcctttcctgttcctcttgttttgaggagtctacagcattttacccataagcaaattttctttacagagattggattccttgcctggggagaattggaactcaatgggtgtgtaccaacaccccaagtaaagctttttaacatttttgtttgtttgttttgtttatgcggcttctccagtaaagggccctatctttttcatccccaagagaagccctccagtggacaagctgtgctcacaaacacagaacatagtgaaccttcccatttgaaagggaaatcgagtgagaaaagttacctacacgcaacaccaaaggaagacatagctagcttcatcgcatttttaaatgtgtacaaacagcaaggacctccagatggatgaaaaaacccaacagcgtgaaagagaaaatttaaaataaaatttctatagaaacagagaaagctgacatcaaaagaattcagaagatagaacactgaaaaatggtcattggcaacttccaggaagatgtgacttgggcactaggctttgtctcacttcttacctcccctcccttgaatcaccagatccccatggaagtgattgagaaaaagagagatgaaaagctgaatcagaatagatagtgggatcagggtgaagaaataccagggcctgactcatcactctgtttccttagaactcagtgcagggttgtgaggaacatatggagatgtggtgttggctgtgctaatttgggagagcagagagcgagggaggcctgatgaccctgagtggccacgggcagccggggtgggcttgtgcagcagcgatattgatgagcagctgaactgggaggccagaggacacacgcggcttcaacacgctcaaaactgctagagcttctcctgggcgccacagtcctccttcctggtgcattgggtggcatcccacccatctggagtggaagccaggtctagacagggagagttagatgcagaaactagaaaacaaaagcaacacgataggctcagagaaggaggctcccagagctgacgttcccttgaagatggaccacatctctgaataggcagtgcagtttatatatgcatcctccagcctataaacttagagttagaaaacagcaacaataaaaacccaccaacgtttagcagcattctgaggaggaggtccagctattcttttttttttttttggctgggggggggttgggggaggatgggtctaaatactattgttcagaaataaagaataaagcaacatgtttccaaaagaaaataggagggggatataatttttgaggcagaggaatagtataatttagaaaatagtaattatagaaatgagaagtaaatttcagattgaatctactttgtgctgttcttaataaacttcaagaaacacaaataagtggttgaaagatgagataaagcaacaggccaagctgaaaactagggcagagagagttataaaatgaggctgggcactaagcttatgcctgtattcccagcgctttgggaggctgagatggggggatcactggagcccaggagtttaagaccaggagttcgagaccagcctgggaaccatggtaagccctccgtctctacaaaaaacaagaaaaatttggccaggtgtggtggtacacgctgcacctgtggtcccagctactcagaggctaaggtgggaggatcgcttgagcccagaagttgtcaagactgcagtgagctgtgattgtagcactgcactccagcctgggcgacagaccctgtctcaaaaataaataaataaaaattataaagtgaaatgaaagagctgaaagaaactgtaatgacagtaaaagcatttgcagaattttaaactcccttacgattcatgaagagcaaaagtttacaatgtagaaagttaaattattgctgtgatctgaataaatgttgttcgtaaagaagataccaaaacaaatagaacagaaacaataatcagattcaatgggaaaaagtatctttgagctgaaaaaaaacgagctgtttctgtatattcaaagagctcattctgccttagataaaattagtgggaagagcaagaaagagcaagagagtaccctgcaaacagccagtcagaacctggggagagggttacttacaacgaaatcgggatggttttagacttttctataacattgccagaaaatagtgtcgtggagctgaggctaagttttaagggaaaaaaggttgtaactaagaattaaatagtcacactaattgttgttaatttgtgaaggcagcagaaagatgttctctgaagatacagaagttggagctagcacactgccttcagtgggagctcaccctgcctttggacttaggagttatgtgagccagtacctttccttactgtttaaggccatcagcttttttctactacctgtacctgaaatttttctgtatgccttctgtaaatttttcttaaacaaaacttgttcatggatatattctaaccaactaaaagattgtttgaataactcaagaatgcggaacttgtggtgttaaaaaaaatactgacattgaattgaaatcatgtaaacataaatttaagtctaaattataaacttgattacagatgttacaaatgaaaagtcaaatattgtaaatactgaaagagaagatatgtaatggaaagagaaaaatcccagttattcagtaacaatgccaacaataataaatctgggtcagattcactagtagaaactgagaagtaggtgggggtggggcagggactgttaggagaaagtaaaagcccagcctttattttttactgttttatttttgtttttgataattagaaaaatacaggtagtggtatggttttaaaaaaaaattaaagataatcactagaaaattcaaagtaggatgttcacattccacgtcacacatctacatgtgtgaggatatatgcattcctcgctggaggagggaaaacaaaagataaatttgatcacaggataaggtcatgtcacgcaaaaattctatggtatttggttttgtaaattggcttttaaaacttacttagaattttggtctggcatggtagctcgtggctataatcccacggttttgggagttgaggcgggaggaacacttgaggcaggagttcgccaccagcctggggagcaaagtgagacccctgtctcttttaaaaaaaaaaaaaaaattatccaggtgttgtggcatgctactcaggaggctgaggcaggacgattacttgagctcaagagtttgaggccgcagtgagctgtgatcatgtctctgcgttccagtctgggtgacagagcaagactgtctcaaaaaagttaaaaaaaaaaattaaaaattatttagaggataattacctattttgccctgtgttttagaaaatctttaagaagcaagtaccttttttggggagagggttaatgggagataatccattttgtgaaatgtatttgtttagaaatttagatcatttgtgattcctccccaaactcggtctcaaaaaaaataaaaaagagtttcactcttgctgcccaggctgtagcgcagtggcacgatctcggctcattgcaaccttgacctcctaagttcaggtgattctcctgcctcagcttcctgagtagctgggattacaggcgtgcactaccatggctggctacttttgtacttttagtagagacggggtttcaccatgttggtcaggctggtctccaagtcctgatctcaggtgatccgcctgcctcggcctcccgaagtgctggaattacaggcgtgagctgccatgcccggcccccaaactcttttgaggtaattctggacaaacctttgtgaaggtcttggaggtagaaacgcttgggtggtggctggagatgagtgaaagtagggaagaagcctgctcccgctggacacattctctctagggtgcaccttctcccagggtcacgaaggctgggatgaaaaagaaagtagagagcagtgtgagcttccccatcagagtatcagcagtcagtggaggaggagccagaatttgtggggcctgaaactctctaattctgagggccctctttcagaaaaagaatacaaatttaggtatcaaaatgaaaatttagaatgaaaaagaagtcactagttgtacattttgaaaagctaaaactacaaacaactcaaaacctagaaccatataacacagttctttctttggcacacaaccttacactttccccctgcatttttggttacctattctaatctcttcacgtagcaattttgtaacattttatgtaaaaagactagaaggccgggcgcggtggctcatgcctgtaatcccagcactttggaaggccggggcgggtggatcatgaggtcaggagattgagaccatcctgcctgacacgggaaaccatgtctctactaaaaatacaaaaaaaaaaaaaaaaaaaaaaaaaaaaaaaaaaaaatttagccgggcgtggtggcgggtgactgtagtcccagctactcgggaggctgaggcaggagaatggcgtgaacccgggaggcagaggttgcagtgagccgagattgcaccaccgcactccagcctgggtgacagagcaagaatctgtctcaaaaaaataaaataaaagactagactaaagataatccagtctttcctccaggatgactgaaaacatttaagaaactttctttcaaggttttgaccattaaagttttaagtttccattttaaaacaataatttagcctaggaaatgtagtgagaccccatctttacaaaaaaattaaaagctgggtgtgatggtgtatactggtagtcccagctactcaggaggctgaggcaggaggatcgcttgagtccaggtggttgaggctgcagtgagccatgattgtgccactgctctccagcatgggtgacgaagaccctgtctcaaacaaaacaaaaataatttttcggacattttgaagcatcttctggtctttttcctttcagtttgtttttggattctactagggtacttcagaatacacagaataaagcattctaaaagcaattagtctgtaattaatgcacatgcaaaagcagttgaaataaattcattaaaaattgccacgaagttgagttacgtcattcaatcctgactctagatgaataggtttaggagttttgtcatctgaaaacctgtttttttccccccaggctgttttgttgctttggtaacattcttttctgccatttcttctgtgaagtctgaaagtgtccgactttgacaggacaaaatgcatcagatacataagatgcaattctgtatgttgggctgcatagaacatgcaacttcaacacaggcttacttactattttagtaccagtacaggtttaaaacctgtaaatacaggaattctaataaattcttcaaaatgtcaaaaaatgatgtatttataacttactttgaacagtcaagtatattcctaacaggagagaatttccattttgatgagacaacaatgacaatgaaatctttttaaaaattcacttctctggtgattggaaagttttctcctagattatctctgactccatacgattcaaacctcatttcttctccattatcctcacactcctggtgttagttactttaagacatagtcatattaaaataccacctctgaccctacagttttcatcaattcattgggtaagttgatatagggccggaaggaatattctaggaagtcatttgtccatttggaatggctggctgtaatttaattatacgcagaagaagctgaaagccacctaagtaaattccactaaacccaaaccaaatgtatttccaactgaacctccccttatggattcccaaaatacccatccccttaagatgccacctgccagaagaagtgtggtgaagtggaaaaaactcttaaccaacagagctttctggaggttcaagtgtgcttaacttcaccatgttattacattgcttccccacccccatcctgccccatcccacccatgctttgacccaaagcatgtgctcggttagctttgttgtcactgaccgctgctgggggtcaggtggtagagccagacctggccagtcacaggtgtcggctgccttttcacagacctgctcctctatgcacagagacacaggcccagcccgctgggctcttctcatcttaccaagggcagtttgcgctcttatgcctggaggtgagaagccctaatttttgcactcaatgtctattaacttttcaggccagacttagggcagagagttgctggcttgacaagttttggggaagaaataccatttttagagcacctgcaattaatcatgagactaggtgtgcatctattgaccacagtcaccttgggaggcacaagttttacctcctagagaactgaaggggcatgtcccaggacacccatggcaagctgtgaaacttgcattgtggaacccaggtctccctcacctggttctttttttgttcccaggcctctgtgcagcctcacgattggtgacccttggtccattctggggtcccagcacagggactgcctagagggtggcagtggggtctgggaggagtatgggaggcactgggtaggatggtgttgaatgtagtatgacagggaattcctgtgactcagagcatctggctccaatcttgagctcatccccctttaggccttcacttgttgaaaatgtaaatgatcctggacctacatagagtcccttaagaaggcccctcttcacgcctgtaatcccagcacttttggaggccgaggcgggcggatcacaagatcaggagtttgagaccagcctggccaatatggtgaaaccccatctctactaaaaacacaaaaattagccgggtgtggtgacgagtgcctgtagtcccagctactcaggaggctgagggaggagaatcgcttgaacctgggaggcggaggttgcagtgagccaagatcgtgccactgcactccagcctgggcaacagagtgagactccgtcttaaaaaaaaaaaaaaaaaatgccaggcgcggtggctcatgtctgtaatcccagcactttgggaggccgaggcgggtggatcatgacgtcaggagatggagaccatcctggccaacgcggtgaaaccccatctctactaaaaatacaaaaaattaggtgggcgtagtggtgggcgcctgtagtcccagctactcgggaggctgagacaggagaatggtgtgaacctgggaggtggagcttgcagtgagccgagattgtaccactgcactccagcctgggtgacagagcgagactccatctcaaaaaacaaacaaagaaaaaacccctctgccctgttcccttcctttgtgtaaaggtgtgtttattgtgttacagtggtatatgcaagcatgaatgagactattctgtcccctgtcctacctcttagaaataattattagtttcttctttatgcatttaatgtttatttatgcaattataataaaaatgtaaattcttatcactgcctcctgttacacctcacctttttcatgtaatatctggagatcatttcgctacacagagccttttcgcaccttatttttttaaaactgatagctgtcataattgagcttttcctgtactctaggccttgttctagccctttctttccctccccactgcaaccccaccactttttttaaacagctctatagtattccattgtgctaatggatcggtttatttatccagtaccttattgatgggcacttggattgtttctaatctttcgctattatgttgtagagaatgtgaatatgccgttttttacacatttatctgagagagaaattttcagaagtgggattcttatgctaaaaggaaaatgtgtttaaaatgttgttagatgttatcagacttccctccacactcactgttttttacacccatcaacaatgtgtgagattgcctggttccccacagttttgtcaacaggtagtctgtcaaactttcggatttttgccagtctgatgggtcagaaatggtatttccgtttagtttgcatttgctcttctctggttatatgcccatttatctgttgggttgttagtctttttcaaattctcgaaggtctttgcatagtaggggattagttcccatggattgcaaatgttatcttccacttcaccatttctcttttgactccttgggtttacttgggttttggttttgtttttgtcgtgcagaagatcatgtgtgtgtttaatgcaaccaaatgtatttctttttttttttgagatgagtctcactctgtcgcccaggctggagtgcagtggcacaatctcggctcactgcaacctccgcctcccaggttcaagcgattctccagcctcagcctcctgagtcactgggattacaggcacatgccaccatgcccaactaatttttgctttttttttttttcagcagagacggggtttcaccatgttggtcaggctagtcttgaacttctgacctcgtgatccacccgccttggccttccaaagtgctgggattacaggcgcgagctactgcgcctggcctcctttttttcttttttcacacctaaattatgagtcacacttagaatggaaggccattctaagattataaaagaatttgccgatgttatctgttttcttcctgtacttctgtgttcatgttctacatttaaatctttgaattgtttggagtttattctgatgtgtggcgtgaggtatagatacagcttcaactttctttccccaaaaggctgcattgtcccaacaccagttattaaaaagttcatctttaccttgccacttttatcatatattaaagtaccatctgagtctttctggatttactattctgttccattctgtctattcagatgccagcatgacatggttttacttattgagaccatggtattttagtatcagttagggttaatctcctcccctccccacctcatttttctttattttcagagttttcctggttattcttgcttgcttgtttttccttgtgatctttagaatctgctcatcaacagaaaagaaacagcttctgatctcattctttttttttttttttttttttgagatggagtctcccaggctggagtacaatggcacgatctcagctcactgcaacctccacatcccaggctgaagcaattctgcctcagccttctgagtagctgggagtacaggtgcctgccaccacacctggctcatttttgtgtttttagtagagacgaggtttcactgtgttggccaggctggtctcgaactcctgacctcacgcgatccacctgccttggcctcccaaagtgctgggattataggcgtgagccactgcacccagcctctaatttcattctgattgcattaaatatataaattaacttagaaaatgtatctttatgatgttgcagtttctgattacgttaaatttatgaattagaaagtatatccttatgacattgcagttttctttccaagaacatgatatgccttatttgttcaagtctgttaccattcaagtgtgttagttttccttctacttacatatgttttatgcatttattattaaatttatttggatatttggtattttattgctatcataaatgaagtattcttttctactttagtgtctaactagttatttgaatttatgaaagctattgatttctctatattaattttatatctcatttgcttagcaaattatcttactgtttttagaaacgtttttcatttgcttctcttggatttttccacttacacagtcatttctttagcaagtgatggttttatctcctcttttctaatttttcttctgattttagtctcttgtccaattgcattggccaatgcattctgttttgaaaatgttcacttggaccctccatatggagatgtaggtttggagcttaggagagatagtagggctagacatcaactttggaagtcattgtcttaaagatggtggttgaaactctgggaacttatatgttggctaaaggggagaggtcagagctggggatggagacggggcagtggtgggcagagactaggaaggaagggctgcgtcttctcttctctttctctcttccatttccctcttctctcctctcccctcccctctcaacaaatataaaggttgtcttgatgaagtataaaggttgccctgttgcccaggctggagtaaagtggtgcgatcatagcctcactgcagcctccaactcctggctcaagtgatcctcccacctcagcctcctgagtagttgggactacaggcatgtaccaccatgcttggctaatttttgtattttttgtagagatggggttttgccatgttggccaggctggtcttgagctcctggcctcaagcaatcagcacgtcttggtctcccaaagtgctggaattacaggtgctaaccagtgtgcttggcttttttttattattattattatttttaacctggagttctgatttccaatcttttccccttttaaatagactttatttttggagcagatttaggttcacagcaagaatgagcagaaaataaagagctcccatatactccctgcccccacgtgcacacagccttccccggctgtcgacacccttcaccacagtggtccatttgttacagtcgatgaacctacattgacatgtcattgtcacttggagttttcattaggattcacttttggttatggtacattctataggtttgggcaaatgtttaatgatgtaatgatgagtacccaccgttatagtatcatccagaacagtttcactgaagggctttctttttacatttacttttgcttactcaatatgcctgcctgtttgtataggttattgacattatctgtaatgtatttactaagcatacagcttagtgtactttactaagcatagtactttcattagtctttattgaacttcatcttgtttgttagccatcatttctttaatctttcaatacttatttctctgtccttttgttctttttagaggaggagtaaatcatttcctttagtagaaattgtttaaacctgtagggaggaattgtgcttcaaggttgtttcttttgattataaatgaatgaattaaatgtatactaagattcacaattaaaaaaatattgaagtgaatttaaaaagcaatgcaaaagctcacatctaactcttaaaatagtagtagttcattcttattctggttggagtaagttctgtggtcattttcctggatttcaataataacctctaaggagacttgatgaagtatacagattgtctaggatatttaaaatgcattttcttctataaattagaatgttacaatgagtggggaccctggtatctttacctatagctgactctatactcattgcgtaacatctcagccaaactgatttgcaggccagattctagcattatagggtgatacttgcacacgtgttcctcagccttgggtttgccactcctgctatccttggaagttggctgacttttgagacttacaggaagagagtaaacatacatttacaagtagtagtcaagtttctgtgtattgcttggacatatacgtggaaccttctaattggcaataatacttttggaaataaacattgcatgtgtggtttttttttgttgttattttttagatagagtcttgctctgtcgcccaggctggagtgcagtggcgcgatctgggctcactgcaaccttctgccccccgggttcaagtgattttcctgcctcagcctcctgagtagctgggataacaggcgcgtgccaccatgcctggctaatttttgtatttttcgtagagacggggtttcaccatgttggtcagactggtctcaaactcctgacctggagatccgcccgcctcggcctcccaaagtgctgggattacaggtgtgagccaccacaccgggctgcatgtgtttttaatagaaatcagatgggatgggaaaaggtgggtgcttccttctttgtaactaatttcgtcagtgtagtagatttattttctcagccttttatcagtgggatgtgagctgtcctctgaaaactaacatagctcagactgttccccaggcaactgtgttccctgcggcagtgttgttgcacttgtacctccagtgcctatcagaccaacagttctagtctaaaagtggattgagaagacagtttgtgtagaactcgctctgggagagctgaagcaacgcctgccgaggcgggagctgctctggttctaagtgctgtctcctttgatcaggaattctttgagctgcttctccagcaagtactcctctgctttgacatgagccttctgtgagccgttgtgaaaagaaatgcatttcaccaaaactcggaagctgatctaggcctactgaccatgagagtctttgtagaacattaattgggaaatttgtaaattttgaaaatctctttgaaacactacttcatatgtaacaggtacactgtcagaaaaatggagacttggccgggcgcagtggctcacgcctgtaatcgcagcactttgggagactgaggcgggtggatcacttgaggtcaggagttcaagaccagcctagccaacatggtgaaactttgtctctactaaaaatacaaaaaattagctgggtgtggtggcatgcgcctgtaatcccagttactcaggaggctgaggcaggaggagaattgcttgaacccagaaggtggaggtttcagtgagctgagatcatgccactatactccagcctgggcgacagagcgagaatttgcctaaaaaacaaaaacaacaacaataaaaaagaggggtggtggacttaatcataagaaatagttatttgcaggccaggcgcagtggcttatacctgtaattccagtgcttttggaggccaagttgggaggattccttgagcccaggagttcaagaccagcctgggcaacatagcaagaccctgtctgtacaaaaagtaaaaaaaaaaaaaaaaaagtcaggcgtagtgtgcgcctgtagtcccagctactcaggaggctgaggtgggaggattgtttgagcccagaaggtcaaagctgcagtgaagcaagattgtgccactgtactccagcctgggcaacaaagcaagactctgtctcacaaaaaaaataaggggggggttattttctgttaatatatcctatatattaacatttctaaaacccttgtctgtgtctgcatgatacagtttaagattccgcagctgtcttcatcctttcggatgtaatcctagagtagttaagtatcaggtagtcaggtttgctgaagctcttaattgttggaggggatatgcatgtgtgacttcgtgaattggctaggctggtttcatttttaagcaatagccaatcctaggtgaagaaatgtgaatataaacatttcaaaataatttctttacagcaatagattggagctactgccctgtactgattcaacttactcgtcgttttgttttgttttgtttttatagcgggagacttttcttcttttggtagtatagagttgtgggaagagaatagaaaactccacatttgagtggggtttctgtctctaatggctttataatttgcttgatttccaagactagaaaaaattgtaaatgagcagcaagatactaccagctgttgtattgctttactcacatgtgacatgttgtattttttatttcagtgtagtatctaacgactcccgtgtataagaaagaacccgtggtaggtttctgagaagtacggagttaggcaggacctaggggccgctcttagggagcttcgtgaggatgctgtggaaataactggctgagatgtggtgcatgatctagcaagcactaagcagtttttttttttttttttttgagatagagtctccctctgtctcccaggttggagtgcagtggtgcaatcttggctgactgcaccctcagccaggttcaagcgattctcttgcctcagcctcctgagtagctaggattacaggcatgtgccaccacacccagataatttttgtatttttagtagagacatcggtttcaccactttggccaggctgttcttgaactcgtgacctcaaatgatgtgctcgccttggcatcccagagtgctgagattacaggcgtgagccactacgcctggcccactaagcagttcttactgcgtggatcagggcaggtgctgggaaaggtggtcatcgagccttaaaggataagtgacaggcattctgtgaggaggaaatatacatgcgcatggcaaaggagcatgatgctcttggggagtgagtggtgggtgtgagtaaggttttggtgggatatgaaattgggaacatcatttaggaccagatgcaaggcactgaagtgagggatcagaggctctcattttcttgctgagtagctggggaagaaccattgataactgaatgaccttctttaccaacttgggccacgtctcatattcttattattattttcaacaaattactcaagctctcttattaccaattagcaggaagtccagtgtctccttcagggtgacttttcttgaccaagaattgtcctgtagaactccaagggttgatcttgttcaaaggggttagccctgccacgcggtgggagagctggagggccctagagctacagctctcccagtttgcactcgtgcacccagttcttactcactaagtacagctgctcaacaggtcaccgggtccccaggggcttccagtcacaggtgtgggatgtcccgagaccagccctcttcatgagcatccaggccttggtgttgagcctgagtcaccctcccatggtgacttcctctatggggcttttgatgttcttgcctgcagcaaacctcagttggggacatcagtaaatcgtgttccttttgaacttctattgggaaggaatgagggcctctccttttcctccaataggctctgtggctcagatgcagaattagccagtgagttttcaattcttgggaaggcagtccttggtcagaacccagaagatacttctcttctttttccagggcagtgggtgcctccttcactgatctttggataactaagagagggccactccagaactctcccttgttaacagggatctccagtggcctctaacacatgggaaggtccccctcacaagactcctgctgcacttgataaaggttactggatagttgatcagttctgcgatttagaaagataatgatatgatgttgtaatggattgaatattaatgtactccaaaactcctgttaaaatcctcgccctgaggtgatggtactaggaggtgggcctgatggtactaggaggtggttctttgtaggtgattagctcatgaatgagatccttgtacaagaggcctcagacagctgccttgccccttccaccaagtgaggacacagagaaaaggcagctgtgcaagaaccagagagcagccctcaccacacactgaatccgccggcacctggatcttggactccccaccctccagaacttgtaagaaattgattcctgtttacaagccacccagtctttcgcattttgttatagcagcccaaactgaccaagacagttagaaagatgggactggtggtaaggccctgaaacagggtagacgctgggactgagatgaagagacacatttactgaattttttttttttttttttttgagatggagtctcgctctgtcacccaggctggagtgcagtggcgcgatctcggctcactgcaacctctgcctcctgggttcaagcgattctcctgcctcagcctctcgagtagctgggactacaggtgcccaccaccacgcccagctaattttttgtagttttaatagaaatggggtttcattgtgttagccaggatggtctcgatctcctcacctcgtgatctgccctcctcggcctcccaaagtcatttactgttttaaacaaaacaaaaactagttacaaaggtagaattggcaggatttggtgacctcttagatatgggtcaaagctaaagcttgtctaacttgatagtaaagacttgaaggcgtggagtaggagaaacagtgtgtagaggataaggtaattaattcctttttggacacactgatatatctgcagtcctattggagatgtctagctggcattgagtatactggtgtgctgaaaacctaggtgatcactaaagttgagaaagcaacttcagagaacatttagaatgaggaaggtagacaactggaatgcagcctggggagctgtagtatttaaggagcttgggaagaaagaggaatcctgtgataccaggaggctgagagagaatggactgtagaagtaagagagtagaagtggtagagtggtttcaactgagccaaggggcagagggctgcagggaggtaggaggtgggggtcaggagtaccaaataccatggctaagaggctggcacccgaagtggatgtaaactcagggctcctagttgcaaatcacaaaaaatgactctggctaatttaagtgtataaggaaatcattggaagggtgtgggggaagttacagaacctacaggaagtacagagagccacgcccagaaaactgaccgtagacgagggaagcgggacagtcagaaccacagccgcagccgagaccacacagtctggctgaggttgcccagtggctgctgctgcagccaccactgctacagtcctggctgttgctggcactggcaaaatgatttccaaattgtctgtttcttgtcacactctttttggtctgagccctgggcagaagttcgggcttctgcgattggccaggttcacaacaggaggctgcagggagaaccaggacctggctcttttgcttctgtgatggcaagtggtccatcattacaggccatgtggtccacctgtcacgatagccttagaaggagcaggggaatagcagttgggagaagaataaatggagaataggaagtgggagtgccgggtagagcatctccaaggccagcagtcagactcagagcttgcttaatctaagagtgtgtcccggggtgcttcttgtagttgcaactcttaaggcctccttgaatctggctgtggtactcccaagattggagaaccaattagcctgctggtttgtttcaataaccagaattgtgcatatgtctggaatgagtttaagggtggttatgcttatcaaggattggggattggcaatgggtctagtggaagggtaaaaggtaagacagccattcaaaaaaaggtgcatcttggtgctgaactgggagggaagcaaagtcttgagggtgcagagagatcaggaaaagaggcaagtttaaaactcagatgcaaacgggggcaagaaagcagaacaggtaaattgttgcaggttatggccagagaataatttctctggagatcaggctcgttggagagcctgttccgacagtgaagattcaggtggtgttagcagggtgccttgtggcccgggtcccgatgcctttaaaccattatttgagctcctgccctttggtttgatcatgtgctcacatgacaattttccaattataaatgggatccccacttgggggataataatcatgttaatatctaggattctcttacctgtgataagtttttatttgtttctatgaattgatcaatcagcattgagagaatgcagtaaactatatggccaaagactcatatttgtttggtagctgttatttcttattgttaatttatacatgggcacactggtttgatacatacatttctccagtgtgctgaatgtgtgtgtgtacctgagaggtggatctgttcctggcacgtaaagcagtcctggagatgagcactgctgggtgaggctgcctgggagacaccccggcctcaccaccctgcaaagactgagacgctgtcttgacatcatctgagctgtgagcaggctctgccctcctgcagggctctttggagtcttcgtgctcactctgtttcctttgcccaggaggctcttctcccagtccccactcttggtctggccaactcctcttcctcctccaagtcccttttctcttttctctcgtagagtttatcagtgttttgaaataatacatttgagtgttaagtgctgcgttccctactaactaaacagaaagcgtgaggagggcagaagccctctgcccgtccccactcatgcatcatccgactgcagacagttgtctggagagagcaggcaggcagtagtgtttgatgaagtctaaggcgtgggttagtacaggtgagaggggaaaggcctgggtaactcagggagccgagtggctggggtgactgtggggaaagtgaaggcacagtaggaagtctgtgagaacagctctgtgtggagccacaaaatcactgatttcaagatgaaagtggccttattgacttttttcctgagattgtgtaagtacaggctcttaaaaaaattatagaaaattacaaagaagaaaataaacattacctataatcctaccgttatcaaccttttggtttgtataacttttttcaaaatacgggattttatgtacttagagtgttgtacccattttttttcatttactatgttgtagacttgttttcatgtagtaaaggtttaccttgtcattacatggctgcattggatccttctcatgtagtaaaggtttacattgtcattatgtggctgcattggatccgtggcatgaaacttgctgtgtctagtattgtggacgcttaggtctcttacatttttttcaccgtgtaaaccccactgtgatgattattcttcctgttgtaatttcagtcccctaagacacagaattttaagtctggtggctaatagagtaagcagaatgataattaggattccaggtttttatttttgactagttttgtttctttgggatttgcattagttattctatacagcttaagttcccttttccctgcggtagaacgggaataggtatcttaactgtaggtgcctgagactctgctttatggagatatactccttgtaagtttccagctgaggcaccaatgttaatagtggttaatataatcagaacaataatagcaacaataataacggccacatgcatcactttccattcggactgagtttgtttggtggtctcacaaccatccttgagttgagatgggtttttttattttatgtttatttttatttatttttgacatgtagtctcactctgtcgcccaggctggagtgcagtggcataatctctggcttattgcaacctccacctcccaggatcaagcgattctcctacctcagcctcctgagtagctgggattacaggtgtgcaccaccacacccggctgactttgtatttttagtggagacaggttttcaccatgttggctaggctggtctcgaactccagacctcaagctatcactcaccttacctttccaaagtgttgggattacgggcatgagccacccagcccagcctgagatagataattccatttttttttttttttcttttgagacagggtctctttctgttgcccaggctggagtgcagtggtgtgatctcagctcatggcaaactccgcctcccgggttcaagtgtctctcttgcctcagcttcctctgtagctgggatgacaggcacctcccaccatgcccggctaatttttttttttttttttttcagtagagacggggtttcactatgttggccaggctggtcttgagctcctgacctcaggtgatccacccaccttggcctcccaaagtgctgggattacaggcgtgaaccactgcgcccagccctgagatatgttctatgagccctactcgaccgctgggaaaactgaggcttaagcagattagataacttgcacaggcttgtaagggtgcagttgggcggtggaccactgttgcttgttcctggagtctgccgcagcaagcacgctttcttcattctgtgtgtctcataggaaaatgagcacacctgatatcagtgaagtataatttctttataagtttaaagagactgtttttaaactagaaacaaatgttttgtcattatttagacatatgtaaaattaggtgttaattgtttttctttggctatagaggagtagcagatgaagagaagcaagtaaggagaggctggcattctggccaactttgataacgacatagttcctctttaggtcctctacactttatttggctaattcaggttttacttctgttccactgttttattctgttgctagacagctgttaaacatctgttccctctgctcagagggggtgtggttatcttcatatgtctacacagtggctttctgtatcctgttcgtatgtgccctaggagccttcagaataaaggggctcggacagcgattgcacagtgtcttatgttttccttgtcactgcatcctcaataactcactaattaccaataaaaatgtctaacaaaattagatatttttcccaccagaggaataaaggaaaagaagataagattaagtggaaggaagaaatctatttaaaaaggggcggatttttacattcttaaaaacacagccgtgttcttgagtgtgagggaatccttttgtggatctggtctgtgggaggggttgatagaaagtgtgggaggaccctgctcagagcgggaggcagcccggatttccagaagcgaaatgttaaagttgagcatggtttggatgcagataagaagttcttttgcttcctctacttgtgttaaaactgttcattttttatttttaaggtcatctggggggagtttctttgcttccagcctggatctctcagtgtggcctgacccctgaatcctaccctcccacacaacttgagaacttgattcttttctcacaaagacttctttccaacccctcccctccccctagaagactccatatttggagctgagtattttgaacagggccctggccagagggcatgttacatatgttgttctgtcccatgtacatggaaaagcataagctttaaagcaaatgtatataaaaaatggaaaaggtccctctaagccagggacacatgattttctgttatgaatgtgctgtacttatatgatcattctctttaacttgcctctttgaaactggaaaaaaggtgagcagaaatggctggaggtaatgaaagggaatagagaatcaaggaaataatttctttgaccattcttttgtgagccttgggttagcagagttaaatacttaaataagaacataaaataagggaaagcttcacatttccacattcattattaaatactttttaaataggagaatgagtcagagtgaaccctagcaattatctcgttgttgttgaaatctagcccacctaccacattttcataattaaacacaggcctgaggcaaacatcaggttctcattctccagaaagtgagcacttgtataccctggttcagccgaggtccagtaaggttacttgttcacattcactgtggaattctctgcttgggaaaccatcatgttcaggaacattctcaataaagtttatgagatatcgtattggcctggaacatgcacagagaatttgacaacccgtttgggtggaggaatacaaacttcgtaattattgaaaacatagttgttgtaaatgcttccctttggtttgcttacttgggccccaaccagaggttttccagccttggcaaagctgcctaaagccttttgtgtagagtaagggccctgatagtggcatcctcgttttgattctgtctgtagtgggaacgcttccaagtctgatgcttgttgtaggtttctgccagaggtccttcacttaggttaagacatcttctattcttagtttaatgattttttttaaatcaggaagggctgttgaattttatcaaatgctatttttccatctattgagatgaacatatgtttttcattatgagcctttcagtactatttgacttttttttttaaaccatttgcacttattatatccactgacttgaggcttaaaattccttcaaaatgctaactttacaaccatcttctgcatgtgtttttctttgaatataatttttccatcaatctgttcctatctgctttctttttttgtagtgatttcagcatctctgggctgttggtgattttttattctttaaaaagcctcttctatcatttcatgggtttgtcaagagagcgggcacaccatgtgccagccctttccactttttttttttttttttttagacagagtcttgctctgttgcccaggctggagtgcagtggcgcgatctcagctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcgtcatcatggcccgttcttgatggtcactgtctcttcagagctgttgggtacacttcccaggacggggcggcctggcagaggcgctcctcacttcccagacggggcggcctggcacaggcgctcctcagttcccagtatggggcggccgggccgaggcgctcctcacctcccagatggggcggccgggcagaggcgccccccacctcccagacggggcggccgggcagaggcgctcctcgcctcccagacgaagggcagccaggcagaggcgcttctcacatgccagaccgcatctgcatttaagaggagaagtgaagcatccttattcatttttatttgcttcaaataatgaaggaaaaaattacctgtcagtaaaggctgccagcaagtgtttagttcactttacatttattaattattgattgattgactattatgagcaggccaactggagtgttgtttgaaactgccttttaaaatgttcttttgtcatattagctgttttgtcaaataagagttaaccgtcacctgaaaatgtggaacactttataataatgtataatggttatataaaattggttcagttttttttttgcttttttgggttttgtttttttttttttgaaacggagtctcactctgttgcccaggctggagtgcagtggcgcgatctcagctcaccgcaacctctgcctccctggttcatgccattctcccacctcagcctcccgagtagctgggactacaggtgcccgccaccacgcccggctaatgtttttatatttttagtagagacggggtttcactgtattaaccaggatggtctccatctcctgaacttgtgatccacccatcttggcctccccgagtgctgggattacaggcacccagccaaaattgattcagttttaagactcagcagttgagagtaacatttgcctgggattcttctctgtatgttaaaatgttaatgactcctctcttcagcaggtgtcatcactgtgacagggatatgggggggaacacgaggcacttgccttgagaacagagacagagttaggcattatcgacaggtgctcatttggtatcacattttaaaatgactaagccctaatcttccttccgtgatgtcccttgacatctctgcctttggaagtctggctgctttttcattagcaccttgatcacatctcactcagaggctgtgaagggcaccctggcaggagggaccaaagctctttgccacatactctgctctgtcctgctgcttttccctggaatggctgccaggacctgtatgactggaggtcagatgtgtaagtccttctgtctggtcacgagggtataggaaacatctggtttttccttaccttatgcaatataaagactgttttttagttttttttgtttttgtttttttgacagcgtcttgctctgttacccatgctggagtgcagtggcaccatcatagctcactgcagcctcggattctaggcttcaaatgatcctcccacttcagccttcccagtagctgggaccacagacacgcctcactatgtctggctaatttcctttttattttttgtagagctgtcctcccacctcactctccctgagtattgaggttacaggcgtgagccaccatgcctggcctaattttttttttaacttcattttgaactaatttgtagattcacagaaagttgcaaagataacagtacataaaggttccacttgcccttcactcatttcctcacactggttacatcttatgtaactgcaatacagtatcaaaatcaggaagctgacattggtatgaggtgtttgtatagttttgtgtcatcacccatgcgtagattgatgtagccaccgctgcaatcaagatacagaactgttccatcaccacaaagttatcaggctccctcctactaccccagttgtcttctcctcaaccaccctaaaccccaaacaatgactaatccattttccacctctgagatgttatcattttgaaatgtcacatacatcaaattatataatatgtaaccttttcagactggggttgtttctgggtttttaaaaattcagcttaatgcccttacaatccaaccaggctgttgtgtgtatcaatagttcattcacttttattgctagataatattccatggtatggatatatatcacagtttatttctccatccacctattgtagaactttggttgtttccagtcttaggatattacgagtaaagttgctgtgaacattcatgttcaggtttttgtgtgggcatacattttaatttctctggaataaataaatttctcaggtgatattgctggatcacatggtaagtgtatgtttagttttttttttggagaaggggtctcactctgtcgcctaggctggagtgcagtggcgcgatctcgacttacttcaacctttgcctcccgtgttcaagcaattctcctgccactgcctcccaattggctgggactacaggtgcccgccaccacgcctggctaattttttgtattttagtagagatggggtttcaccgtgttgcccaggctggtctcgaactcctgagctcaggcattccacctgcctcggcctcccaaagtgctgggattacaggtgtgagccaccgcgcccggctgtgtatgtttagttttataagaaaatgccaaattgttttccggagggctataacattttatgttcccaccagcaatgtatgaaagatccagattgtccacatctttgccagcctttggtttttttttttttttttttttgagacaggatgtttcgagactttctcccagtctgtagcttctcttcatccttttaatgctttgcagagcaaaagtttttaattttgatgtccaatttattatttttttcttttatggattctcagtcacgtttgtggattctcagtcattactaagccttcgctctcaaagatttttctcatgttttcttttaaagttttatagttttacatttaaacttatggtctactttgagttaattttgtataaaatatgaggtttaggtcaagtttcattcttttgcctatgaatagccaattgctgcagcaatatttattgaaaagaatatctgttctgcattggaccgcttttacacctttgtcaaaaatcacttggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaatacaaaaattagctgggtgtggtggtgcatgcctgtagtcccagtcacctggctctgagtgtgggctcttctgagttctctcttctgttccattcatctgtgtgtctatccctctgccaacaccacagtcttgaataatatagttatgtaagccttgaaattgaggagaataattcctccaatttgtctttttttcaaaattgttccagctattctgattcctttgacttgccattataaatttgagaatggtctttgctatctcttaaaaaaaaacttactggaaatttgataggaatgagtctttttcattccaagctagtggagtttctactttttgaacatcctcaaaaaccttgtgggtctcctctgtatttcacagggatttcacaggggacaagagggccctccatagatcttacctgtgcggttctgtttctattcctggcttttgctgagagggttgaggggattcatgagtgacaggcttaaatctcttcaaagagctttctgtgtgaatggatactctcaccttttaattcttccagcatactagcaaaacattggccagccacacccttgtctttccttagagcactttttcctgccagtgaatctcctaattttattgtcttttgcaatccatgcaggctcagaatttcccaaattaagccctggttcctttttgcataatagtttctcttaatttctctcttctgcattttactataagcgcaagaagaaaccaggttgcacctttaacactctgcttggaaaatgcctcaattaaatatccaagttcatcacttacacgttctgcttttcacacagttgtaggagataattcagctatgttttctgctagtatataatagtttccaaaaagaggtggctcatttctttgagtcctaccagcagtacatttaatgtccatttttctaccaacggtgtgcttatgaagatgtaggtattctctaagatgatacagactttctgtactctgctcctcacttctcctgagtcctcagtggcagtttttttttttttttttttttttgagacggagtctctccccgttgccagcctggagtacagtggcacagtgtcggctcactgcaacctccgcctcccgggttcaagcgattctcctgcctcagcctcccaagtagctgggactacaggtgtgcgccaccacgcccagctaatttctgtatttttagtagagatggagtttcgccatgttggccaggatggtctcgatctcctgacctcgtgacctgcccgcctcggcctcccaaagtgctaggattacagacatgagccaccgtgcctggcaagtggcacagtttttaacatccacatttctgtgatctgtttaaggcaatctaggctttctgtatcgtcatcttcaaaattattccagcctctgtcccttacaatttgaaagctggttccacatttttaggtatttgttatagctgcaccctagttctgtatttgtttcccgaggctgttgtaataagttaccacacattttgtgccttaaaatagcacacatttattcttgtactgttctagaagtaagaagtctgaaatcagcttcactgggccaaaatgaaggtgtccaatgggccgtgctccatctggaggagagaatgcattttcttccctttcccagcatctagagctgcatttccttgtccatgacccctctctccatcttcaaacccagcagcctggcatcctgcttcagtcatcacgttgccttcttctgtgtcacatctcctgtgctttcttcttatatggacattttttattgcatttagatcccctggataatccaggataatcatctccattgaagatgctttttcttttctttttgagatagggtctggctctgttgcccaggctggagtgtggtgtgatctcggctcactgcaacctcccacctccccggctcaagtctcccacctcagcctcctgaatagctggaactacaggtgcacaccaccatacctggctaatttttgtatttttcatagagatgaggttttgtcatgttgcccaggctggacttgaactccagagctcaagtgatctgcccacctcggccttccaaagtgttgggattacaggcatgagccaccatgcctcgctctccatctattttttttttaatctaaaattcttaattctatttgcagagttccttttgtcatgtaagttaacattcacaagttctagagattaggacctggatatctttgggggtcaatgattcagcctactacaattttctgtggggtcttgaaaaacatgaatattatgctgttggtgggagtgttctataatctttctgagactttgttggttgatggtggtggtgagttcttctctatacttgctgattctttggttcattaattattaacaagagagaaaggcattgaattctctgactataattgttgatatctctcagctctgttgttgctggaatcacatattttgcagctttgtttggtgcatatacatttagaattgctatgtctttttgatggatcattatatagtatctgtctctggtagttttctttgctctgaagtttactgtagctgttttattaatatagccacacctgctttctttttattaatgtttgcatgatatctttttcatccttttacttcagccaatatattcgaatataaaatacgtgtatttgaagtgagttttttgtagacagcatctaggtgggtcatgtataatttttaaattctactctgccaatcttttaatatttaacatttatatttagaccttttacatttaagatgattattggccaggagcagtggttcatgcccgtaatcttggcactttgggaggccgaggctggtgggatcacctgaggttaggagttcgagaccagcctggccaacatggtgaaaccctgtctctactaaaaatagaaaaattagctgggtgtggtggcacacgcctgtaatcccagctacttgggaggctgaggcaggacaatcacttgaacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcgttttcctttatttaagaatgtctcaatttccctttcattcccaaaggataacttcaccagatatagaattcagggttgacagttctttcttcacttgaagaatgttttgctacttcctctggccattgtggttttgatgagaagcccattgtcatttgaattatctttctcctctataggtaaggtgttattttccctggttggtttcaaacatttttctctttcagaagaatgtgtatcatgtgtcttggcataggtctctgggtttatcctgtttcaagtttgtttagcctcttgaattcataggcttatgttttttgccaagtttgagaagaagttttcacctattaaaaaatgtttttctagcccaccctttttgtccttatttgtctttttttttttttttttttgagatggagacttgctctgtcgcccaggctggagtgcggtggcgcgatctcggctcactgcaagctccgcctcctgggttcacgccattctcctgcctcagcctcccgactagctgggactacaggtgcccaccaccacacccggctaattttttgtatttttagtagagatggggtttcactgtgttagccaggatggtcttgatctcctgacctcgtgatccgcccgcctcggcatcccaaagttctgggattacaggcgtgagccaccgcacctggcctgtcctcatttgtctttagggaaattatctgtacgttttgggactatcaagtgcccctgaaccgtggagcatcttctgctcttgggtcactagagcagggggaataatcaggaagaactttctggtgttactcagctgcgattttccttgtcaactctcatgtgctccatgttgtggagtggcgttttaaaatccaaccagtactctttcagaacacttgaagtaacagaattctcagaggaagagagggcatcctatcccattttcttcacacacaaataactctgtagttttgtgtaaggtgggttctgtttaaatttttgtctttttaaaaatttaccaaaataaccttactcttttttttcaagccaatcaaaatcaagataagaaaatactattgtctctatactaagagtatgactaggcagctctttgcctgtggttgcgaggagccacagcctttcacagagcgaatattcgctttggcatcagtttttatcatagttggtactttgatattaccgtgggaaatcttgtcaatcgcatgtgtcctttaggttagatgagaaggaaacaacacatcttacaggctctacttgtctcttgaactagcaagttatttttgcttattaaaaattttgttttgtatggtttggtgagagtatgctcagtttgttttgttctgaggtcattcctaggccaggtggaatgtggccctcttaggtaccagctctcatagtggggaactccagggctgaaaatgacacttctctttggaaaaagcaccagtttgtatggttttgaagagccagatgctgtaggttatttaggaatacttagtaatatttgaagagaaaataaaagtagtaatttttaaagcattccttatacacaaaattaagggaaaatgccattaaaatcatttagaaatctgtagagttctctaatagtcaaggcttttaaaatttatttcttatgttttgaattttcaaaatacttttcaacattttagtatgaaaaatttcaagtacacaaaaacgttgaaaggctatacagtggcttaggtgtaaaccccccacctaggctccacgattaacctttcactgtgtgtgctttatcacatggccgtttatccgtctctcatcgatccatccatccatcttactttttagacatttcagagctggaggtgtcagtgtactttaacttttggacctgtttttctcttatttgtgtggtccaagatgggccctataaaaactttgaatcaaaatatgtcttctgagaagctctagttcctcttacaaggtcaggggagtctgtgacactgctttccctgcactccatgagccttcctaaaaggatgctgagaataactcctgtgctctgatgcgttatgtggctgagaagcactgaaacttcatggagccaagttctcctggtgggcagagagaacatccagacagaatgggctgtcttctgggctgggcccctgtgatgggttcctgccttgctggcttccaaggaacagtgttaatcttctgcttgggtgtaatcttgaattaactgaggaatctaggaaagtgcatgagattgtgtcttcagacacccgaagagagcaccaaagctgtgagatagtcacacttaggaactgtgcttccctagaccattggttctcaaggcccctgggggttgaaggccaaggagattaaatttttcaaattgggtaattaaagacaacggcaaaacaaaaccaaacaaacaaacaaacaaaaaaccatggggacactttactgggattgagattgtattgcaaagaatggaatcagagccgtcgttgttgtagataggcaccaacgttattaaagccctcttgactttaagattgacacaaaattgtggaaatcttcctaaaatggtgttggaggttcctcctttccccaaactcttttctataccatgcaacaacggatagtgctgggatatattttcaggaattcacgaagaccgtgaaaatgaatgaaatagctcttttaattgcaaagagctaataaacatacatctcatctctggagcaccttttgtgaaaagcctgtgttctgagtagtctgataattcagcagatatctctgagttcccactatgtgctagtcacggttcttggtgctgggaatttaataatgaaccagacaaggaagaaccctgtccttgggagttgacattcttataggaggagacataaactaaacaataagtcagcgggatgctactaatagtattaatacatggcacttctaggtgcagtagttactgttatccctattaaagatgagatgactgtgtggaaaattggaaaccttgtgcactgttggtgggaacgtaaaatggtgcagctgctgtagaaaacagtgtggagattcctccaaaaattagaaatcgcactgccccagtgcccttcacaatgggcaagagctgaagccatcagagtgttcatggccagatgaatggataagcaaaatgtggtctctccatacaatggaatattactcagccttacaaaggaaggaaggctggtccgaaggtagtgagttatatcgattgttcagttacaggtctaactccttattctactctttcctcccttctcactactgcatttgactaatctttaaaaaaaaattgaaaatgtttttaaaaaaggaaactctgtcacatgccacaacatgggtgaaccttgagaactttttttttatatttatgccaggtgaaataagccagtcacaagacacatactgtgtgattctacttatgtgaggtacctgagtagttgaattcatagagacaaagtagaatggtgggtgcctggggatggggaaagggagaattggggagttagtatttaatgggtacagagttttacaagatgaaaaagttctagagatggatagtgatgatggttgcaaaacagtgtgaatatacttaacagtactgaactggacacgtaagaaaaaatggatgccaggcctggtggcacatgcgtgtagccattacttgggaggcaaaggcagaatgactgcatgagccctggagttcaagactgctgagtcattattgaccaccatactccagtgtgggaaacatcgggagaccttgcttcaaaaaaaatggttgaaattgaactcatggagatagagagtagaaggatggttaccagaggctgggaagggtaaaggggagataaggatggttaatgggcacaaaaaattagttagaaagaatgaataagaccctagtattttttatttatttatttatttatttttgagacagcgtctcactctgtcgcccaggctggagtgcagtggcacaatctcagctcactgcaaccttcacctcctgggttcaagtgattgttgtgcctcagcctcctgagtagctgggatgacaagtgcaagccaccacacctgactaatttttgtatttttagtagagacattttggccaggcttgtctcaaactctgggccacagtggtccacccgcctcagcctcccaaagtgctaggattacaggcatgagccaccgtgcccagccaagacctaatatttgatagcacaacagggtaactatagtcaataataatttaattgtacatttaaaaataaaagaatatatttaggccaggcaccgtggcttactcctgtaatcccagcactttgggatttgaactcctgagctcagatgatccttctgcctcaatctcctaagagtctaggactataggtgtgcaccactgtgcccagctgtgttatgcgttttaccacaattaaaaattttaaagtttttgaaatgagaaaagcaaagcacaggtgtccggtcttgcacagctaatgaagtggtagagccaggagtcaggctccgcagtgtggctccacaaaacgtgcattcagccatcattctgttctgcttccaaaacactctgggtaaaaagtgctatgaaagaaatacaacagccatgtctgatagaaagcgattgtgcagggagctgagagtctgtcctttagacagggtgatcagggagggcctgctttgagcaagggagctggagggagctggagccagccaggtgctcaggagagtggttcacaggaggggatggtgccccagtggcagatggggtcggatcagggagggcactataggctcaggtgaggaactcggattttgttctgaacccagcgggaagtcatatgtgttttaagcagggaagagacatgatttgatttatattttcatgagtactgccaaaacttcacttggaaaggaaattgagaaaaaattccggaatatcgatttctccattttgtgatcaaatatcaaatagaatacttcaggttttacaaaagattaatcctcaccctgctttttggtgctgtttgaagcattttaagtgtaacaactcttatcagtgaaggcaatatgcccaactgttttcttggaagacacttagttaaagatgctgaggaggaaaaaatactgctttcctaagcctggcaccactactcaagatgatgtgtgaagttgtgtcagaatccatcagagttaatgaaatggtttggaaaaaaatgactgacaagcactgggggtttcttttggggacaccagcagcatgaactctgtcttagatttcacgcatttttagccaaagttccacctatggatataggaaattagttataaaaatgtttttatcttcccaacttaagttctcaaggccaaagattttgaaaaaacttcaatgaaaaggataaatctaatcttaaattttaggtgacgtctccttgacatggtagttgaaaactcatttgaaatttgataaggaatcttctttcatattctgtcgcatcttcaagaggacttgttgggagtttgggttgattaaattgtcagagatgactttcacaaagttgtcttagagaattatttggtagctttggatgtcattatccctactttaaaaatgttattaatagactttagtttttagaactaatttagatttacataaaaatcgagctgacagtatagagttcccatctgctcaccgcctcccagcacatagtttttctgttattaacatcttacattagtgtggtgcatttcttacaatggataaaccaatattgataccttgttactaactgaagtttatggtttacaatagcatttccttttggggtccttggggtcctgacaggtgcataatgacatggatccaccattaccgtatcatacagaagagtttcaccaaccaggagtcccctgtgctcagctattcatccctgtccgtgtccccctgaacccctggcaaccactgatccttctgttgtctcagtagcattgccttttccagaatgccatctagttgaaattgtacaatatgtagccttttcatattggcttctttcacttagccatatacagttaaagttcctttatgtcttttcaaggcttgagagctgatctcttactatcactgaataatatttcattgtctggatgcatcatagtttatcgagtcacctattgagggacatcttggttgcttcagtttttggcaattataaataaagctgctataaatatttatggcagattttcatgtggacatagtttccaactcagttgggtaaattccaaggagggcagttgctggatcgtattgtaaggctgttgagcttggagagaaactgccaaactgtcttccaaagtgtcctcaaatggtttttagtcacgtgcatttgtgaagctgctcccccgcaccgccaacgacagcttctggctgtgaaagaaactttattcaggtttgatctcagaagttgtttattttactctgtttttcagttagctagggtagaaagtctcaatgtctattactagtttttcatgactgaggtcaacatattcatcgttcaagatcttacaatattttttgttttgatttgttttgagatgcagtatttaatttgaaatttctagtaatattcaagaagagagtttgattagcttgagatagtagtagtatcccatttacaaatgaggaaactgaggcatagagcggttaggtaaaagacgctgtgcctaaaggcgcagagctagtaagtggcagagagaacatttgagacaagtccagctgcaagattgactgtgtcacattgcctctctatctgttgcattcatgatttaaggacttatctattcagtgctgtattttagcagtgcttctcaaatttccctgttcaacaaagtcatttgggaagcttgttaaaattcagagccctgggcttcatacccagaggttctgatttggtaggtttgggatagggtctaggaactctattttagacaattacctccaagtgtttctgatggagaagatctttagaccatgttataaaaaactgctacagaaaatgaactctaggccaggcgtggtgacccacacctgtaatcccaacaccttgggaggctgaggagggaggatcgcttcagaccagcctgggcagcatagcaagaccccatctctacaaaaataaaaaatagttggatatgatagcaggctcctgtagtcccagatacttgggaggctgaggcagggtgattgcctgagtcccaggagttggaggctgtggtgaactatgattgggccattgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacatgctgttgttgttgagcattttagttctgttcttactctatgagatgttgttatcttacacagtcaggttttttaagatttacttatggaaaccagtgctcatcattttctcttgatgctcacacctcctgtactggatcccttctcttgattgaacttatttaagaatttctgttagtgataatggtgcaccagtggccaactccagtttgtgtctgaaaatgtcacctttcacctaatccaaagaaggctgggtaaggaaccagtgtcctggaacagtgaagatcaccacatggagattgaggagaaatgacaagaaagaaggttccaaggaggtggcgagaatcggacccttggagcctctgcggctttcctgcctgcccctgcagctcagtgcagcatcctggctagctgcggcatgccactcacctggccctttccgttgttgctaacacgtgactgccctgttacccacctggatgtcatagtttgaatgctgctttatcacccactgaggtcacccgactgtcgagtggtgaggagaggcagagcgcagcccctggcagctcagagcctgcccttttgttctgcgtgtcatcatactgcttcagtagtctccagaaactcatgctcatttaacagttgagccaggcaaggtggctcatacctacaatcccagcactttgggaggccgaagtagaggattacttgagcccaggagtttgagactagcctggacaacaacatagtgagaccctgtctctacaaaaacaatttgaaagttagctgggcatggtggtacgtgcctgtggtcccagctattcaggaggctgaggcgggaggatcacctgagtttgggacgctgaggctgcagtgagctgtgattgtgccattgcagtccagactgagtgacagagcaagatcctttctcaaaataaccagtttaaattgctggatataacagtgttatgagataggtgttatttctgtgtgtgttaaaccacggctccatgtagagtttccatgtagtggattaactgggactagtgctcaaagcccatgctttgccagtgttctgtttcctgcagaatcggccagtctctgaactgaccaaaaatctaaaaagctccatatcacaacaaaaattagtattgattagtaataaaggtaaacttaagggtaagagaatcaatttcaattaggactaggtagccagaaatacacagttgtgagttaaatgaccaaatttttgttcagggtacgtattatcacatttgacttacagtgactaaaacatagtgagggttctggccacagttcataactgtgaaactccatctttctccaggagaagtcataggactgcgagtgaactccgtggaagatctcatatgtttgcatatacatgtatataaaatgtgtcagggtgtcactatttatagcagtaaactagaaagctgcagcttcttggtagattggaatctgttagataactagattaataatataacttgaaagttagaaagtactgaatcaacttggagataccacttgcttattttttaatatgagtatctgtgacaatctcccatttttccttgattctgagatacaaattatacattttaaactgcctgaaattaagcatacatcttacaattgatgggctcttagattttattaaagatggtaaataagggaatgattctgaatttcttaatattattgcacactttgttagtggttggtttaggatttatatatacacctttcatttctcagtctaccatcaaatgatgttaaccatttcacatgtgggataagcagcttataacgtgtgctttcctttctccctcccaacctttgttctgttttatatttgttattaacccaatacatgtcgtattatttctgctttgaacactaacagtaaatcttttaaagaggtatctgtcatgaagggaaagtattcactcacatagttatcatttacaagactttcattgttttgcatcggtaacaaatttttatctggtatcttttctttccccctgcatgaaggactgctttaacatttcttgtagtgcagatgtgctagtggcaaattagtttaagtttttatatctgaaaatgtctttgtttcatctttatttttgaaagagattttgcagggtgtagaattttgttattttgtttgcttgtttttttattgtttattttttagagataggttcttgctatgttgcccaggccagcctcaactcttgggctccagatcctcctgctacagactccccagtggctgggactacaggcacataaccactgtgcctggctgtttttctacccccatcatttcaggcaacaggataaatccagtccctgttactccattgtggctggaagcagaaggtccacacttaagtactttaaattcctacaaacctgaacctaaaatatagacctcaacaactgtgagtctctgtgattttgcagatctaagtttgtggaaggctagtgcctgagaaaggcaaggattttggctgaatgatgtgaatttgctcctgattcttatgtaaagcttcactggcagcacccttttactaaaatggaggatttcctgccttctttccacattgttttttccttgtggaaacatttatatttgctatcaagaattagagtaagaatgttgaaaccgtatgtgctgcacagactcattctcttttagagcctgatgcattgttagaaataaaccagtgtgtccaacctcctccatcagacgagaactgagtctgaaggaccctttcctagcgtgtctggaatgtcaggattttatagggaagctcgtggtgggtgcattcaaccagctttagagatttcatgccagaccagtgatttccagttaacctgcccttttttttttttttagcagctttattgaggttggaggggaagttttcattgtatgcctttttatatgtttgtgtatgtgtaaccatatccatatattactttatccattcaaaaataaaccgctagatttcttgggaggaaaaaaccacttgacctttgtttcttcttacctaacagagtccaagtaacaaaacatacatgatgtcaataagtgaatccaagccttagataactttgattgaaggctggtttgttgctgtggaaaagatctggataattaaggacaccttctctgaacattgcttatcttcccatttttagtatggcggtcacatgtgtgaaattgtctgtgtatcagcagattctgtgactgcaaagttattttggatgcagagggatactgatagaacgtcactaaacagctggtctaacagctaggtgttggtatttgctatacaatctgggtgtccaaagacacaataggacagcaaggtacttagaagctccgcagagactggttcagaaatactttatcacatactcctatgccttttatttattccttttcatgtgtcaaggataattctgttacttcctagtaatgctttccccaaatatcctgagtgatattgctacagatgttactagccacttaatacctgaaagttttttttttccttttttttttttttttcttaagagtgtctcactctgttactcaggttggagtgcagtagcacagtcatagctcgctgcatcctcaaactcaagggctcaagcgatccccccacttcagcctcttgagtacccgggactgtgggcatgcgtgacatgtctggctaatttcttttctgttttttgtagagacagagtttctttgtgttgcccaggctagtctcaaactcctggcctcaagcaatcttctggctttggcttcccaaagtactgggattacaggcttgagccattacacctggccaaatacgtgaaacttaaatttttttttaacatgaaaaattcaaactcttagactgtaaaatggataatggatcaaatagatttaataattgttataattttgctcaattcttttttttccctctttgaggcagagttccactcttgttgcccaggctggagggcaatggcatgatcttggctcactgcaatctccccctcttgggttcaagcatttctcctgcttcaccctcccaggtagctgggatttcaggcacccaccattacatctggctaatttttgtatttttagtagagacgggatttcatcatattggccaggctggtctggagctgctgaccttaggtgatccgcccacttcggccttccaaagtgctgagattacaggtgtgagccactgtgctcagcctcaattctttttttgctaaagtatttcgaagtatagacataatagcattatatccctatatactatgacatgaatctctagaaaataaagacatttctctacacagccaccatgtctttgtcccactgtacaaaattttcttttagacgtggaaattctgattgcagtactggtaaagtaaacggctagtgcttattcaactccttagggccttaagggggtaggaaaagataggtattactgaaagataaaaatcaaggaaatcctttgattccgattaaaaggtattttaggatctttagagttaaatcattctggtgtttagattcactttgtacgtcttcactctgtgttaacaaccaaccctgctcatctttagggtaggaggagagaaactgtagatagactttcttaaaaaggaaacagaaatgtatgccgatgcttgaattaaagctctccccttgcaggctcttatttttctatatctgcacaggagagctcagcagaagaaaattcttttcgtaaatgttgttgacagacttgatttgaatcttcaggtacatttactttttagtaacaggatagtgtcagtcagctggttactattagatatactttttgccatattgaaataagatgcggctgggcgcggtggctcacgcctgtaatcccagcactttgagaggctgaggtgggtggatcacctgaggtcaggagtttgagaccagcctggccaacacggtgaaaccccgtctctactaaaaacatagaaaattagctgggcatggtggtgcgtgcctataatcccagctacttgtgaggctggggcaggagaatcacttgaatgtgggaggtgaaggttgcagtgagctgagattgtgccattgcactccagcctgggcaacaaaaatgaaattccgtctcaaaaaaaaaaaaaaaaaaaggaaaaaagaaaaaagatgctccctcagatgcgtaagagtaatagttttgaagatttgagaactgcctgcttgcttctttattttatttgatctctctgggcattcgatgttggttttctgcctgttgaaattctttattggctttcattctttcctacttctcacgttatctcttgatctcgatttctttgtgtttcttctccttcaacgctaagtgtggtgcgcattcattccactcgtgctctttagccgatcacagtaaaatgtcaggtggagctaggctgagccaaggagaatagagcatagactttatgggcttctcagaaggaagacttctcactcttgagagagacataggactaaggaagcatgtagtttcagttgctgggggaagcctagagcgagaaagagacagactttaggatgaaactgacacattggaaggcaggatgaacagactgggttaccgatgacatcgttgagctaccagaccacccaatagcatgttgcatgactttggatctccttgagcttattctacgtggactttgatgagcaccttggaggtgtatattcatgtcattcatcaaatttgggacatttcagccattatttcttcaaatattttttctttttctcctgggaaagaatcattagactttccctggctttggtttcctcatttataaaacgaggataataatggctgctcttagttatttggggggtttaatggagatgacctgttagttgatcagtaaattgtagttccttcctcattcattgcttgacatagaggattgcttaagaaaacagcagtgtgaatacaaaaaattagccgggcgtgatggcaggcacctgtaatcccagctacttgggaggctgaggcaggagaattgcttgaacctgggaggtggaggttgcagtgagcccagatcgtgccattgtactccagcctgggtgagagagtgagacgccgtctcaaaaaaataaaaaagaaaaagaaaaccacagtgtggaatttatcgacacttagatctaatacaggaagcaggaaattaaaaattttatgttaattgtattatttgtatctttgtgaagcatattttatttttttctgtttgagacaaaagtttactaagaaagacctgaagaaaatagtgtctttttgcaaaatttttttgctttgccatgtttactttatcataagctgaacattgtgttcttaatttatatcgtaatgaaaacatttaactgattagggatcacagtacctacagtacccttgaaaatattaataaatttgttctctttttttaggcataaccattgccatccaaaagttattttctgtgatgaacagctttttggtttcagatgaccattggcttatttaggaagaagatatggcctactttttctcttttcatttgtctctttcttttttctttttttaaaattatttatttatttattttttgagatggagttttgctcttgtggctcaggctggagtgcaatgacgcgatctcggctcactgcaacttccacctcctgggttcaagtgattctcccgcctcagcctcccgagtagctgggactataggcgcccgccacggcacccagctaatttttgtatttttagtagagatgcggtttcaccatgttagccaggatgctctcgatctcttgacgtcatgatccgcctgccttggcctcccaaagtgctgggattacaggcgtgagccacgtgcccggcctatttacttttttaatctacacaatgggcttctttgatgttattggtacatatcttctgttgcagtgcacagaaatttttctgatatacctgggagtaaaattgctgggtcatagcagatgcacttctttgatattaatagacaaattgttttccaaagttctctcgatgacaggtcacagtctggtgagattgaaatgcatgtgttgttttcaaggtttttttgttttttgtttttgtttatttttaaagagatgggagtctcgctctgtcacccaggctgggatgcagtggctggtcactgcaacctggaacccctgagctcaagcgatcctcccacctcagcctcctgagtacctgggactacggatgcgtgccatcacgcctggctttttccccaaggttttatattttatcagttgtacacgtattaaagagtcaactgtaatgtttgtaatgggggcaagcattgccttgccttgtcactttcttgtccccaaggtgtaaccacttttatccctttttgcttttttgtgtctgtttcggtatctgttttgcatgtcagaggcttacctccagtttgggaaggaagaagtaaaaagtgtattagaagctctgagtgcagcagaaggccgtgttgactgtttctctgtagggtgatgtgggtgtactggttgttggtgtctgcccctcagatcattatctttagagctgaagcctgtgggatgcttcagagaagacgcttgtcccagcctctgtccagggtggtgggagaggagtaaatggcccgtggcctgcagtcggggagcccagtggagaaggcggcttggtgatgagtatgtttgcttttatctctcacccctgtttttagtagggtgcccttgccctcaaacgtgttagaagtgccctagtctctctgttttgttctctaaagataaataagcagtcttccgtggcgtgggagagaagaggcaggcatccagtggcatttcaaagagcctttcaaccagttctccttattttagttgaccctccttcacagccccctccagagttacgtagtgaagccagagcctaagccttgtggggattctctcacgtaaattaggttacttggtctacgccactgtgggcttcaaagtttgcttttccatgtggattaaatcagctgtggctagtccagtttggcttcaagctcataaaaatgtggcggttctttctgtttccattctctttgttgtgacaggttttgagttttttaaattgctaattatgattactacagttttagtggatgtctcctttttttttttttttttgagacgggagtcttgctctgtcgcccaggctagagtgcagtggcacgatcttggctcagtgcaacctaatggaggtctcttgttgggattttaatttgtatttccttgactattaagagagttgacatccttttatcagcccattcatattaattttttggtcttgtgcctatgcaagtcatttgcccaatttccttttttcttttgagacggactctcgctctgtcacccaggctagagtgcagtggtgggatctcggctcactgcaacctttgctttcctgtttcaagcgattctcctgcctcagcctccccagtaactgggattacaggcgcccaccactacacccagctaattttttgtatttttagtagagacggggtttcactatgttggccagactggtccagaactcctgacctcaggtgatccacctgtctctgcctcccaaagtgctgggcttacaggcatgagccactgtgtctggccccatttgcccattttctaagcacggagttgttatgtcttttaaaaattgacttgtgggccaggtgtggtggctcaggcctgtaatctcagcattttgggaggccaagacgggtggatcacttgaggtcaggagttcaagaccagcctggccaacatggtgaaaccccgtctctactaaaaatacaaaaaattagccgagcgtggtggtgcacgcctataatcccagctactcgggaggctgaggcaggagaatcacttgaactcaggaggtggaggttgcagtgagctgagatcgtgccaccgcactccagcctggcgacagagcgagactctgtctcaaaaaaaaaaaaaaaaaaaaattgacttgtggctgggcacagtggctcacatctgtaatccctgtgctttaggaggccaaggtaggagttttgcttcaggccaggtgttcaaggccagcctgggcaacatagcaagaccctgtctttaaatttaaaaaaaaaaaaattagccagacatggtggcgcatgtctgtaatcctagctacttgggaggctgaggtgggaggattgcttgagcccaggagttcaaggctacagtgagccattgcagcatttcactgcagtgagatcctggccagcagagtgagatcctgtctctacaaaaaacaataatataatttgtaggagttacatattttgaatccgaattctttggcagtttctggctcagctcttcttcactctgtggtgtggaacttttggagaataaagtttttatttattaatttttttttgagacacagattctgtgttgcccagactggagtgcagtggcacagtcagcctcacagtcatgatcatagctcactgcagcctcaaactcctgggctgaagtgatcctcccacctcaggctcccaaagtgactgggcccacaggcatgcaccaccatgcctggctatttttcattttctttagttcagatgggggtcccactgtattgcccaggctggtctcgaactcctggcctcaagtgatcctcccaccttggcctcccaaagtgcttggatacaggcatgagccaccttgcctggcctagtttcttaactttgatataattaaatgtattaatattttcctttgtgatttatattttgtctatcttgtttaagaagtccttccctggctgagtgcagtgaacccaggagacggaggatgcagtgagacaagattgtgccactgcactccagccagggtgacagagtcagattctgtctcaaaaaaaaaaaaaaaaaaaaaagtccttccctaccctgaaattataaaaaaaattctcctgtatttacttctaaaaattgtgtagcgtttccccttcacatttatacttttaatccacttgtaattgattgaaaatatgtgtgattgataacatacaatctgcttttattttttccatataaataactgttttcacacatatttattgaagagtccagtctgtttttgagctgagtgtcagctctgctgtgaatcatattttcgtcggcctgtggtcttttcctgggcgctgtctatgttgatttatttatttatttattttaatttttgtagagaaaggatctcaccatcttgctcaggctggtcttgaactcctgggctcaagcgatcctcctgcctcagtgtcccaaagtgctgggattagagacgtgagccaccgtgcctgaatttagccttctttcatagtcatcattttatttgtgagactcatccatattgatagacttagctcattctttttaattttttttttttcccgaaacagaatctccctctgttgcccaggctggagtgcagtgatgtgattttgcctcactgcagcctccgcctcctgggttcaagcagttctcctgcctcagcctcccgagtagctgagattacaggcatgcgtcaccacacccagctgatttttgtatttttaatagagatggggtttcaccgtgttggccaggctggtctcaaactcctgacctcaagtgatccacccacctcagcctcctaaagtgctgggattacaggcatgagccaccgtgcctggcctgaaaaaatatttttgttggatgggattctattttatgaatgtaccgcaatttattcgtgttcttactgatgaatatttaggctgttttctggttataaagagcgctcctatgagtgtctcagatacagtctcaatgggagcatttctttaggataaatacctgcgtatggaattgctgggtggcagcatgtacccacctcaaccttgctggatgttgccaatgtgttctccaaagtagttaattatttttttcttctttcagtgcctgaagacctctcattagaagagagagaagaacttctagacattcgtcgaagaaaaaaggaacttattgatgacattgaggtaaaaaaaaaaaaaaaaaaccaaaaatccaaaactctgttttttgcttttgagtaaaatagtaaaagagtagcctcacaaaaatgtaaaaaaaaaaaaaaacccaaaaacaaaaaataacaaaaaaaaaagatgtttagtgtgtgcatataagaactacacaaagagacagagtgaaaagttatcaagttgggaaagcaaagactccacacaggcagtgagaccccgggtagaaatcaagacatcgtagaactgaggtcagcagtagccagctcgcaaacccagggccacaggcagcgtatcatctaaagcagcagcaagccacgagcgcattgctctgtcaaattgtgcactgagaccctctttcgttaactaatatgtttttttgtttgtttttttctttttgcttttttgagacagagtctcgctctgttgcccaggctggagtgcagtggcacaatctgggctcactgcatcctttgcctcctgggttcacgccattctcctgcctcagtctcctgagtatctgagattacaggcacccaccaccacacccagctaattttttgtatttttagtagagacagggtttcactgtgttaggcagattggtcttgatctcctgacctcgtgatccgctcacctcagcctcccaaagtgctgggatcacagacgtgagccactgcgcccagccaccaatatgttaatgttctagcacctagaacattgcctgttccatttttggctctcagatgccctttgagtgaatatgtgggcatgtattgggttccagctgtgtaccaagtgcctaccaggtggtaggagtaggatgacacattaggccgggcacagcggctcacacctgttatcccagcactttgggaggccaaggcaggaggatctcttgagcccaggagttcaagaccagcctgggcaacatggtcaaaccccatctctacaaaaaatgcacgccaccatgcccagctaagttttgtacctgtagtcccagatactcgggaggctgaggtgggaggatcacctgagcccaagaagctgaggctacagtgaactgtgattgtgccagtgtactgcggactgggcaacagagcaagaccctgtctaaaaaaaagaaaaagtaaagacaaataaaaacacaggcacacaaacatgggctcttccacacttgtgtactttactcagaggatggggtagagggcggtcccacaggagaagcatgtgaataaagccaccgtctcggcgtgggagagcctgtgattgttacagaagtgattcagagggccggccctggctccttccgtttggggcttccttgggaaagtcaatcagacatggaggtcttctttgagaagctttctagtcattgtcattgccaaaataaatgtggcttcacaggccacggcaaggacaggccttgtcccagacaatagctcctttctaggagtttgcgttttaagtccgagtgtcttggcatataatagggtcctgaataaaaatgtctttgtatttgaaaggtaattcatggaaatttttcttctaaggttacccttcattcttgggaaaatcagataacccagaattggtctctggttgaagaataaggatgtatattatttggaccttagtaatcagcctgctggataaatgtggaatcgtaatctagctctaactacttcattttatcagtgagcacactgaggcccagggaagttggaggcttccagaggtcagtctcattagtaggggtcacatcaagggaaagggggtctgtccccttggatgcatttggcttctctgagtgccctgagtcagttctgttcacccccgggctctgtccatggtgcttcatctcattcaaggtgatacaagtgatcctgagaccactgacctaaacacacctgagcttcagcctgagaccaccgatctaaacacacccgagcctcagcttctccctgggaacacaggcagtgttgaaggaggaggcaggtgacaactgtttgcatggcagggctgaatagtgcagttaagcgaactgaggactcatggctttccttttgctgggctttttttttttgtttttttgttttttttaaaaaaagagaccaagtcttgctctgtcacccagactggagtacagtggtgtgatcatggctcactgcagcctcaaactcgtgggttcatgcagtcctccctcctcagcctctctagtagctaggactacaggcatgtaccaccacactcagctaatttttctgtttttcttttttgtagcaatgaggccttgctacattgcccaggctgttctcaaactcctgatctcaagcgatccctctgcttcaacctcccaaaatgctgggattacaggcatgagccactgctcctggcttggttttatcttttcacagctgtgatattccccccccagtgtgcttgcctgattttatatacaaataccctaggatctgcagagtggacccctctgaacctggtatctgatgaaaagtgagcaaagaattttgtgttctcctaagttgtggtggctttgactatgaagctctagctgtattgataatagtattggtttttccatccctgtgatgctccggtgagaccgcagggaagcttgtcacaagagaactaaaatttctgagtctcaggggaggaaggttaagacccactccccacctcgaaattcttcttttttgacagaggctgaaatatgaaattgcagaggtgatgacagagatcgacaatctaacttccgtagaggagaggtaacaatttgtggctacacctttaagctatttactcttttctttctacctccatcctgtagtcaaacttgcagaaagtggggtgagagtggttgggatgtggggagcctgtggagttgttaattcctctcctctccccctactctgcgtggaggggtccaggggtgtttccctggatgttacctcccattgcctcctctgtaagtcatcatctgcctttataggttcaggcataagcacaggcacttcagggttgacccgcacagaaattacctgcctgcgtcataaggaactgtgctttattaaaatcactggtttgcatcattagctttttctgaagtgtctcaagttatcaaatgtgaacagcaatggtggctgcaccacccctgccgccactgcggagactgggggcccctccgtgagggcctgtgcttcgcttccttgagcccgttgttgcgggggaaagtacactggagggccgtgactgggctgcattgtgaaaacagcatgagtgatttttaaattatttcacaccaatagcaaaacgactcagaggaacaaacagatagccatgggaagaaagaaattcaacatggatcccaaaaaggtaagagaatgctctcccttttctggcctgcaggagatggactaattgatttgaactgccgtttcccttttggacagaggtcagaggtggtccgccctgtcacctcataaaagactgggagttgaaggcacatttttatcaaaaaggggcttttcgcgagtggggtgaagcagaagtgccttgtagggctggtgccctgggcagaaaggcctttctttcagagtgagctgctgggtgaggaagcagcctcacaggcacggcttggacgactcagcacaggccgggcttggctccaggcagtgcccttgctgtcgaggctcatattcgcatcttcccgcttgacctgggtcagggaatcacgtgactaggaaggagcaggggtgggagtggaaccctggtgtccagaggttacggactttataatctgggtgggttaagtggttcacataagaggactttattcctccattcaccttaaaaagcaggtgtctgtgaaaaaacaagggatcctccacatttaagccagcatctttctctttcctcaagttggattttctagggagacactcgaaaaccgtgaaacctgaaacatgtagctgcttgtttttgagaccgagctaagggatttggcagaatctgtgaagctttttgggggacattttggttttgagaaagaagggtagacctgagtcttcagggttgaggagaggaacggcgtgtccacgggaaggtctcgctgcagagctggttcacgccactcctgtggtcttcagtcggtctgcacttttttttttttttttttttttgagatagagtcttgctctgtcacccaggctggagtgcagtggcacgatcttggctcactgcaagctccgcctcccgggttcacgccattctcctgcctcagcctcccgggtagctgagactacaggcgcccgccaccacgcccggctaattttttgtatttttagtagagatggggtttcactgtgttagccaggatggtcttgatctcctgacctcatgatccgcccgcctcggcctcccaaagtgctgggattatgtgcgtgagccaccgtgcctggcccagtcggtctgtacttctaacgttccccttgcttttctggcattgagcctctgtgctaatgagttaattatttgttccttcgataaatatctgattgcagaattccattgtacaaggtctaagatctgtaaactcacataagtgcaggtgcagttgcaggtgatatttacagaagtgcatgtcgttatttcctgctcacggtttgcaggtctgggactgcaggtatgcgccactgcacccagataatttttttttttttttttgagacagagtctaactctgttgcccaggctggagtgcagtggtgcgatctcggcccaccgcaagctccacctcccgggttcacaccattctcctgcctcagcctcccgagtagctgggactacaggtgcctgccaccatgcccggctaattttttgtatttttttttagtagagacggggtttcactgtgttagctaggatggtctcgatctcctgaccttgtgatctgcccaccttggcctcccaaagtgctgggattacaggcgtgagcccagtgcacccggcccagtttcaccacgttggccaggctggtctcgaactcctgacctcaggtgatctgcccacctcagcctcccaaaagtgctgggattacaggcatgagccactgcgccaggccatgtctggattttcttaaggcccagcacatctgcacccagaggagggtttttgtttaatgcatacactctagccactgtgaaaactttcctgttgctttctggttctctgcttatggggcataaatcatctccaagatggaatgaaaattgtcaattttgtgaatttggaaatgatttgatattttgggtaacagcttttctttaaggagttggaactgtggagttagatttatcagcagatgtaataagcattggaagcatctcaggttctttatgaaagtggatgtgctcagaactgggtcttatgttttaaggggacccaagtagtgcagcacagggcagcacaccagtaagttcatggataaattctaatctcatgaaatacatacaaataaatacttattttttaaagggatgctactgagtcctggtgcggtggcttacgcgtataatcccagcactttaggaggcccagttgggcagatcacctgaggtcaggagtttgagaccagcctggccaacatggtgaaactccatctctactaaaaatacaaaattagctgggcgtggtggtgggtgcctgtagtcccagctactcgggaggctgaggcgcgagaatcgcttgaacctgggagtcaggttgcagtgagctgagattgcatcactgcactccagtctgggcgacaagagtaagaggctgtctctcaaaataagtaaataaataaagtgatgccactactgtgcatcaggtttcagcttcatgagcgtaaacttttcttcatgcctatgaagccctctctgtcaggctcttgactgtcttcctgttttatatataccgtgtgtcagatttataataagggccaacaaaactacaagttttgtagacttgaatatagcacttgtcagtccacttgagccttcctaacacaataccacagagggggccaggcgcggtggctcacgcctgtaatcccagcactttgggaggctgaggcgggtggatcatgaggtcaggagattgagaccatcctggctaacacagtgaaaccccgtttctactgaaaatacaaaaaattagccgggtgtggtgacgggcgcctgtagtcccagctactcgggaggctgaggcaggagaatggcgtgaacccgggaggtggagcttgcagtaagccgagattccgcccctgcactccagcctgggcgacagagcgagactctatctcaaaaaaaaaaaaaaaaaaaaaaaaaaaaagccacagagggggtgcgtaaacaatggaaatgtattttcttacagttctggaggctggaagtccgagatgagggtgccagcatgattggtgtctggtgagggctctcttcctggcttgctagtagccgccttcttgctgtatcctcacatgctggggagtaaggagaacttactcactctagggtgatgttcttataagggcacaaatcccatgaggccaggacctcatgtaacactgattacctccaaaagaccccgtctccagatagcatcacagtgggggtttgggcttcaacatatgaattgtgggggggacacggacatttcgttcacagctgcaaaggatgatctcacatgcttcagacacaactcaaaattatatctacctccccatgcccctattaaacctgtaacactatgaagcatgaagacattgtcagagcaaataaattccttccagctaggatggtgttttctaagtctcagagtgatgacactttaaacagggagctttggtttgttgaggtgcattatttctagaagtagtacttgagttcattaatgagtaagagggaaggtttgattagatcaaggaagctgaaaacactctgcagcctctcctttattcctgatttcctagaaatgccttaaataaaatatataaatctatatgacaagcaggggtccactcagtggactagaaattgaggaatccctggaagaagataaatgggatcagctggagaaggaaacactccccacagcacatacaagaaagaactgccgggggcggcaagagcagcttcagagttccccgagtgcagaggaggtacattcagggaacaggactgtgggagggacgtcgagactggtcacgctctcctgaccttgtgtctagcagtgattgtgtctccaggtgggaaaagcaagagggagcacttagtccgtgaaaacaggcagcgtcctcggtgggtggcagcaccaacaaggagaaatacccactcccagagaccagccgttggctgcctgacctgctcctcttccagatcactggaggcagctgcagcaaaaaccagaagcaagtagcattctgttaggccaacagtgaccctaaaatacaaagacaaacacccaccaagcaccaccaagcgtttgaggaaaccagcaccatgaaagagacatgaaacccaacaaacagaagaactaaggctggaggaaacagacttaatggaaacaatagaggcggggagggcggctcatgcctataatcctgacgtcttagaaggtctaggtgggaggatcacttgagctcaggagttcaaaaccagcctaacatagtgagaccctcatctctataaacagtttttttaaaaaaataagccaggcatggtggtatgcacctgtagtcccagctacttgagaggctaaggtgggaggatcacttgagcccaggagtttgaggctacaatgaaatgtgattgcaccactgcattctagcctgggtgacagtaagactttgtctcttaaatcctttatcaagccagatgtggtggcatgtgcctgtagtccaactactgggaggctaaggcagaaggattgcttcagcccaggagtttgaggctgcggtgagctgtgattacaccactgcactctagcctgggcaacagaatgagaccctgtctcttaaaaaagaagcaggaggctgggtgcggtggctcacgcctgtaatccgagcactttgggaggccggggtgggtggattgcctgaggttagaagttcaagagcagcttggctaacatggtgaaaccccatctctactaaaaatagaaaaaaattagctgggtatggtagcaggcacctgtaatctcagctactcgggaggctgaggcaggagaatcacttgaacccaggaggtggaggttgcagtgagcctagattgcactaatgcactccagcctgggcgataagagcaaaactctgtctcaaaaaaaacaaaacaaaataaaaacagaagaagcaaaaaaacaataggaggaaactttttatagtaggatatttgtgtatattataaatatcatcaaagagatacgataggatgtttcttatccatgatataaaaatgggggattgtgaaaaagaaccttggaaatgaaaactaggagtgtgtgtcacatcatcacttgagcatatggagaagacgtggctgaagagtggacgtgtgctagaacagagtttaagaattctttattcagttttgcagagacctacaagaaaacatgcacggtgggtccagcagcccaaatttcatgtaatagaagtcacagaaggagagaatggaaagtggaggagaggaaatatttcaaagaaatcttggaatattttagaactaagaaaaatccttagattcaaaggccccaccaaatgccaagcaggataaaaattgaaaagacttatacacatagacgtgtcaagtaaaatgttgtaaaactcatggatagaggaattcattaaatttcccaggaaggaaagatcagattacctaagaagaaatgaggagcacagcaagcttgtcagggatgctggatcaaagacaggaggggagcagtgcctgccaaggcctgaggaaacatgatttaaaaccccaaattctgtctgtcctgtcactcacaagagaaggtgaggaaacacatgttcagacacacaagggcttctctgatgtctaggaattgtgtaattggagcgtgacacctcaaaacaagaaatgactacataggataaaaaaggaaaggcatgcaaagaaacaagcaaaactttgaatgtcaaagtgagaaatttattgtttaaaagattttttttaagtccaaatttatgtcagtatttaagtagcaagggggaaaggaaggaaggaaggaacagctaaggttttctagatgttgatagataaaaataagtttaaatacttgtcaaaattttaagagtaatcactgaagagaaataggatttttaaattattaacaaacattgaataaagaaagtttgatccattcaacacaaggctggaaaggcctgtgaaatagaaagtaccaaataaggggtcaggagtaagtgctaactaatcagtgctcaccgtagatttgattgggctaaagtaatgacaagacagacacttgggtattaataaaataatataaaataaaatccagctttggattgagacccacacctagaagagaaacagaaaaagatagagtaggtgtagtgggtcaaatggtgccaccgcccccatttctgctgtttgacttttaaatggtattttaaaatagtaaacatttctaataatgttagaacactcactttcttttatgagtatttacctagtgtattagtattctagggctgccatgacaaatgaccagcaacggggtggtttaaaacaagagaaatctattctcgctcagttcaggaggccagaagtccgagatcggggtgtgggcaggattgctgcttagactgagggagaatcccttccagcctcgctcctggcggctgccaccctcctggtctccacagccgtgggcacctcactgtggtctctgcctccattgtcttgtggccttctctgcaccttctcctctctgtctcataggacaagtgtgattgaacgcagagcttctgtgtcctcctcctctgcttgtctctttgtcacctgccagatagcattctccaagaaatgtcagtgttttgtgtgttctgaattttagggcaggccttgagcatccagaggaaggcatgggagcctcatgcccaggcccattcagttccctgggcttcagctgacagtggcaggggccttcaccatgcagggtcaggcccccagccctgtagccccagagatgacaggacaactagtgatccctcagggtgtcctgtctctcctcccacctgcagctgatggcctcacctggcttctccaccggcctcacttgttttcctcacttagagccaatagcaaagccccagcactgtctttcctgccctaggctctgttttcagggaacttgggctgcattaggcctctcgaaggaccagacctgcattgctactgtgtgtgtgtgtgtgtgtgtgtggtttgtgtgtgtgtggttgtgtgtgggtgtgtgtggtgtgtgtggtgtgtgtgggtgtgtgtggtgtgtctgtggtgtggtgtatgtggtgtgcgtgtgtggtgtgtgtgtggtgtgtgtggtgggtgtgtgtggtaggtggtgtgtgtggggtgtgtgtggtgggggtgtggggtgtgtgtggtgggtgtgtgtgtgtggtgtgtggggtgtgtgtggggtgtgtgtgtgggggggtgtgtgtggtgtgtgtgtggggtgtgtgtggggtgtggggtgtgtgaggtgtatgtggggggtgtgtgtgtgtggtgtgtggtgtgtgtgtgtgtgtctgtcttgtaatttagatggtgcccctgtgggtaccatcaccagatacatatgagaattgatttaggattgttagactcactgatttttctggagaataacattaaaacatggtgcacaaattctaaatgtacagcttgaagaatctttataaattaatacactcacataactgcaacccagaacaagccgcagttgtagaatattacagggcacctttctgatgcctcatcctagggaattcactccccagggtaaccagtccttaatcaccataagttttgcctttttaaaaccttctgtgaatggaactgaaatactcttccgtgtcgtcttttgctccatatcatgtctgtgagattcattcttgtgagtgttcattccatttcatggctgtagagtcttccatcatgtgattatgccagaatgtactgatcggttctcttactgactgttttcagtttttggaaataaggctgctgtggacgttcgtgtgtttaaaaaaaataggaaatttctggatggaccgtgagggtatgaggcagccctggtcttgggtactgagagtcttagctggataaagcctctctgaatttgtagaaatggcctcctggcaaattgatttctgaattccctattcccttgccacccttgccaacacatattttgaaactggctgcaaggctgtgttagaggtaaacatttctattaataggttcctgggacttctcatgagacagtgctcagctgattcaggccaggggcagcccattgcctttgagattgtcagctgtgccgcagccctcagagtgggcatgagctttgactggatgagcttggtggcacagcatgtcagtatgtttttggcatcaggtaatagaaaatccaacaaaatgtatcttacacagggcgaggtttatcttctcacacagctgtgtagcagtaggtggctcccaagtggcaagaaggcggtccctgtacacatctcagggtttcccatgtgagatggccactgtggctctggtcatcacataagtgttcaaggcagaaaggaggaggaagagcagtgctggctcatgggctcctttttaccaggaaatcaaaaactttccctccaggcttgcctttctgtctggccagatctgggtcacaaggtcatttctagtgccaaaggcagccaggaaactccctctctagtgaagggggtggcagggagcggggaccagcaccacccgcttgctgcgtccctgggagtggggccaggttggccaaccggcagtggccaccacccacaaagttttcctcgcagacacagaataaactatctttctaagcttgggaaatctaatattactgttactcctgcctttataatttctaataaccacctgtaatggtttgttcaataacccatttgtctgtcttttaacttgttaaactgaacaggaggaatgaacgtgcgtttctttggtggataaaatgtagtatggatttgggaaaatcagattgtgcagttgtatgggtgtctctggtattatttttgctgtgtccataccagtaaaatcctgacactaagtgtatttctgtctttgaaaaatgagtttgagtgacactcctaaccagtgcttccattttaatgttcttcagggaattcagtttctaatagaaaatgacctgctacagagttccccagaagacgtcgcccagttcctttataaaggagaaggcctaaataagaccgtcattggggactacctgggtgaaaggtgagttagaggaggatgcaaagccctacctggggccactcagccctgcagcttgacctaggctcacgctccactttcggggccatcacagcctaaaggcatgatagagccacgggctgtgggcatccacatgcccgtctcaataccaagcgagcccagtgcaaccggttcctctcccgtgtccatgggaggagagaggcattaccgtattatgggatcctgggactcctctggaatcctgtttttcagggagccacaacagaactgacaatgctgctgcccctttctccttgtcttggaaagcatcttaatcgtcttctgttttgcccagaaataagcctgatttctcagtggttttctttctcctgttacttgcagtatgaataaaggtggaaagtgaatttttttaatggaaagcagcaggtcagatttactttctgactgcgactggcttagcagaggttagggcaggactgctgaggcagcacatgccctgagtatggcaaacagacttttgtcaaagaccagaagaaagtgtttttaaacaaaagcccagtagttcctaaagttgggcggttttggtttttagcttttttaaaaaaaatatttgatcgaaagtggaaagtggaatacttcccgactcattctctgaggccagcactacctgatacccaaaccaaagacaccgctagaaaatggcagaccctatccttatgactgtaatatatagtaagcaataggtaaaaaggattgtgcaccaagggggacttaccccatgcatgcaaggttagttcaacatacaagtcaattaaagtaatgtatctttcacataaaggacaaaacccacatgatcttctcaacaaatacaggaaaagcatttgacagaactcaaaactccttcacgataaaaacacttaaaaagctaagacaggcatggaacttcttcaacatgatggagggtacctataaaaaaccccactttaacatcatacttaatgatgaaagactgctctcctgctaagatcaggaacgagacaaggaggtctgctcttagtactgctgttcagcccggtgctggcacgccttgccaggacagttagacaagaacataaagacatccaaattggaaaggaagaaattaaattctatttgcagatgatgcaatcatatatatagaatatcctaaggaatcattaaaaactattagaagtaatacattcagtaaggttgcatgatatacaattaatatacaaaactcaattggccaggcgtggtgcctcatgcctgtaatcccagcgctttgggaggccgaggtgggcagatcacaaggtcaggagatcgagaccatcctggctaacatggtgaaacctcacctctactaaaaacacaaaaaattggctgggtgtggtggtgggcgcctgtattctcagctatgcaagaggctgaggcaggagaatgacgtgaacctgggaggtggagcttgcagtgagccaagatggtgccactgcactccagcctgggctacagagtgagactctggctcaaaaaaaaaaaaaaaaaaaaaaaaatcaattgtatttctatacaatagcaatgagtaaactgaaacagatattaagtaaacagctccatttataatagcattaaaaggaataagatacttaggataaatttaacaaaaaagcaacatttttactccaaaaaccacaaaacattgttgaaaaaaatgaaaagacctaaataaatggaaaagcatcccatgttcgtggattggagggcttactattgctaagatgccaatattccaacactgatctacagatttattgtacttcttattgaaatcccagctgacttctttgcagaagttgcacatcctaaaattactatggaaaattcaagggacccaaaataaccacagcagtctaaaaaagaacaaagttgcagaactcacatttcctgattacaaaataaagtggccaggcacggtgactcactctgtaatcccagcattttgggaggctgagacgggcagatcacctgaggtcaggagtttaagaccagcctggccaacatggtgaaaccccatgtctacaaaaatagaaaaattagccagacatgatggcaggtgtctataatcccagccactcgggaggctgaggcaggagaatcgcttgaacccaggaggcagaggctgcagtttgtcaaaatcatgttattggactccagcctgggtaacagagtgagactctctcaaaaaaaaaaaaaaaaaaaaaagactaaagtgtatagtcaagacattgtaagactggcataaggatacacatacataaatgatggaacagcattcagaatccagaaataaaccctcacattaatgtcaaataatttttcaaccaggtaccaagacaatttcagtggggggaagaatagccttttcaacaaatggtgctgggtaaaagtaggtagactctacttcatcagaatattgtgcttcagaagacatcaagaaattgaaggctggccgggcatggtggtgttcatagctaatcatcagttacagattccttggttccttccccactcccactgcttcacttgactagcctgaaaaaaaggtaaaaagacaacccacaggccatcctgggtaacatagtgagccctgcctctacaaaaaatagaaataaatcagtattacttgcaaatatcttcatatatttctccttatataatctagatgtaagtccttagcagattataaggaccagttatcatactgattcagtccttgtaatctcctaaggacttctatctagattatataaagaactcttccaaataagagtaaaaataacaaaaattactcagttataaactggcaaaggatctgaatagacgttacacaagtggccaataagcacaggaaaaaatgctcaattgatcatcaaggagatgcagattgaaaccacaaggagaggctgggcgtggcggctcaggcctgtaatcccagcactttgggaggccgaggtgggtggatcacgaggttaggagatctagaccatcctggctaacacggtgaaaccccgtctctactaaaaatacaaaaaattagccaggcgtgctggcgggtgcctgtagtcccagctactcgggaggctgagacaggagtatcgcttgaacccaggaggtggaggttgcagtgggccaagaatgtgccactgcactccagcctgggcagcagagcgagactctgtctggaaaaaaaaaaaaaaaaaaaaaaaaccccacaaggagataccatttcacacccattaggctggccgtaataaaaaagacacataacaaatgccagcaaggctgcagggaagtcaaacccttattcattgctgataagatataaaatgatgcaggcaggtgccgtggctcacacctgtaatcccagcactttgggaggctgaggtgggcggatcacctgaggtcgggagttcgagaccagcctgaccaacatggagaaaccccatctctactaaaaatacaaaagttagccgggcatggtggcgcatgcctgtaatcccagctacttaggaggctgaggcaggagagtcgcttcgaacccaggaggcagagatttcggtgagttgagatcacgccattgtattccagtctgggccacaagagtgaaattctggctcaaaaaaaaaaaggatataaaatgatactttggaaatctctctggcagttactcaaaatgtaaaacataaactttaacatggaacccagtaattccactcttaggtatttactcaatagaaataaaaatgtggccaggtgtgggggctcatgcctgtaatcccagcactttgggaggcccagggaggtgtgggaggaccacttgagcccaggagttgcagaccagcctgggtaacatggccagccctgcctctacaaaaaatacaaatgttttaaaaaagcatggccatgcagaaacttgtgcatgaacgttcatagccacattattcatcagccgcatcttttaaaatgattgcgataatgtacattaggtttgaaacttacttctttttttcccagggatgaatttaatattaaagttcttcaagcctttgttgaactccatgagtttgctgatctcaaccttgtacaagccttaaggtaagtatgatcatttgctgggtgtagagtggatggggaaggccagaggaccactgcctgggcagcagtggcggtgaattgactccaggtaacttggtgccacacgagtctcacagatgctggctccttttccggatgatccagctaatgctgtgtgacactgagcagccctagacaggaattggggcacacgcttaagataagggccgtgctttcctcactgtggccgctgatgctccttccattccgtttccttttatttgtaatggtgtatggcagtagtcgagtgccttgttcccaagctctgtatggcgtggcgttggtgctccatggggttacttccttccacacttgacccaaagcaccaaacgcatggatacctgagtgtgccagagaggatgtaggtgtctcgccattttggtgtctgggacacactccctggatgcccccttgagctgcccttcctgcacgttgtcttcctcctgctctgcaagcaggaagttgtctcgcttccttccttggtgccctggctgagtcgcgtgggctcttcatctgttctgggccttgaccctgagccagcactcagcagcatccgggggagaggaggcagggcttctggtgggagtcgcctcagccggcccttggactaagaaaatcaggccgcacctcgtcatcttctcaaatcttcggcttcataccttgttctcgtttacgtggactgtttgctcatggccttacctcaactgcagactgcaatgttggcagcgtttttgtgggaccctcgtgatgttgtgctcacagcgcagcctggggctgaacagtgcgctgagagttcgcaacatataagaatcctgcagccgcagttcaggcttatcagattgcgtttctggaagctgtacatccagagaagggtgcaggcctggtgagtctgggaggggtgtctggtgcggcccttgcagctgtgactccatttctttcagtccatcagtctctggcgagagccggagaggttcctattaattcccacagccgtgggagcctggcatagccccgtagagggcctgatggaggcacaggatgggcgggaatacaggcaggtcctgtggcctgaggagctgccctgaggatgttagcttttgtcctgagggacacggcaagcctgtgtggggcagaggcatgcgggctgactcgagacgcatcactgctgtggggtgggcaggtgcatgctttgctggtgaatgtggggcagagagggagtgaggggtggaggaggggtggttgtgttgagtctgaaggctgctggtgcaggcctggcggagaagaaggggcctggtagagagtggggccagacgtggctggaatcctgggaagagagagcagaggaaggaccctggggagctgccctgtgtgagggacgtgcagaggaagaggagccccgcggggccaggctgcatcctcccccgatggctggtgggatcagtattttaaaaagcccagagacttaattggagcctcaaggtctaactcggtcttgatccttgtgctaaatccacggcagcatcagacgttgctgaatagctggtgcgggaggctgcagctggccatggggactgcagcccctgcctccggggctcactcctgggcgggcagacggtggctaaggcagacaggtagcaggggtggtgccacgcagccaaggaacgcaaggaagggaagcagtgagcgggggcggggcgggttgttgggctgggggttccaattacaggcagggcagccagggagacctcagccagaggggatgcctgagggtgggagtgtctgctgggcctggtctctgaggcaggcatgtgtctgcccagcaaggcagcagcagcttctgaccgcagcgcccagtgctgtaggtggggctttggataccgtcctgtgggctatggctctgccttatgtgtgggagttctgaaaggaggaccggctggtggcagctcgggacaggcagggctctggtgatcacctggcagcagcaggagatggtggcaatggggacagagaagtgccaggatcctggatatttactttttaggcagagacaaccggcctcgctgctgaattggttgtagttacaaaaagatgagccatcagtaagcgtgtctcgagttatggaacggaaggagactgtcctgggtcttctcctttctgtctctgcgcccccaagcccctgccagagctgtaccccaggctcgggaggaaaacgtccttcctgagctgggcagaagccgcccttggccgtgaggcggtgttggttctgatgcggcttcccatggctttggtgtctccacaggcagttcttatggagcttcaggctgcccggggaggcgcagaagattgatcgcatgatggaggctttcgcttctcgctactgcctgtgcaaccccggggtcttccagtccacaggtcagtgcagagcccacagcctggccccttgccaggcacagcctccagctctggagggggcggcccctgtgggcacagcccagcgtgtgttcctggggacctgccttccctgagcgaggacgacctgtgggccgggcacctcttgcaggcgggcccccagcacgcggggtcccactgtccactggaggttctggctgagcccagcaccccggactcgttgcagacacgtgctacgtgctgtcattcgccatcatcatgctcaacaccagcctccacaaccacaacgtgcgtgacaagcccacggcagaacggttcatcgccatgaaccgcggcatcaacgagggcggggacctccctgaggagctgctgagggtgagctccccggcccgcggccgctgccgtctgcaggatctcttcgctgtgagcggccgcagcgcccgcggctctagacacgcctcccaagcctccttgccgccctggtcccgctgagctttctgcccggccagccattttcctccgagtctctgaactggctgctgttttccctccttgcagaatttgtatgagagcattaagaacgagccatttaagatcccggaggacgacgggaacgacctgacccacaccttcttcaaccccgaccgcgagggctggctcctgaagctgggtgagccgccggcccagcgggacccgggcgtgacccctctgcccatggcagcagcccctcgggttcctcccaggctcatcgtaggaatgccccccaccgcaggcagagacgttaaaaagaaacgcggttaagccagagcccgctctcggtagctgcatggccacggctgcttctccgagccggggcctcagagccatgcccgcggcagagagtagcgcccaggctgcacggcccgtcccagaaaactgctgagttagcatccagatccagccagggcagcttcctgcacgagaagcaagcgcattatctccacagagcctgtgtgcctctctcggtttggtgtggctgtgatttttgacgcgtggtttaaatgtgccttcttgttgttttccttctgcctgtggctcccacctttctgttctgtgacgggctgtccctgcttgtcctgctttaggaggtaggtacccagtggctccccgccccctcagcggctcattcctctcgctctccccacgttggtctgtgtgagctccgctgtgtggctgccattcatccgatccatctgtggacttgctggggctgcgccgtgcacggtgtggtgaatgctacacccacccccaggggcggggctgagagtggctgggacctggagcacatggggatgctgtgtgggaaccaacttgccccccaccctgtgtctctaggggtccgcagcagtagagaagcagacagccagccctgtccctgcggcgtcaccctccaccccatactaacccagcagcgcatggagagatttcgggagtgctctaaaggcctttggagcaatttagggcaattacgggcagttttagaaatgctgaggggttgttttgcctgcggggcggggatggttgccttatgcccacagtgaagcgggcgagatgcggtagctgggttcacgcaagcctttctgagagcaggcggccgctgggcagcacgtgagacatggagtggagcatcctggtgattttttaaaaattttatcagccgggtgcagtggctcatgtgtgtaatcctagtgctttgggaggctgaggtgggaggattgcttaggccaggagcttcagaccacctgggcaatatagtgaaaccccatctttacaaaaaattagcctggcgtgatggtgtgtgcctgtagtcccagctactagggaggctgaggcaggaggatggcctgagcccaggaggttgaggctccaatgaaccatgactgtgccactgctctcccacctcggcgacagagtgagacctcgtctcaaaaaaataaacatcaaggaagggtgagacacggtgtgacgggcacaggcctcctcagctggtggaaagggtgtgagtcccacaggtctgccattcccattagggtctttgaccttggccattgctctttgacttttttctggctgtaccgaggtttaggggagttgtagatatttgcctgaaaacctagtaccatggtctttggctcgggtgcctgagagacccgattcaaatcacattgtgcgagtgttctagagtgagggccggtgggggggaatgtaaccggaaatgccggcaggcactctggggccgggataagtgggatgttcgtttgattagatgcctcccttctggttcctgcgttgcccaccagtgtcccctcgagggacagtgacgccatcagcctgcctggcagccaatgtgacccctgccaccagggaaaggtcggctctagagacgtaagtgtgtgaatgaaatgaaggcacagcagagctcgtgttgtctaacctgttttctggttgggcagataaacaggccatgaaatgagtgcacacagtgctcacgggaaccaagagctggctgggcgccgggtgccaagcgcaggggccctggaggggctggtccagctggcgtggcctcagtgtggtgggcggcccggtgagcacctgctgctctaggggctggcttccttgtcctctcccagcaccctgtatgtctgctgtgttctcagaaacaaagttcgagaccaaaggctggcgagccagggccctggctggaggcagacgagatgggtgcaggatctagaacgtgcttccaggcgtgtgctcagcggggagtgcggcctggcttggttgcattcttattgtagatttgcttttagaacaggtggtcttaaaaaggcctggatgctttgccagagcgtaggagccctgctgtgtacacaggcgtggcttacgattgttggtaacttaagacttcgagtcttgaatcaatcaccagaaaaaaaaaaaaaaaaaaaatcctaggaggtggcccaatccgagctgccatacagaaagtgtgtgcatgtggacctgtgtgtgcacgtacgcgcctgcctgctaacggcaatgaagacagaaacttacagagagaaagtggctcccatctgcaggttccagaagccaggctcttgtctgcaggcgagaatgctgtgtggtgtggccagaaacaagtgtgagcagagcctgctcggctctgagaccaagcttatcaccccttccctgggcctgcagtcctggtctgcaacgaccccctggccctgaggactggacagggatggggctctgcatgggaggtgtgagcgggggacccaaggtggagctgagaggccacctggcagacccctcccaggcggggccaggtgtgtgggctagtggaacatacaggtcctttgctgtccaccatgctgggagcgtggaggaagagagcaggcgctggacagaaacacacaacctgggggctcctggatgagctccccaagaactggagactcagataacagggcagggagaaaggccacagctggggagccaggaagggcagcccctgctgccgcccaaggagttgggtttaaagctgagtgcagtgggaccctttggggggcttcaagccggaggggcatgattgccacgtttttgaaaagatgcctttggccgctgtttgggggatggcagctggcaccagtgcagctggagcggggcctgctctggagtctctggagggaagcagaggcgaccgtgacagtgacggatgtcagggtagtggagttgctgtcagctgattctgccacagcagttcaagctggagcaagtgcctggaaggaatcagcactgtcctcctgtccctagggtctcggggacatagaacacctctcactgctcactggaggactgtgggacaaggcaggttgcccccagggtctcctgccctcccctgtggacttgggcctccctggtgtgctgcagtggaggtggggaaggtgaaggccaagggcttgcagagagcatggagcccgcggtgagacagggacacgagggcaacaaggactttgggccttgctgtgggcctggctgggtcttaaaggggaccagtgaggcggtgccacagttggggcagagggttccagtgacggagcagcttgcaggggttcggggagtggaagccccgccagggctcaggagagatgttgggggcagggtctgagggctggggagatgcagcagagagcttgggggcagatttgcccagaccagggtctagacagaccctttaacaggtaggctggtgggacactgatgagactggggcctgtggggagaggaggaacagctggaggctgggctcctgttccaggctggcggtggcaaccgcattgcaggctgccttaggcatcaaaggaggacggcagcactgagtgaggcaggggccagagggtcccagagggactgcagagacccgcttccggcctccagttccgctgagccaggcttcctcccacctgcagctggttcctcctcacccagggtctctgcaaaccaggccccaacagggaaagccccctgtgtcctggtgatccatccacagagcccttcgcacacagtcttgcctccaggcctcagcgcccgtgctggcccccacttagggagggagggctactcccctgccggcctgtcacagagaaagccgggtgagctccgcagcgctggagaggcatggggcagagagggcctagtaccccagggagcacttgagttcattgtcaccagcgtgtatttctttgaattatttaaaaaacaaacaccggcaaggctatagcagctgaagtcagtttgtctctgctcagtgtttaaggatcagagatttccttcccttagggagaggagggcaggtacagatgggggtacgtgcgtgtgcacgtgtgctccagatcttgttacaaaattaattcagtctcacgattccttgggcccaggggtgactgattttgatggatcccagggctgcccaagggcctctgtaatgcgataaccacctgacatggtggggtcaggtcctggacagagccaggcgcgcagtcctgacttcatcacactgccatctcatgtgggaaaatgacgccatccatcccactaactctcccaggaagcgaattgtagcgcggttgtgtcatcaaggggcccatcagtgccgtggagggggcgccggtgtgggcggggtgggtgcatgtggggccctgcggtgggaacgctgaaggacacctgaacccaagcctggcgcctggtggcctttctgaaaacgcagtggtctgtgcaggtccagggccccctcttggacccgcgggctccctgtgcacggagcgcagactcacggggcccttctgcttctaggagggcgtgtgaagacctggaagcgccggtggttcatcctgaccgataactgcctctattactttgaatacacaacagtaagtaagggccaggcctccttgccgcctcccagcagtcccggagctgccctggggccgagggaccctcaggctggtgacccacagtgagccccgccgtgtactttcctcttgtaggataaggagcccaggggaatcatcccgttggaaaacctcagcatcagggaggtggaggacccccggaaacccgtaagctcttcctcctgaaccttctctcctgccagccacctgggagccatcctcactgcctgcagggaacctgccccaagcccccctgaccgcctcccctctctctttctccaccagaactgttttgagctctacaatcccagccacaaagggcaggtcatcaaggcctgtaagacggaggccgacggccgcgtggtagaggggaaccatgtggtgtaccggatctcagccccgagcccggaggagaaggaggagtggatgaaatccatcaagtgagtggggcctcgggggcggggccaggcccgtcttctcgtgccggttggagggcgggggatggtctggaacatggatgcttccgtgtgcaagagtggaccttctgtctccagaaaccccagagggccgggctgccaaagccgacgttcagatctgagcctgcggtcctgtctgaggggcctctggggctggtgggaaaggggaggtctgtgtgtcacccacgacctaacctgtgtgttttccttttttcaccagagccagtatcagcagagatcccttctatgacatgttggcaacgaggaaacgaaggattgccaataaaaaatagctttcctggctaaaagacccaggtaaaagacccaaccccagcagaaagacaccgcgggcggcccctccgcggaaggcgtggcagggaggcagtcgccctgcggtgcaagctgctgctccagagcataccgtggcccaggtggtatccccaaggcctcgtgccgtggctggggtcctgggaggtggtcgccctgcagtgcaagctgctgctccagagcgtaccgtggcccagactgatcctcgaggcctcctgccgtggctggggtcatggtcggctgcgcatgtccagaagcatttccttcctgcgaccatcccggcgcccctagggggagaagccaggacagcagcttccgctgtctccacagcagacacgggacggattccacagacgggagcctcattcgtaccatgccaaacgcattcactcggggcagtattaaccgttctagaaagccactgttttatagcaaaacaggaaaggaaaagctaccagttttttattcagaatttttctcagatatataggattatagcttttatatgcctttttatattctgaaattataacaaaagatactttctaacagtagtatttttagaatggcagctataaagttaactcctggacacaagtatatactgtgcactgaaaaaatatccatctacacagcacccaaggggagggctgggggcaccggcacgggggcagcgtgcagccctgccctgtcaggctgtcagacaagccccggggggcagcaggtgggctcgggacgggctgggggagggacggccatggcacttgggggctccagggtgactcccatgaggcctcccttcaaccaggctttttggccccacaaatactttaagcaaatcattaaaattataacagttaatggtttgggggtgtttaggctgtaactgctaactcctaggaaacagccttttccctggacacagatggtccatacgctgagccacgtgaaactgctgatgttttgtttagatgcacacacatggcagcgtttcatacaggtcagcaggttagaccggcttttgaccatattcatcgctatttaaaacctgtggcaaaatgaacgcttattttacagactttctaatttgaccagatttcttaatgaatagacacagaattaactaaaaacagtctcaccccatgtagtgcgccgtgtcctgagagaggtgccctccctacgaggagggaagaacaggccctggggtgcagaggcccggcacgtagagaacccagatagacgccggtggtggaactggtcaaactccacgcccgcctgggaggttgtcaggttgctgtggatgtaaggataggaggtgcccagtgctccgctcaaggaaggctggatctgggccccacctacagagagggctcagggctggaccgggggcattgtgtgcttgggccgacccgggccggtggcagacgctgttctctgtcgggagatttgcgtccccaggaccctgttacacagtgggctgttgggttggtggctggcttttcctctatggacttcctcttcctgccccacctgcataggcacacacaccttgaatctgcaccctctggagggcatctgtactcctgtgcaaaatgcccagtccagagacaaaacctcagactttgtgcacctaggtttccttctcagcagcggagactgttctttgagttgccttgaagtggaggccgagcggctgcgggcccttcgcctccctgcggctgaccttgatgtagctttaagtcacactagactgcagaggggtccgaggccagaaacccctgtcctgcatcagactttcattcccacgttcttaggctttgttactgatacctcaaatcggaagttttagttctgagaaaggcaagtcagcgttcttgaaatgcctgactggtagatatgcaactctggcctccagtcttccatgaaaataaatgctgcctggacccccacccagaccacacactgacggccggctccggcggtgcccacccctcaggctggcccggcacccaagactggccacagccagctctgtcagcatgttgtgctcggacaagctgtttccttcttctgaccaacccaggtgtgacctggggatgcagagctttctgttttgggtgttgggagaagcagcaggaaggagtcgccagatgatcaagctccccctttgctgtcatctgtgaatgagcttcgccaggtggtgggcacctgggagccatgcagaggctgtggtgctgagttagactccaggtactttgtggtcaaaggaaatcgcctagctccaggctgtgttaggacagtattagcatgaaggctgtgcgaccatcatgcctgctgatccttgaggcaggcctggtccagaaaactctgggtcagtgactgcgcagggccagccgctaccaggacggccctgaaacaggacacatctgttttttgtccctcaccctgggcaggccgcgtcacaatcacagtcctcctcctccccaccctgacgtctgagcgcagggcttgaattgttagtcccaactctggccaaagatacttttttccagagacagaggccaggaggcagtgaggg

SEQ ID NO: 14197 - DNA, 35355 bp, Human
cagctaacaataagacaattcttggtgtttttacattaactacaggtaataattaaacttgtgcggtaattacatggggaaaatccctctcattaatttcaatactaaatatggtatctttccctttttttgcattattaagcttactgaaatatacatagcaaaaaataaaatacagaaggccaggcgcagtgactcatgcctataattccagcactttgggaggccgcggtgggaggatcacttgaggtcaggagttcgagaccagcctggccaacatggtgataccccgtctctactaaaaatccaaataacagttcaattccttgaagcagtaaagctttgagctgcactgagaggagactagactgcctaagtcattacagctaattagccgttagctcttgtgtggaaaaaatggcagaggagcatgaagcaagtgctgaagatgcctcagaattgtcaagaaatgttataaataatctctttctctggtaaataagggtaactttttcgaccacattagcttttttttttttttttttttttgagacgaagtctcgctctgtcacccaggttgaagtgcagtggcacaatctcagctctctgcaacctctgcctcccgagtccaagcaattctcctgcctcagcctcctgcctcccaagtagctgggattacaggcacctgccgccatgcctggctaattttcgtgttttagtagagatggggtttcaccatgttggccaggctggtcttgaactcctgacctcaggtgatccacctgcctcagcctcccagggtgctgggattgcaggcatgagccactgcacctggcccacattagcttttgttgatatgatcctgtgaggagtcttgcctcaataaaccaaaggtagaccaaatgttctttttttcttcctttatacccctactcccgctatttctaaggtctctgtccttatagcagttcaagatccttatgaacaaaacattcataccctttgtctcttcccacccttttcagtgttgtatttaatatttctatgtcatggccttaaaatttcagaaaggggagaaagcctttcagggagccctgtttattctgttgtgccactgagttcacttggtcttgaatgaggaaatgtaatcagaagagtgtgaatgcaggctcagccagctctactaaacacctttgaggtatctatatttcatattacacagtagacctgaccgttggaattcgtgtttcttcagtattattttaagaaatcaggtaaacagtgaaggttagatatagcatgaagcaaagaccatttaatttttagtggaagaaatatcagtatttttaagcctagaaataaatagattgcttaatctatgttaaaaacccacaacatacagctgaactgcttccagtcctgatttgccagagtccaaatctaagatatgggcttttacttaatttatatgtagctgagaaatatccatccccagccctaagtcatagaagtcccttgtcctcaccccagtgaatgagaactagactgccagcttaattcttgggaaatccataattcttgtcttattatttttcagtgccacattgttattacaattagtaggtgagttctctctttgacttcaataattctttctacttaacctgttttcttaaaggtattgcaaataaaagtatatcaacagattaatgcattccagctgaacgttttagcctttttagtttcagctatccacaaatcaagccaccgagtccagctggtaggtttgtaaccattttgccaaaaatgtcttgagtttggggacaggaattggaaaatcttaacccaaagtattttaaaatgtattgtatttgagaaatgggaaaagaaacaaccacaggtatattacagctattgtgtcatctgccctcttgtgtctaatacctgtcctttgaacagcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctggtaagtggaggagccaatagcagcaaataagatgacctagaatggggtcttcccaaattaagtattctttgagtccttaattgcaattggaatttaagtttggaacaaaagttggtttttgtttgtttgttgagagcagaaattggggttttttgtttgtttgcttttattgttggttttgttgtgagtccctcccctccgctgtcctctccactgtacaaaaagagaccaggtaacaggtggttccatagtaacagatgccagtcgtgatcccaaagctgtcaggctgttttctttaaaagaaaaaaaaaatcacctagtaaaagctatttaaataaatgtttttaacatgggacacagaggtggtaagtgtaggtgtagaaagcaagtcatgtgcagctatagaaagcagatgtaaaaggaagaactataaaagctttttgacctgtaggcaaatgagacttgttcttaagctcagcacttcaaaggccctcccaagcaaagtgcttcttctgttccgatgagtggcatcatttgtagcttagtcctgttaggacagacttttttaaaaaatctgatccttagccttactatgaaaaacatcagaataacatctcagtaatcagaaaaaatggttttctttcaggcaccgaatttaagatcaagtccagcttcctcctataaggagacatatacactagaagaattaggatttttctcaaatatgttagtcttctgaagatattcacaatctttcaaaccagaaattgctccccttctcctctctccgaaaagaataatagtgtttttcttttgagagaaggagaagtgtttgcattttccctttattttgtttatttaaaaaaaaaaaaaacactcaggtgcatagctgacttttggcctttcagttagaaagggctgaagaaaaaagaggtaaaggcaagacagataagtgattgatgcaagggaaaaacaaaatcaatgttgattttttttaacatggtattttcagtctctgaaatctctcccagatttctatgatacggggccagaatgggaaactctggtttagaagattgtaggggaaaaagcagagtgaaaaataggaaaaataaggaatgagaaagtatgatttatgagtatgtggttgagggaaattttgctaaacagattcttagcttctgtcaccattggaggtcagagaaaaactcaacagtatagcagctgagcaacagaacgcttgtccttctggctataaacagacataaatctggctagagttgggagcattgcaggcacatgcccttctgttactattttggcacctcatcatcctagtttgtttacactgagtttatcatgccaccaggtccaacctgtttccactagcaattagtactttgccaaaacctttggcttcctatgttgagcttatactcaccacactgaaacaactcttactttgagagttttacctggactttcagactagccattctgtcaatagagaaaagtacatatagactcatatgtggcatatagtgaataacactacttttatgtagtcattcaacatgaatgatggggctgggcgcagtggctcgcgcctgtaatcccagctccttgggaggcctaggtgggcagatcaccggaggtcaggagttcgagaccagcctggccaacatgacaaaaccccgtctctactaaaaacacaaaaattagtcgggcatgatgacaggcgcctataatcccagcactctgggaggccaaggtgggcggatcacctgaggtcaggagtttgagaccagcctggccaacatggtgaaaccccatctctactaaaaatacaaaaattagccgggcgtggtggtgggcgcctgtagtcccagctacttggctgaggcaggagaatcacttgaacctgggaggtagaggttgcggtgagccgagatcacaccactgcactccagcctgggcgacagagtgagagtccatctcaaaaaaaaaaatcaaaggatgggagcagattttgaggacagaagtttaaaaaaaaaaaaatcgaaggaatttcatcaataagaaaaaaataacaagaaagaataaaaaggtacaaaagatgtgacatgcaacttataaccaaatgattaaaaaatttattctcatcaatcattagagaagtgccaattaaaacaaccattaaattgtttttttacctatgaaatttgtgaagattcaaacaggcactctctcatatactgttgggtttgcatgtaaatcagacagtctctttgagggtaacttggtagtaaatgttaactttttttttttttttttttgagacgaagtcttgctctgtcaccgaggctggagtgcagtgcaacctctgcctcccgggtttaagcaattctcctgcctcagcctcccgagtagctgggactacaggtgtgtgccaccacgcctggctaattttttgtattagtagggatggggtttcaccatgttagccaggatggtctcaatctcctgacctcgtgatccgcctgcctcagcctcccaaagtgctgggattacaggtgtgagccaccgtgccaggcagtaaatgttaactttttaaatgttcaagctctttgatccagcagttctgctactgtgaatttatcctatagaaatactcatacaagtaaacaaaaagagttaagttgtattgtattcagtgcagtatttaaaatcatgaaatattagaaacaaccctattgttcatcagttgaaaagtagctacataaaccacagggcatgcaaaagatgtgatacaatacagctattaaaaatagtgaggtaggcctctaaatggcctaacagggaaaggtgttggtgctgattaaaaggcaagctgaaaagagctatgtatagtatcccattttttaaaaaaattaaaaagatagtaatgaatattagcaccagaaaagaaaaaaattcttgaacactgttaagtgtctttagggaattggttcaggagactttctatactatatttttctgtacagttaagaactattaaaacaaatgttatctcttaaaatcagggagaaaagccatacatttaaaataattaaaggcattttgatctattaggtaattctttgttcactaggattctgtagagaagataactttgctatttctggcagtgtggagtataattatggatagaaataaaacttttgctttgtaaaatgtggtaggatttatagccaggaatttcaaaaccctatatttaacttccctgacttgagatgttcactaattagatgattagcttgttttacatctgaaattatcatcttcttggttacatttattatttttggtagcatgcttggttctctcttaaaggggtgtaacatttaacagtatacattttctggcagatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgagttacaaacttatagcattattctacccttcctatttgagcttgggctaggggcttgctctttgaaactggttacagctaatggttagatacaaacctactcactgcactccctggaactcagggtttatatttcagtgaaccttttggtatgacctaaaaacagtatttagatgcagatctaacttttgttcccatttcaatactgactgcactatatagctacttgcctttactaccttaaaaaggaaatgggaagggtagccaaacccattttcttctcagaggtaacctaaatattcagatggaagccttcagaggcatcagagagtgtttgccctctgtgccctgtctgtgtttaaaccccaaggttggtactaatgtctgggatttactctttaaatgtcatgatgctaggtttataacaaatcccattctctgtgactagagggggaaaaaaaaagatttgaatctttagatgttgctttgtgtatcaggatcattctggtattacttgagtcagatttgcagttcaagagtgatgctgtcaagatcagttgtctgtataaaacagaagcattatccttaacctatcatattaaaaccatttcccaggtgatcccagcttgaaaagcgggaatggcatccctagccgttgtgtgtatttggaagaaatggcagtagagctagaagatcaagactggcttgatatgagcaatgttgagcaggtaatattcttacgttcctaatgtgtgcccttagcaaaaattagctatgcggctgaattctgctcactgttctccaacttatgcttgtgtccatatgtccatccctctctctttttttttttttttttttaccagtagaaggccaagtaacctggatgtgcatctctaacattgtggtgttcctcttttggaatcttttcatctaccatggccacatgcccaaatctacccatcctctaagaaccagttaaaatgccttcttaattacaaagccttggccaggcacattgactcacgcctgtaatcccagcactttgggaggctgaggcaggtggatcacgaggtcaggagatcaagaccatctggctaacatggtgaaacgccgtctctactaaaaatacaaaaaattagctgggcatggtggtgggcgcctgtagtcccaactacttgggaggctgaggcaggagaatggtttaaacccaggaggcggaggttgcaatgagccgagatcataccactgcactccagcctggacaacagagcaagactccgtctcaaaaaaaaaaaagaaaaaattacaaagccttgccaaataaaagttgttactccctcctctgggtacctagaataatcagcctctgaatctcttgtgggaattgtcactttctgtctcatgttgcggctttcttatgtacctgtcttatctcccctattagacttaagttcttaagggcaaggcccatcgctttttcttctttatatcctttctatcttagtctgttttgtgttgctataaaagaatacctgtgactaggcacagtggctcacatctgtaatcccagcactttgggaggccaagttgggaggatctccaggccaggagttaccagccctggcaacataacaagaccatgtttctacaaaaaatacaaagaattaactgggtgtgatggcatgtacctgaagtcctagctactcaggaggctgaggtgggaggattgcttgagcctgggaggcagaggctgcagtgagccatagtcacacgactgcactccagcctgggcgacagagcaagaaagacccatctaaaaaaaaaaaaaagaacacccaagcagtaatttataaagaaaagtttatttagctcacagttctgcaggctgagaagattcagggtatgtccttggcctctggtgagggcttttgtgctgcctcacaatgtggtggaggaagtcaccaaaggacacataccatgaggacgcatgcaaggaggagaaaacctgagaggtgtcctggcttaataagaacccgctctggagggaatttgtccattcctatgagaattaatccagtcttgtgagagcaagaactcattcagcaccttgagaaaagcaccaagcaattcaggagggatccgcctccatacccagacacctcccactagccccacctccaacagtgccacatggagatcaaatttcaacatgaattttgttggagacaaacatataaaccacagcactttaaaaatcaaaacagtgcgttgtaccttgcaggtgcctgagtaacattaaaagaataaaagtttggtaggaaagacagttgacagcttgcagtttaacttcacatttggagtatctttatataagtctgaatgagatcagcaatcacacagaatagtagatttcacatctaagtttaatcactgatctcagcaccattcaacaaatagtcttttaatgcctactctatgctggggctatactagacacttgaggcttgatttaggataactttatatatgccataattttctaaaattttctaaagtaaaaatatacagggccctttttttctccttcactctacattcaaatctgtgattcttgctaataacctgtgtcagaattaccttttacatcttaatgttctcagattaattttgcaatagtttagtatttttgtttggttttctttataggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagaggtaaaggaataatccccattgaatactgtattgtcctcttgggtatgacttcagcatgtgggccagagttggatcagtctttatttcaatttatatatgtcatagtatgtctagaagtgaatatcagggacactaaagcttttatatcaatttatatatgtcatagtatgtttagaacactggatatcagatgcactaaagctttagtctcctttccgtatcttggggtccacccttctccccagttaaccaatgcctcctattctctctaaaacctctttagaaatcacatccttaaaaaaatctcatgaggctgggcacagtggctcactcctgtaatcccagcactttgggaggccgatgcaggcggatcacatgaggccaggagttcgagaccagcctggccaacatggcaaaacctttactgaaaatacaaaaattagccgggcatggtggcacacatttataatcccagctactcaggaggctgaggcaggagaatcacttgaacctgggaggtggaggttgcagtgagctgagatcacaccactgcactccagcctgggtgacagagcgagactctgtctcaaaaatcagaaaagggctcatgaattcatttccactgagatgtaaatattagagtaggctaagccggatatttccaggtttggaattttaaataggcagatagatgattccttaagccaaggaaggaatctctaattaattttcaagcatccacaggagaccagtatgtctcttctattgtattcactatgtctactttcgttccagattacagagttagactattccctcttttcttcatgctgtttgcagattaccaaagttccagagaacctgctaccctttgcagtgcagtgcagaaacctcactgtgtccaatacccgaacagttcttctcaccccagagatctatgttgaccaaaacatccatgagcaactggtagatttgatgttagaagccatccagggagcccgtgagtacatgaacaagatctgtaagcttctacattttgattttcagatttaaaatttcactaattgcattagaaagtctcagagccattatggttctggtataaattaaggaggagggctcacatcttgatctttgaggttgagtaccaatagaataaagctgggcatggtagcacacccctgtagtcccatctactctggaggctgaggcagaaggatcccttgagcccaggagtttgaggctgtagtgtgctataatcacacctgtgaatagccactacactccaggctgagcaaaaaaacaagacccccagctctaaaaaaaaaaaaaaaagaattattgaaagtaaagagctagtgtgtaaaggcatataaaaattcttgtgccctcctttctctctcatttgtcttctgttagattttgaagatgtaactgagtttctggaagaggtcattgaagccttgatattggatgaggaagttagaacatttccagaagtcatgattccagtgtttgatattttattgggccgaataaaagatctagagctctgtcagatccttttgtatgcatatctggatattcttctctatttcactaggcaaaaagatatggcaaaggtaggtctgaaagatgatatgtattcagttgagctagatgtgtaatacatgatgcttccctatcctgaagacactataatactacctataaaataagaaaaagatagcttggttgttgtatcaacttaactgttttgaggccctcccaccccatcaccttatctcaccatgaagatgaataagcagaacttgtcttctcttacaggtttttgtagaatacattcagcccaaggaccctaccaatgggcaaatgtaccagaagaccttgctgggagtaattctgagtatctcctgcttattaaagactccgggtgttgtagaaaatcatggctactttttgaatccatctcgttccagcccccaggagatcaaagtacaggaggccaacatccatcaggtggaactgtttaccagggtatcccagccccctgatcttaaaagagttttctcagaaagcagatacagataaggctgctcaagcctctctgggaaagcaaattgatctagttggcttttacatcacataaataaattaaaactgggcatggtagctcaagcctgtaatcccggcactttgggaggccaaggtgggaggatcgcttgagcccaggagttcaatttgaaaccagcctaggcaacacagtgagacccccatgtctacaaaaaaatacaaaacttaggtgggcatggtggcaagcatctgtagtcccacctactcgggaggctgaggtgggaggatcacttgagcctgggaggtcaagacttcagtaagccatgattgcatcatcacgctccggcctggatgacagaagaagactctgtctcaaaaaaaaaaaatcccctctttgtagcatatgctaagaacagcacgtgtggggtaagaatgagctgctgctactcattaccctttgctgtagcactgctacagctacttctccccaaccctcatttttctcactgagctataactttagctctgaaaatcttttgactgaactctagcttataaacccagtttttcttccttttcgtgtctccacctatgccctctctttgggcttcttcacataaattatagtagaggtctggccaacatgaggcattgaatgattgaattggggatagtttaagtcccctaatcattaatcattacaactctctaaggcaaggcatggcaaactagcagtggccaaatctggcctgccacctgtttttgtaaataaaggtttattgaacatagccatgcgcattagtatatgtattgtttctggtttgaattcatactacagtgatagagttgaataattgctacagacactgtatggcaagtaatgccagaaatccttattgtctagccctttgcagaaaaaatttacagacctgtgctctaataccgtgtaatgccatctgcagttgggcagctgatcagaaaatctcttataagtgcccagaaatatattttaaaatcaaattaggggatgaggcacagagagtgaggggaaagattaggattagcatatttttggaaactgccagttgctaaggtttgggaataaaaactattaggattgtgaaacgttctgtggttgtgttttctggttgaacagttcatggctcagttccacgaaaagatctaccagatgctgaagaacttactccagctctctccagaaaccaaacactgtatcttgtcctggcttggaaactgtttgcatgcaaatgcaggccgcaccaagatttgggccaatcagatgccagaaatctttttccaaatgtatgcctcagatgctttctttctgaatctgggtgctgctctcctgaagctatgccagccattttgcaaacccagatcctctcggctcctcacctttaatcccacatactgtgccctcaaggagttgaatgatgaagaacgaaaaattaaaaatgtacacatgagaggtaggagagaaccaggcttctcaaaactgtgtgtgtgtgtgtgtgtaacgtgtaaagcattcactcccttatcctttttcacagagttcctttctcaaaaaaagatgaggcagaaacgagctatttcgatttttttttctttttttttgagatggagtcttactctgtcactcaggctgtagtgcagtgacgctatcttggctcaccgcaatctctgcctcccgtgttccagcgattctcctgcctcagcctcccgagtagctgggactacaggcacgcgccaccacgcccagctaattttgtgtatttttaatagagacggagtttcaccatgttggccaggatagtctcgatctcttgacctcatgatccatccgcctcagcctctcaaagtgctgggattacaggcgtgagccaccacgcccagccagaatttttaaaagacagatgtttgagagaaaaaaaaaaacacctggtagcttttaaatgttgtactttagtgagaccttctctctggatttggcagccttgcatattcattcattcatagtttataaaaatgaataaagcagagtcctcatcctttttgaactcaggctccagaaggcagatatattaactgataattataatatggtatagggctaagctatgggagcacagaggagggagtaaataatcaattctgcagaagttggaggtcttcatagctgagtcttgagagacaagttaggttttaccaggcaaagaagcaagagggtccctttatacagagagaaaagcaagtgtaaaggtacaaagctatggaaaatcttgactaaggaatggtgagaggctcaatgtggctagggcaaggggtagatggggttgagttggggaggaaatggatcaagggaggaagataggtggggctggattggagaaaacagtacagagaaatgaagagaaaataaatgactcacagtcctaccattcaaagtgaaatcactcttaattttggtatatttcattccagttttataattctaattgtaaacatgataactgctcaaaagcaaataatcaaattcagaaaagcacaaaataaatacaaatgatctattgcctatcacttgaaacaatctatagtagtattccttttaatttttggtgatttcatgaaaaagatttaactgtatttctgtagacggtgagaaaccaaaagatatattcagacaaagaactaatatgacaagatatgtttttaagaagatatcactgctaacagtatggaaattgaatgagtgtaagaggagactggagaccaagacatttaccctcttttttttttttaacttctttgaggtttggacaaagaaacctgtttgatcccagctgtgcaggagccgaagtttccacagaactacaaccttgtaacagagaaccttgctctgacagagtacaccttgtacttgggatttcacaggtaactcctctgatgtcattaggaaaaaacagtttagttgtgttgataactagaaggtagaaattgagtctttggccaggcacagtagctcacatctttaatctcaggattttgggaggccaaggcagaaggattgcttgaggccagaagtttaagaccaccaacctgggcaagaaagtgagacccccatctctaccaaaaaaaaaaaattagccaggcatggtggcatatgcttgtggtcttagctgcttcagaggctgaggcaggaggattgctctagccgaagagttggaggccacagtgagctatgattgtgcaactgtactccatcctgggtgacagagtgataacctgtttcttaaaaaaaaaagagaggaagagtcttacagatataatctgagcttattctaaaggttcacattagaatctaatagaaaaggggcattgtatgaatttacttgtgtttcatgaatcagctttgtccagattccttaaatttgtttttaacttttatcgttgtcgttgttgttgaaatggattttcgctcttgtcaccttggctggagtacagtggcacattctctgctcactgcaacctccgcctcctgggttcaagcaattcttctgcctcatcctcccaagtagctgggattacaggcatgcaccaccatgcccagctgattttgtatttttttagtagagatggggtttcgctgtgttggccaggctggtctcgaactcctgacctcaggtgatccaccaccttggcctcccaaagtgctgggattacaggcatgagccactgtgcctggcctgttttttaacttttgacctgttaaactttaaaaattaaatcactgtcttcctattgtgatctgggaaagtggaattgttttcattttatattgcactttctgctcttaaattttcattactggccgggtgtggtggctcatgcctgtaatcctttgcactttgggaggccgaggcaggcagatcacttgagcccaggagtttgagaccagcctgggcaacatggcaaaaccccgtctctacaaaatatacaaaaattagctgggcatggtggcgtgtgcctgtagtgtcagctactcacgaggctgaggtgggaggatctcttgagcctgggatgttgagactgcagtgagccgagattgcgccactgcactccagcctgggcaacatagtgaaaccctgtctcaaaaaaaaaaaaaaaaatttcattactactcctggtgataaaagatgaagttcagccgggcgcagtggctcatgcctataatcccagcactttgggaggctgaggcaggcagatcacaaggtcaggagatcaagaccgtcctagctaacatggtgaaaccccgtctctactaaaaatacaaaaaattagcccagcttggtggtacgcgcctgtagtcccagctactcgggaggttgaagaaggagaatcgcttgaacctgggaggcggaggttgcagtgagccgagatggtgtcactgcactccagcctaggcgacagggcgagaatctgtctcaaaaaaaaaaattaattaaaaaaaagaaaaagaccaagttctactctacagatagagacaaaagtggcaaatattaaggaaatgtttataagggagctaatgagatcaataggaccacaaaagacattagataaagaagattctagaaatgttaagattttagaactagaatgtatgacttccaaaaacagttctggttctggctattcattattctgtaatttgttttcctctgatttagctgattatgacaggtataagtagagggagaaaacagcaactcagtcatagaaagggacactaagaatagcaatttttaatgccttctcaagatacctgaattgatgcagagcatttttcaaaactactcagtcaacacattgccggaagaaggaaattatgtctttagagagaaatctccatcatagacattttaaataagacagtagataaaagttcagcatgtgcttaagctgctcagctgcctagattcaaacaaaaaatgaatatcatctagtttcccaatattagctagctcaagacattatctacagggccaaaggaaatgattttggactattatccataactttgaattatgtgtcttcctttcagtagagaatattaggctgaccttttctgaagaataatttaatttaatattgaacaacagagagctggaagctgctcttagattgcatctcaggtggctactagtttatatgtggtcattactaatctagagtcccttttcaccagcttagttttctactaaccaaagaaagactatccatataaccccatcaaagtatgatcattgcatcaaagtatgatcattgcccttgtgtgatgtaaaactatcctgctggccttcttgtactttgcctaataattattttatgtaataacaacccattctacaccctactcaaccaagctgcctttctttggatagtgcatttcaactgaaggctgctatttgcaattagcttcaattatgttgaatacttggcagcattttcccattgctgtgcaccctgcctgtgtcctgtcaaaaacttttgtgagtgccttctgtgtcattgcaactgcaactccctactatccttaaagagaaggctagataaataattgaggatttgtttttttgtgactttctgttttccctgacccagtctcttctgctttcttgggggcaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccaggtaagcaggctctcccttgggaatgtcctgtttatagccttctgagtttaagtgggtcactttggaagtttaatcctcaaaataccctttcttcgttatcattcagttgtttttggagaaacaactcaaacttagataatatctactggtcaaagtattaggggactaacagtttgttccctcaaccttgtgtccccctgctatgcatatcagaaaatcatcttcaaaggattaagtgtaatcagagttttcagagctgttagtttctatcattaatatttgttcaacttacacattcatctaactttccctgtcctttttgtagaaaaaaaattagctcctgctggttaactcagaagggaaagagtgtgtgtgtgtgtgtgcgtgtgtgtgtgtgtgtgtgtgtgtgtgtgtgtgtgtgtgtgtcagtgagtcattgaggggtgggcaggtgttgtcaatctaatcaggttatgtgttcttaaccattgtattggccatatcatgctgagtaacagattaccccaaaacatagcagcttaaaactacagactgggtatgatggtgcacgcctgtaatcccagcactttgggaggccgaaacaggatgattacttgagcccaggagttcaagattggcctgggcaacatagagagaccctatctctacaaaaaataaaaaattagccaggcatggtggtgcacacttgtagttccagctactcaggaggctgaagtgagagaatcgcttgagcccaggaagttgaggccacagtgagccataattgcactactgtactccagcctgggtgacagcaggaccctgtctcagaaaataaattaattaattaataaaataacaacaacaactgcaaacagctcactcacctgcattgttctgactcagagttcctcaggaagttatatagccaagctgtcaatcagggccttaggaatctgaggactctgctagggctggaggatccacttacaagcccagtcatgtggttgttgacaggcctcagttgcttgtgctattggccagcagcttcttttctaggccatgtatgtgtcttctaaatactactcatgatatggcagctggcttcccccagagcaagtgaccaaaatggagactgtaagcttttataccctaatcttggaaatgacatactatcacatctgctgtatgcctcagagtttatcttctactctgaaagagtgaatgtgggaggggactgcataaggtcatgaataccaaaaggcaatgatcattggaggaccatcctggagtctggctaccacagtcacctaacatattaatctttattagagagtcctcacacatctgaagggtttaaaccacagttaaccttgagagtaaaaatgtatatattagtatactggtgtgttaacattttgtgtcattactgttcatatatttacttgaataaaaatttaaattgacttacatttaaaggagattttacatttattgacttaacgaccatctctagtaccaacaaaacatttagggttttttttaaccttcattaagtagggtgaaaggaatttaaatgttgtttattagtacagatatacagatgtttggctaattccagtgaatattttctttttcagaattttttgcagataacctgggtgattttctcatttttctccgccgctttgccgatgacattttggagacatcagcagattccctggagcatgtccttcactttatcaccattttcactggaagcatagaaaggtgaagtgctgaaagcttggttctgtcactgtttaggctgtaaaacattcagaagacttctaaaccaagaaataaacaagcctgaatcataaggggttgccttcagaagttatggtaacattaaggaatcacctgaccatccatatgggtagccagaaatcccactgttgagaggtataataaacaaaggactttgtccacagagaatttaatcctgcatataagtatcttatgggaagtccactgccagtccctggttaaagtagttaacctaatgccagaaacttaacagtggcagccaggtgctaatgatcttctaataattatatgataataaagcttattcttgctattctgagttggatgagcagtaaacttaagtcaatgttatttctcatttcaagttttctcactcatagcttctagtcctcttttccaaaggaagatactgtgacttgtagaattgcttccctgatttttttgatgcataggctaaaggaagtggaaactctgtgtacaaaagtgaagatttgctgcacaatgaagagaatgacccacaattccctgagccgtatcagtgataagtagagagaagccatttcttcactgagctgagcatacctaatgagaagtcataagtcaacaagtattatgcatacactgtatgcgtcatgggtaatgtagcataattatattctagtctttaccctcagaaagcttgaaaaggcaagtttattccacatgaaactgtcagagaataggaagcagtaaataatgcattattacagagaagtaaacaatggctaagcattcaatagaaacttaagtgctcaccgtcatatttggtaagctgtcaactcaagagttaaatgatgtaccctgcatcaccaccccaccccccgcccagccgcaccaagaaactgacaaacttaaaactgcagaagtggatccttttttttcctgtaatatggtttagggtggattttgattcttatgtggagagaacagagtcataaatttggagttaagcttatctgctcatcttgctttttgcccattttgcagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggtaaagcagtcatgaagctgagcccagaactgggaagctgataccagtggagtttcatagtttgatccgtatttggatatcaaagaaatgtcaagccattacttattgaatacctactatatgccaggcttgatgataagtgctttttttttttttttaacattatcccattgtcaccattggaaaagtttcactctattatccctgttttatttattttttattttttaattattcttgttttacatatgaagacatgactgcccaaaagatcagtttgtccatgtcataacaaactaccaagtggtagaatcaggtctgtgtcacctaaagaaatctacatattcaacacccttattatgttgcatcatcaaatcagactcaaattagactatttgggtctttatatttctctgccttaaaattacagaatagtgcataaagaggcagtgtattggttgagagattcttttatcttaaccagactatctaactctccaacagtctaatggttcgattaaaaataccagcaggcggacaggcacagtggctcatgcttgtaatcccagcgttttgggaggccaaagtaggcagatcacttgagctcctgagtttgagaccagcctggccaacatggtgaaacccattctctacaaaaatacaaaaattacccaggcatggtggcaggtgcctgtaatcccagctacttaggaggcagaggcacgagaattgcttgaattcgggaggcagaggtggcagtgagctgagatcgcaccactccagcctggatgacagagcaagaaatccctctcaaaaaaaaaaaaaaaaaaaaaaaaccagcaggcaacattccctctctatctaaccctgagcccctgtgtttgtttaaacagtaccctgtctcaatcagtaaataagatatgttaagaagttgttgaagaccattttttaaagggatatctaccatccaatgataaatacaactaacatttaaagaggcatttaacattttactggccgcctttccatatttggattctggttttttttaattcgctcacctatcaaccttagtttcctcatctataaaatgggtcaaagtgatgattaagtgaaataatgcatgtaaatctttataatacataagaaattgtataataaatcattgcagttatctcgttatgtgaccatacaaccaaagtgttgtaatggagtacaatttctgttttatttctgaggaagtggaagctgaagaagattaagagacttagattaagcagagccagaatgaaaacgtaggtcttttgactccaaatcctacactcttcctttattatgacccagcctgtggagctctagtaatacctttggtatttcaaaagcagtataagcctcagatttttagctcctgacctgatttttcagagtaatcaagaacctgttggctacacagtttgggatattgtctgtgaagaatgtgggaattgcttagtgtcccgtcctgcacatggctttcactgccataatggccagccctgagccctcatttaaagcctgagaagtactcatgtttggatatggaaacatttgtttcccttaacttttattttacagcttggtacttgtctcttgcagagtaaggtatcctttatctctgtctcccccttacttcatcagtaaggaaatgagcaaacacttggcgataactctaggcctttagaaactccagggcagattttgttagtagccttaacacactcaaaagcaaatgactacaaagcaaatggctacacataagcataaactcttcctcttatggcaccgcctttgctgatatttcgctcttgccttactccaggagacccccatcaatttgaacagaagtttaattaccgccgtcccatgtatcctatcctaagatacatgtgggggacagatacctatcgggagagcattaaggtgagagagtttttgatgaaacctgttgctttatataagccctaatgagttgtaattcagtactaaaatggttttcttgtgggctgggacttacaggatttggctgactatgcctctaagaatttagaagccatgaatcccccacttttcctccgctttcttaacctgctaatgaatgatgccatcttccttttggatgaagccatacaggtaaaaaaaaaaaaaaaaaaaaagatttaacttctccataccatcaaatcatcagcagtacatacattttaccttttaatcataatagagcagtccttatgcccctagtaccagacttgaacaccaaaaatttgtgattagtagtgtaccaccaagcttgtcattatagagctttctagttcattccattagagaccaagatcaagggtcattgaagcatcatgagatggacattttggcagagtcaaaaataccatatggtgaagccaaactaagttgtactggcaggagtaattcatcaggccagcactacagaaagaaatcagaggagcttgcttttggtcagtgactttcaacccttttaatcccaacatgtcagtaaaatatctcactaagacagtgatttttaacccactttcctaaaagattctgatttttgcaccactacttgaaagaaaatctctgatttgggttattttttcatataaaggctccaagttgtcaatacttctcatatttccactgccttctaaattcttagctatatggtgaaacaaaggtttcacaaagtataaaatgcagctgggtgcctctcagctccttcagtgtattatttccttaaccttccctggtggaactgcttacttctcccataaaaacttggctgtctgtagagcaaaacttcccttacctgtgatgggtataggatggacaaggcactgacctaaagggagatgaagcaggtaaatcctgagggtagcctttagacagtcatgagctcctccttatgatcagcaatcccctgagtagcttgtgtttaatttgtgagaaaggtttgatctgatttcttcataatcctacgctttaggatttaagataggttttcttcaaaagcgagaataggtcctgttacaaacaggcccttttaagcaagaggtgtgtgacacaaagcatgaagcagatggtattttcatgagactgtaagtttaacaagttgtttgctacaacaggaaggatgacgtgaggtagagagttttaaataattatggttcttccacgcatcttgcatatgtgatagagctttgatttttttgtaagcaatttggcaggggggatttgttttcatctttcaggaaggattcattgttttttcactatagtgtggggttttttagttttttgtttcttggcctgggtttcatatattaaactattcatccttctttgcatttcacaatgctatactatttctaggggaattacctgtgaatctacccaagctgaaacaaatctgtatgaagccacaatttctttttttcctgaaagttcttttgagcttcagccttatgctgagaaataaaggctcatgtcttttacatggtccctcgttttcccagcttagttgactggattttgaataggacctcttaaatgtcacgtcccttcaactgcacctttcttctctgatatatcccatctctggtttctgcagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcaggtaaggacatgaagtactgcttccccccaaaaaagtaatggccaagatcagcttcacttgggggatcagcccagctgaaactaagaattcagaccctggtgacagtatcctccacatctggaagggaaacgaatcacttgagaagcttcaaaaagaatgatgatgcccattgttgacatggaagtgaggaaatggtcaccctcacacagctgccagagagcataaggtggtaaaatctttcttgaggacaagttagccatataaatatatgtgtgtctgtacacacacatatatacatatatgtttgttaatctgagaaatacgcttgaatcctggttaaatatggtggatctaacagaaatttatctctactccttctatagctccactgtccaattcagtagccacttgcaacgtgtggctttcaaggatttaaaatgtagctggtctgaattgagatgtgctataagtacaagacttagtgttaaaatgtgaaatctgtccatttttatactgattacatactgaaattatcatttttaatgtctcagctaaatgtgatatgacaatcagtaatcaccagacatttgaggaaatcctctaatgtgaaaaacaaataggtgaaaactttgtaaaaactttttaaaaaaactttttaatctcagagggataagagaagatacagcagccacaaaacaagaacaaagaggcaatgaaagagattatttgaagaataagaaagagcccttggatattgaaatttttacctcggaaatgttaaatattcagtaaaggagttagaagatataaattcaaggaactcttctatgaacgtagaacagaaggaaaaagatggaaattagaagagaaaggataagaaaacaaaaggatggatctaggaagtctcaaaagcgaaaaatggaggggaggaagttatcaaagataccaaaaaatccccaagactcaaagacagcctctaaattgaaagggcttgccaaggcccctgcacagagaattttttaaaacccacagtgaggtatgacattgtgaaattttaggaaatcatggtaaaaacaagaccctaaaatagcccagagaagtcaggtaatgttaccatagtttaagtatcaaaatggctttgcacttccaacagtgtcatttgaagctgagacacatttctgagggaaagtaaacctaggaggaggaaggtggaattcaacacaagggagacgcaaaggagattcccaggatgacggtgaaaggagcttgtgtggccactacatagcaggcctgtagagcaagcagtccaggttggagcaaaggatggaaacatccagaaagaatgtttccaaaaattaatcagcagctggaaatgaccatgttgagagttttaaattccaatggagagtttggaaaggatttagtgataagaggctctgaaaataagcaaataagcaaaaagttatactaaaaaggaactatatactcattaggacagcacatggctctgctgtgaataatatttacataatcttaataacaaactaaattatttaagcaaaaatttgactatatattgagggcatctgtgataatgactaaaactgaaaaatcaagaactatcagtaccaaccaaacatagcattatgatactgtctgacttgttaaatttggcatgtataaattttttttaatttttggaattcatgccctataacatagcagttccttacagatttgttaagaagaagcgataggccaggcacggtggctcacgcctgtaatcccagcactttgggaggtcgaggcaagcagatcacaaggtcaggagttcgagaccagcctggccaacatagtgaaaccccgtctatactaaaattacagaaattagccaggtgtggtggcatgtgcctgtagtcccagctgcttgagagactgaggtaggagaatcacttgaacttaggaggcggaggttgcagtgagcagagatcacgccactgcgctccagcctaggcaacagaatgagactctatctcaaaaaaaaaaaaaagaagcgatgagtctacaagatgtatccacaatgaagttcattgataagtgtaggaaaaaactgaaaatagtaaaaatgtccaccagtaaagacattaaataaataacttatggtgcagttacaactggaaaagtcagccattaaaaatgatgtaaaacagactgggtacagtggctcacacctgtaatctcagcactttgggaggccaaggcaggaggatcacttgagcccaggaagttgagactgccttgaaccatgatcgtgccactgcactgcagcctaggcaccagcaagaccctgtctcaaaaaaataaaaaataatttttttaaaaaatgatgtaaaacagctgggcacagtggctcacgcctgtaatcctctaaccctttggaagccgaggcaggaggatcactttgagcccaggagtttgagaccagcctgggcaatatagtgagaccccatctcattttttaaaaagattatgtgaatcacccctattctatagaactttctgtgatggtgaaaatgtcctataaatctgggctgtccagaaccatacttaactagccacatgtggctagtgtgactgaggaatggattttttattttttattttaatagccacatatggccagtggctactatgttggatagcacagggacatacacttactaaaatgataaagtatttgcaatatagttactgaaaacagtaagtttcagaatatgtaaaatatgatcatttttgtttaaaaaatgtctgtgtgtgtgtaaataaggacagaaaagctagaaggacaaaatgttaaattagcaagatgttaacagtgtttatctctggatggtagtttttgtcttttctgttttttgtttggttttggttttttgcttgtctatattttctgcagtgaaaatgaattacttagttttttaaaaaagtagttccttcaaaatgtttagaaataaaataacagtagttcccagaggtctccaaataaactatacctaataaggaaaagagtgctaatggattgagttttcagagactttggattcttttccagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttgggtacctgagattgaaatctgtcaagccagaggggatgctgttttgatttagggttttgatagtagaatgactggttggtaattatgtgaaaatagaaaagaaatggttaattcctagttgcttgatgaaggaatcttctgtagttttaaataaggagattttatctgggcaaggtgtcgtgtgcctgtggtccaagctacttgggaggctgaagtgggaggattgcttaaggccaggagtttgagaccagcctgggcaacacagcaggactctgtctctaaaaactagtaagattttgtgtgacccatgggacattgagatttccagtattctgctttgatctgtgcaaagagaaactttactggttgtaccactgtttagaaaagtagcattcttttaaggtcacatgatacttgatagacttcctagaaagtctttctgtatcaaaaagtatatatattaaatatataatatatttaatatatattatttataatatattattatattttatataatataattttatataattataataaaatatatattatattttattattataaataataaataataaaataatatttatatattataaataatatatattgaaataagtctttctatatcaaaagaatgttcatggcttttaagtggtgagaatgcttgttctgcagcctacctattgtctcttccattgaccaaccctctggtgatcagtttttttctgatgctaatgttccagggatgaggagaatttctgtgccactgtgcccaaggatggacgttcctattccccaactctctttgcacagacagttcgagtcttgaagaaaataaataagcctgggaatatgattatggctttcagcaacttggcagagagaatcaaggtgaggaagaggaggaattgtttgctgatttcattaagaaccacgttgtcagccaggcatgatggctcaagcctgtagtcccagctacttaagagcctaaggctagaggatcacttaagcccaggagtttgaagctgcagtgtgctatgatcatgcctgtggatagccactacactccagccttggcaagatagcaagaccccatctcctaaaaatccatgcaaaaaaaatcagattgtcacctcagctgtgctgatttttactctatttcagggagaaaaagagcattaccaagagaaaatataaacagatggttctttttggacagtcacttagaactacaatattcttagttttattcttgtcaacatgagagtgagaatagaaatttaagaaatcggctgggtacagtagtggctcatgcttgtaatcccagcattttgggaagccagggtgggcagatcacttgaggtcaggagttcaacaccagcctggccagcatggtgaaaccctgtctctactaaaaatacaaaaattagctgggtgtggtggcaggcgcctgtaatcccagctactcgggaggctgaggcaggagaatcgcttgaacctgggaggcggaggttgcagtgatcgcaaccactgcactccagcctgggcaacagagcgagattccatctcaaaaaaaaaaaaagaaaaaagaaatttaagggccaggcgcggtggctcacgcctgtaatcctagcactttgggaggtcgaggcgggcagatcacaaggtcaggagatagcgaccatcctggctaacacggtgaaaccccatctctactaaaaatacaaaaaattagccgggcgtggtggcaggcacctgtagtcccagctactcaggagactgaggcaggagaatggcgtgaacccaggaagcagagcttgcagtgagccaagatagtgccactgcactcccgcctgggcaaaagagcgagactccatctcaaaaaagaaaaaaaaaaaaatttaagaaacctcaactagaagagaagaatgtgcacatttatgtaagatgtttttatgaaaacgtttatgcacagtgttaccaatagattttaaaagctagggtgttaatgcagaataactttttagaaaaaaaaaaagatgagtagttttcagtcattaatttttatttggattgtctctatgtttgtagttggtagttggcttttattggaatatgcatacattttaaagattaaaatactatattgtatttagctaaatccctttggttagagtatgacagagctctattagcaggtaagaagaaggaagatcatggcacaaaagtctaatagaaaaccttccttattgctgtcagtcttccctctattgagtttcttttttattgagttggacttcatctttgtttagagcttagccaggtggatccctgaggaactcaagttgtgaaggaattaaatgtcaaaatgactttaaaattcctatacctgtttgtatcaaaaatcaaaaactgcttttcatacgcaggctgcatgagtgactctaattatgcaaataataccctcctccattctcccttctccatccacttttgaattatggcatttacaacagaactgttgccagatggatgttatatctgatgtatttcttttcctcctaacatttaaacccatttccagtatgactgccagcagctgagccaacctaaaggtccagagttggggctcaatgcttaatttgttcttagaatatcttggcttgtttttgagaaaatgaagctcacgtgtgtcactgtcactgtcaagggttattaatgacctgtttttttatttttgagatggagtcttgctctgtcattgagcacgctgaattcagctacactgtgaattcactttaactaccagatgttgtatactcagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcaggtaggccagtcccaaaaacagactcaagagcatatatatatattagtttgctatctttttctcccaggcacctaagacagtactttgcacccaacacataccacatattattgatttactgatatgttggaagacattttggtttcaattgctaggatataaacatttcaaaacaaaacattctgttgagaaatgctaactctaacctcacctcttcctgccttaagaaaataatttctggccgggtgcagtggctcatgcctgtaatcccagcactttgggaggccgaggcaggtggatcacttgaggtcaggagtttgagaccagcctggccaacatggtaaaaccccgtctctactaaaatacaaaaaattagaggggcatggtggtgcgcacatgtagtctgagctactcaggaggctgaggcagaagaattgcttgaacccaggaggcagaggttgcaatgagccgagatcgcaccactgcactccagcctgggctcaggtgatcctcctacctcagcctctggagtaactgggactacaggcatgcactaacacgcccaactaatttttgtattttttgtagagacagggtttcaccatgttgcccaggctggtcttgaactcctgggttcaagcgatccaaccgcctcagcctcccaaagtactgggattacgggtgtgagccactgtgcctggcctgtttttttatttttgcgacagagtctcgctctgtcaccaaggctagagtgcagtggcgcgatctcagctcactgcaagctccgcctcccaggatcaagtgattcttcagcctcagcctcccgaatagctgagactacaggtgagcaccaccacatctggctaatttttgtatttgtaatagagatgaggtttcaccatattggccaggctggtcttaaactcctgatttcaagtgatcctcccacctcagcctcccaaagtgctgggattataggcatgagccacctcacccagcctgctttttctaattcaggttttacactatattcaccatgtggattaactcacgttctgttgctgttgttgtatcagctgtggtaaccatgaactttccccagcctgcctattcttcggacagtctgccccattataactatagaaaagacaggaatgaagcaataaatggtagcttattagctgcttaatgggccccttaactttttttagtccggcattagaaagaaatgagtactgagagactctgcctatttatatatttatttatctatttttttgagacagggtcttgctctgtcaccaggctggagtgcagtggcatgatctcagcttactgtggcctcaccctcccaggctcaagcaaccctcccatctcagcctcaccaagtaactgggaccacaggccatgcaccactgttcctggcttatttatttttgtattttttgtagagaaggggtctctccatgttacccaggccagtctcaaactcctgggctcaagcagtccactcacatcagcctcccaaagtgctgggattacaggcatagccaccttgtttggcctctccatatttaaaattaagttatatcgagccaggcacagtggctcacgtctgtaatcccagcactttgggaggctgaagcaggtggatcacttgagatcaggagttcgagaccagcctggccaacatggtgaaaccccgtctctactaaaaatacaaaaattagccgggagtggtgacacatgcctgttgtaatcccagctatttgggaggctgaggcaggagaatcactggaacctgggaggcagaggttgcagtgagccaagatcacaccaccgcactccagtctgggtgacagagcgagactcgtctcaaaaaaaaaaaaaaaattaagttatatctctacaaaaaattatttttaattagccaagtataatggcacatgcctgtagtcctagctactcaggaggctgaggcagatcgcttgagcacaggaattcaaggctgcactgagttatgatggcagcactgcactcctgcctgggcagcagagcaagacaccgtctctaaataaacagatagatacatgtggtatactttgacccaaagttaaggaaatttttaaatattaaaaagatgaatttttggccaggtgcagtggcttacgcctgtaatcccagcactttgggaggccaaggcaggtggatcaccctgaggtcaggagtttaagaccagcctggtcaacatggtgaaaccccatctctactaaaaatacaaaaattagctgggcatgatagcacgtgcctgtagtcccagctactcgggaggctgaggcaggagaatcccttgatcctgggaggcaaaggttgcagtcagccaagatcacgccactgcaactccagccagggcaacagaacaagactccatctcagaaaaaaaaaaaaaaaagaattttctacctcttggtatttggtattaagcattcactatatcgctcgaaatgtggcccaacaaaaattcataacgtttcttaaaacattacaagaacttatgtataggccaagacagttcttccaatgtggcctgggaagccaaaagattgacatctgtcataaaccttcttatgtttcaagaaaccataatctgcatgtacttgcataacaatcagctgactaaatcaaatgttggtctacaaggctttattccttaacatctcatactgttctaagaatctgtcactataattacaaatagttctttacactgacatgaatgtatagtgtctctgccttagagaaatctaaaggtgacagaagcatagcattttttaagccactgtaattaaatatcatctgaacagcagtgttgagacaaagtttattaagaaatagaggccaggtgggtggctcacgcctgtaatcccagcgcactttgggaggccaaggctggtggatcacttgaggccaggagtttgagagcagcctggccaacatggtgaaactctgtttctactgaaaatacaaaaattagctgagtgtcatggtgcaggcctgtaatcccagctacttgggaggctgaggtcagagaatagctttcacccaggaggcagaggttgcagtgagcagagataacgccactgcactccatcctgggtgccactgcaccagcctgggcgacagggcaagactgtctccaaaaaaaaaaaaaaaagaaagaaagaaatagacaaagtagctacaaaaactcctgaatcatcttgttctcactctttctaaccccaactcggcatttgactcaaagttataatgcactctggcttcattcttaagatgcgacgcccaggtgttctgtttttggcttagaatgttagaacttatggaaataaccctatttccctttctctctttgtcccagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttggggtttttttttttttggttttgttcccttttttttttttttttttttctttttttttttttttttttactaaattagagaactgctcttgctgaaattatgatagttaagattcctaagaacttgacaatgctcccctggcttgcaggaaattatacttattatagcatcaccaagtttagaaatcatcactaattttcaccctctgttgtctcttcatattcttcttccttttcctaaatgaaattatattatttcaactactaaaacttcccgccaccctgctatttctcttccaattactgttcaaacatttttggtgagtgctgcttttataaatatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaa

SEQ ID NO: 14198 - DNA, 21438 bp, Human
accccaagtcctcctaaactcccttgagcatggattctagtatgtgagttcctttgatccctgtctctcaggactacactctctgagcattgagctctccaaagccccagagtaagcatggagtagttggagctcagacacagctgggtaacttcggcaatagtaagatggaaagaactcctccttgtcccccgccccaggagtgcactctagacaaagtctccatcagtaaagaagagaaagtgtactcattcaactaatatgtagtaggagctggccttatgctcacgaaacacaaagtagaactgctcctgctttagcaattttacattctaatgtcagtagggtggatgaggagtgaaaaaataaatcaataaataagaaaatgttacttgttaataagtactctgaagacagtcaaatgaggaaatgttacagagaatgaataggaaagagaataagactactgtgaattaggtggccagaaaatcacttggatggagacatttaaatggcaccctgaataatcaccatctgggggctgcacacaaaacagaaggccagatggccagtgtggccagaggccagtgagcttggtgaaaggtggtgtaaaatacaggcaggaactaaatgaggtaggcccttggaggcaaaactgaggagtttggatttatttcagtttcaagtccatgtcagggtttaagcaacatagcagtagtccaatctccatttttaaaaccaaagttctggctgctatgttggcatgaattgtaaagtgctaaatgtagaaaggagagtcaggtaagaagctatatctatggctctggcaagaaatgaccacggtttggtttattgtcataaagagacttgaatgggatacaatttggtttgcacagagacaacaagaccagctaagagatgaaacgttgatactggcaattaaggcgatggctcttccaattttggtatgaacaactgcatggtggtgattatgtttaattataagtggcagaattgtggggggaaaatatttgagagaggaagaggaagctagggaaatgagagttccattttggttaatttaaattttaatgggctcttaggcatccaggggtagaaataatcagaccagaccactcaagatatgaatctgattttcaggagagacatcatggctgtcaatataaatcaagagcatcagctgcatagagatagttttaagctatgagattggacaaagtcacataggaagtgggtttatatggagaagataagaggacggaagactgagacctaaagtactctaaggtttagaaatcagataaggggaaaggaggcagaaaaaaagatggagaagtggtagccaatgagataggagggaaaataagaatattttctaatactaaagccaagaataaaaggagtctttcaaggagagaatagtcaactaataagctacaaatgagagattgagttagatttttatggagaaatggccattagatttcacaagtgaaggttaatggggaccttgaaaagtttattttttaaatgatgacatctggtgaaaggaatgtgatgtgctactttttctacttaaatttcataaccaattgaatgttgaaaaaactaagtggaaaattgtgttatccagactctaaatttcagcatagaattattgagtattaaataaatgtaaagaactgtgtcatggcatataaaggaaaaattgaagagctatcattacatcatctgacttaaaatattttccaatcaaaaagattacttaatgttagaatcactttctataaggttgaaaggtaatttttatattcagatatttataatttctgacattaaagtctgaagccatatatattatagtcacaaagtagaaatagatatgtccaaaaaatcatttgacttaaaggaaaaaattcttagtttcaggtagaaatgtctttctgtgacttaaaacaatatatatatattttttctttaactcaggtatggtgacatggtgccaaaaaccatagcagggaagatttttggttctatctgttcgctgagtggggtcttggtcattgctctacctgttccggtgattgtatccaacttcagtcgcatctaccaccagaatcaacgagcagacaaacgaagggcacaaaaggtgcgtattcaactccgtgcaaccatggtttagcacttcccactttttataatgagctttaaaatttcttaatggttattcagtgctctggattggtcagtagttgcatcaatcaggaccgagtaggttattctacactaaaaagaaacgtaacatctcagtggcttaaaacaataagcaatatttctgaatcatgctacaagtccattacttgtccagagaatagagagtccatcttgacagtgtacttctgcagtcactccagcaggagtaaagggcatgatgaatcacacactgcttcctaatgtccctcctggaagtggtttgagtcactttcttgtctattgcattaaccaaagcaaatcacacagcaatgtctaatttcaaagtgggcaggaaaatacaattctactgtggggccagaagcagaaaataagaaatatttgacgaacagcactaatgacagtagcaaaatcagaaacagattcttggcaaattttattaaaatcagatttctagatctgattcattgagtctctatctatcaagggtcaaactggttccagtagacgagggttattaaaggtcaccaagatgtgtctcagatattttacatagttgacacaagaagtaatctgatcatctgtagctgaattttattctcgtcccagcagcttaccgtttgtttgaacttcatgccaggtaattaatccctctaagaataagcatagcgtacactcaactgtaaaatggggaaaataataaataataagattaagattatatacaagtatatgtaaatttatataaacacatcatattatcaatatttaatgtttactgatggtttatatgtgtcagacattagcctaatgtttttcacaaaagaattcatatgttaaaagacaaaccttagccaaattaaattgaaaagtttaattgagcaaagaacaactcatgaattgggcagcctttgaagccagagtaagctcagaaactccagcacagccgcatggtagaaaaagatttacaggcagtaaaaggaaagtgacatacagaaaacaaaagtgaggtacagaaacaattgtactgattatagctcagcgtttgccttatttgaacacagtttgaacagttggccccctttgattggccaaaactcagcggttggcacaagagtgggttacagtctgtttactcctccatgtaagttacagttcactatgcatagagaaacctttaggctaaacttaaaatatgtaaggaggcaactttaggctaaacttgagtcaacacatacaaccttcacaaaaactctggcgttagttaccattattatcctcatttttatagatggtaatcctcaagtacccccaaattaagcaattgtaaagtcacatacctgttaagttggagatccaccattccatccaagccattctggctcccaggttcatatacacaaacactatgataaagtgcctctcagaaaagctatgtaaatgttagcatacttcccttccccaatctttgtcaaaatagtcaccttgagaggcagggcccttgttgcttagaaataatcttggaaatctcttttgtagtttcctttggacttatggcactgtatttccagtgttcttcatggtcattatatctttgtcctttaaggatagtttcattttttaaaaaatatccaaaaccattcataatcatgactaaagtagatgcacaacctaggtgatgtgttataactacaaaatatcatgagagactttgatatagttattcactggctttgtaggtaattccagaacgggatcttaagcacgcatatgaacaatgtcagcctcttaagtaaagtatacaatctcataaagtaagtctttggaaagttctagttaatcactgtggccacacagcatatttgtccagagaactaatttatgcccactgtcaaagatcttcttcctttagcaaagaatcactttttcaagctctgtagttacttgctttatggaacccttcatttttggacaaatgcctagcctttaattattacagagaagagttagaaatagtccagtcaacatggatatagagaactgatcatctaacgaatagggaggagtagaaaaaggcaccctctggacagttgtagtcttatgtagggaatacatacccttggcaagcagaggtaaagggatttcagccacaactgaccccaccaccagggaccttcaaacatcacactcatgacgctgcccatacagtacagtccctctactgagtacaaacacacattgtctaaaataacaggatcctaccaaaagtttaactttcaaccacccatctatctccattctagacatttctcctttagtataagagccaactgtatgaaaactatagaaagcacaaatctaaatttccgataaaccaatttcccaaacacttgtatttcttcagagtttgtcatctgcaacaaagaaatcaataaagaaaaccttagaatattttagaagccttttggtctactaaatattaaatactaaaatacatttagaaatcaaaagtaaataatgtgacattctaaaagtacactaattgaaaagtatattttgtgaatgctttttggtatctttaaatatttgctatatttttggtttctgccataatgcaatgaattttacagagttttactactgaaaaaattggattaataaagtaaaatataataaccaagtataatatgtccagtatgtagactgtgaccaataaactgaacataatcttctaagaaagaacagtggatatgaactaaataagttaccaggggatattttctattttccttcccaagagattagggggaaaaaaaagcagaacaaacgcccattaggctaagacagtttatttatctgggactgggctatgtgccaaatattaaagttatgcaaaaatgaccagctaattcagtcaagcaagcattcaattcagtaaaaacgtcagtccaactgactaataaaagtaatattacaaaatggtttgttagaccatatttttggtgtttaattcaattgccacactaagaccaagcaaaagcatgaaatagacacaatattaattttagaaaattcctatcatcactatcagaaatactttccttcttctagtttcttccatttgcaagtactcttcctacttttgctgtccactcctgccatatacagggaatacatggtttaccccatttctatcaatcattgataaagtcttaactaaatactgacatgctggtgggtataggcctaaactgtgacacctctcctctactcccaccattggtaattatattttaatagatttattgattctcgtagttatactataagtatttactgagtagaatgtattagccaaaataaagctagattaatgcaatgacaagtggcaggttgacattttgaagcagctcttttaatatatggatcacatcacctaatcatctgcatactcacaggctaacctgtgagtaattatcatataataatcatagtagtaattatagttataatttaataatactaattgcaacaacaaaaaccctcactagtttctagaatgtcccaggtgttttatatctgttttttttgtaatattcacaatcaacttgcaaaggaagtatactatttccattttacagataacttgctcatgctcacaaacctagtgattaaagtccaaggcaaaaaaattctagtattatttgaactatgaatattttaggatattcctatagataattctaaatgcagtgagaagtttagaatcaatgagccaatgtatagtgtaatatttttaaatttcacattgacttagaaagacactacccatatgtagtctgccatttatcacaccctgctagggtggttttcaaactttagattcattagaatcatctggaaagcttacacacacacacacacacacacacacacacacacacacacaaacaaaaaaaaaaaaaacaaaacaaaaaacagattgttgagccctactcccaaatcatcagactctgtagttttgggttagaacctgaaattttgctaataaattcccaggtgatgctgatattgctgtttggaagaccacattttgagaaccactgcctagtacattcagcaatgtcaaaatcaaagatttttatttaagtagaataatgaaaaagcaagaaataactacttgctagaacctgagaatgatctcttaggttatctactgttaaaaacaaaattacccagctcctaattccacctaagaatttggtcttggatgctctcctatatcctctttcagttctcaccgcttccaccatggaatcctcttgtagacctctcattgcttagcctcttccactaacccaaatcccagccctttttctgcttagccctgccatctccaggattaaccaagttctggacctaggaatgttgcactgtctgccactgacttctttcttctctttttattgtagtttggtactaacttgtctcatttctagcacagctatttttcttagcaagtgaaaagattccaataaatgccttaaacttctaaaaggtgataaagtttactatgttacctcaaactgaggcattttactaacccttaaatgaaagaaacaactgtaagcaaaatttccagaatgcatgttacagggagtgtggaggcaggcatttgaggaataaggaattaccaaagagaaacaccttcattacctcacttttaaggctacctaggatacctttatttttcaaaagattttgtgatttggtaacaagatggcccaataacttcctttaatctacctcatacctcatctagaaatgactgaccatttaaagaaatcaatgtctcagtggtgtttggcttatagatccttctcagattgacttccaccctctgttccacaacataaactataaagtttatgtcacttggcgtaattaaaaaacaatctacttgataaaacccattgtgttccactgcattctagcctgtgagtacttcacaatacaagatttctatgtcaaattagtttgaggaaatttgcagattatatatccctgttcttctcacagtgatcatccacaatgtcatatggtgtgaggaacccgggagcaaaggaacctgtttaacacctcagcatttcccagccttttcttgaccacagaaccagtcatttgcttcatctgtttgatttagattttacttaccacacttacgaattccttggaaccaactttgagaaatcctgctaagattagatgattggacaaaagctgcagctatgaagaattgggatgcataggaagaatatgtttatgagacagacaacttttttccaaataccatcaccatttaaggcaaataaattatttgaaaataactatgaagctttttttacactgaaaatgtaaaccttgctttaattaaaatttaagaagtctcctacttttcatacagctaaaataaagtacttactgaaacttttctccaacttccatattatttgctggtactttgccatgccagaagttgtatgtcctaaaagggtcgggggtaagagactgaaaggaatacatttctttttaccagcagatggctttcttttaacctcccaattacataattggtgctgccaagattgtcatactgagtggctcagaagtaagatgatttcctaaaatatctttgtaaaataatttccctcaattacctgctgtaatcacaagtcatgaaggctagcattcaacaggcatttgttgtggtgctccgcaagaccaattaaaccaattaactcctatggaattgtagtcgggtcaaagaaaagccatgattgaaatttagatgggaagttctttttctaacacgctgcatgacttagcaaaaatggatagtctgtctctaaagcaacttctttttccctaagcttagaactacttctgcagtagtgtttgccaccatatgtaggctttccattatatgatgagaaatatatgtcattttattttgctggactgtatttttggttaatgtatatgttttcttaataaaagaaaacagttttacccaatgctgctgctgaatgcttagagaatgaagggagggagggaggagttgggagtcaggagtagaaaggcaatgaatgttccaggagactaaagagacttgaagactgaaatttcaacaataatccctttttggaaaccaatatataaattgcttatttctgaattattaagctaattctgagttgtttccaaatgtccttttcacttgctactgtttcactgagtctggtctgaaatcctgaaactgcagcccagcttttgaagttaaaatttttctaccttccaatttcattctctactattgtgtcagtattttgagtgatctaaacattatgtttccaacaaagaatgaaatttgtctaattttctcatcatttataaatatggtctttgtacaaagtatattattttaacctggaatcagcacacaggaagaataaatttaggaaggaagggaagaggggtggagttaaagacatgatatcttaatgcgattttgagagcttcacacatctcagtgctactctcaaatgatatgtgtgaaaggcatcttggtacaataactttggagggaaatttggtaagacttaacaaaagaaacacacacacacacacacacacacacacacacacgcactccctttggtccaggaataattttgctttcagaaatatgtcttgtagataagctcatcatcatattcaaagcaggcagccttgcttatagttgccaaagatgctttaaaaattaattggcagttggcctggtaaataaataattatttgtttataccgtggtatattatacattcattaaaaatgaggtggatctttatatgcatatacggaaagagttctgagatgtaattaaaaaacacaactaaatgcagaagagtgtgcagagtattctctggagtaaaaatgtatgtgtatatacatgtgaatatatctacttgctcttttatgctcagaaaatttctcacaggattctctagaaatattaccagtgattgtttctgaagcctaggagtgggatggctccagggtcagagacaattgtttgcatgcacttctgtagtattaaaaattgtgtcatatgtttatatttatttttcatttaaaaaatctagataattttaaaatttttattaaaaagagcattccaggacttgagactaaagatagtatttttctaggttgtttagaagggaaaaagaagaagttttgtgagataagcctacaggaaacttatctaagccatcccagtctctgttttacatacacttgctagctacatgtaatacaaatagaatggtcaccaaaatagtgctgtccaggaagggaaaacgagactgtttccatgacggtctaaatgcacgtcaacaacagcagttagaaagtagaatggaatatcagaaatctggctacacagccagatccttagtactttcactttagggatctaactgtaacttaaaggaacaattgaactggccacctaaaccctctacattgaaggatattctctacagacacacacacacaaaatgctttaaaaatgaaaaacaatgtttaaatctctctggataggcttactatgttcttcatttcagccagttcaagagtgaaatacaaatcagatgcacatacagtcgtgcggacccgtgccggtagacaaagtagataaattcacagttgtttttgtttatttgtttgtttgtttgtttgtttgtttagagagagagtccatgttgtttggcatgggatctacctaggctaatttaaaggataattgcaaaaatataattttatattggaggatgcagatatagatgaataatgattcttaaaaaaaaaaaaaaagaaaggaaggaaggaaggcaatcagttcttggtacttagttactaatttttttaaggacattagtttaaacgaaaaggagttggcagctggtttcctgagctaccggtcttcatttcattaagttactcagatcgggataaatgaaaatataagtaaagtaatactgctatttttattttgacagaattgaaagaaacaataatgaaataacttgatcttattgtaaagacttaattataattcttaaaggcataagccagctccaaggtagttcattgattttactgataaatattaactgaaataaagcacttaaaaaggtagagaggtaattttcaatagttgcatttgaaaagctggcttacttttaaaaatatgtaggctgacaataggattatacaagggttcattcactgttttaaggaaacgatttataaatgttaatgggatgtttattttttctcctatagaaagctagactggccaggatccgggcagccaaaagcggaagcgcaaatgcttacatgcagagcaaacggaatggtttactcagtaatcagctgcaggtacaatcaattacatctctttttttaatgttcaatttcttggtttaatattgatttagttctactttcctataattttattatggctaattatgacaatggctatccaaacaacaaaagtgtgtttgtttgtgtttttttaataacttcaccctgtacatccttgttggctgtagaaggttagaaacttcactatgaaatactgccagtgaatcatgatgcctattcatcattgggcaatatttctacactgtctcttattaacatggtaaaggtaaaaaaaaatgcttaataattcaaatgcctaattctttttcatttcaaatttatcttccttaacgttcatttgggtcaggggttggggtgggtggctaacatgatgtcttgttttacttcataacgaagagggaatactattcagtgttaggaagatcatatggcataaactacaatttgagaaaatttatttttactccagaattttcctttaatatttaggactccaatctttacttacaaaatagcttttatttacgtgcacatgatcgtggtttcaaaattttctaagcactatgctaaatttgatcatcaaaacataacagattcccatcttacaaacatagttgctagttgaatgagtaaaagagatttcaaatttcaattcaaggaggcatgtctaaaagaccagaccattcatttgatgaaattgtaaatgccgatcatccaacttaacaggaactgcacatttgttcctttctagttagaaaaaaataaaatgttgccagttaatagagcagatctctctgtggaaatatgtagccgaggttcgagttgtttgcaaataaaatagaaagctcttctgtcttctctttgttaacagtcctcagaggatgagcaggcttttgttagcaaatccggctccagctttgaaacccagcaccaccacctgcttcactgcctggaaaaaaccacggtaaggagacagcatgactgccttcccttgctctctgacagtaattccatttgcttttgtgcatacttaatgcttccgagtgtgatttcactgtctgcattactggaaaacatgctaaaaaacaaacaaaccaaaaccccacaatatttgaaattactttgaaagatgtaatgacatttcaatttggaaagtattttagaaacttatttaaaatgttttattcttagctgctgtcttaactctagtctaagaagtcagttaatgcagatgaagagtggtcttccaatagtaaatcctacacaatatcattttctgtgattcttaaaatgcgaattagacagaaaaaaattaatggtgctcgagggtccctagcatctagatcaagagaatagcaatagcaataacaaaaaacagagaacaatggaatataagcatttgtttcattcacaaccataatgaatagagatagataatagaaactattctcattagaaaaatgactcatgtaatcactggtatgcccttgggtgctaaggagtgagtctgtatttctccacttacaagctcttgtttggacctcctcattggcaaatctaccaatttcttaaccagtttgtaaataggagtcataatctatgataatcacagagcagaacaaaatcttcaccatatttggatcatgtcagctcactcactctcgggtgacacatgatttgtattctcagttccaaagtattgcctgttcatgtacttatttaccaatagagtcattcagcaaatatttactacttgcctattatgtgcccaagagtgagccagacccaagaaacgccatgaaatgaggtgtggcctctgctaccatttagcctctgtttataaaacaaaatcccagacagggctgttactggaaaagagcagcgaacatggaaagcaacaacggtgccacagtcaagagagtaaagagggcagagccatgaggggacaggtcaggcaaggcttcctggaggaacttgagtggagacctgcagggtgactaggagttagctaggcagagcaatgaaggggctaacaggtgatacaagtacctgaagaaggaaagaactcagcctaggaggaagtgaaataatttaagagtggtcagaagaagagagtgtagcatggcaaaagaggagctgaagggaaaggcagtgtccagataatgttaggctttgcagccatgtggacaattttgatctttagttcatggaaatcatttaaatgttttaaacaaggtagtaacatgattatacttgcatttttaaataaagatatggacaggtctgtaacctagtaggataaatttgaaagttaaatgatacattaataataaaatgttggccaggcgcagtggctcacgtctgtaatcccagcactttggaaggccaaggtgggcgggtcaactgaggtcaggagttcaagtccagcctgaccaacatggtgaaacctcgtctctactaaaaatacaaaaaaattagccagacatggtggcgggagcctgtattcccagctactcgggaggctgaggcaggagaattgcttgaacccaggaggcagaggttgcagtgagctaagatagtgtcactgcactccagcctgggcaaaaagagctagactctgtctcaataaataaataaataaataaaatatttttattcctatcttttctgttccctgtattttccttttttgagggctttttttaaaatcaaaaatcactaacaccaactaatataaattatgctacctacaaaagtatgtagtaactaataacagaatgactcctgcactttcaatcactgatgagacaaattagaatctcatgcattataacttaggtatgtgaaaccatgcattgtaagagaaggaaacagattgtgaatcttttgtgcaccattttttctttgaaatttaatatttgaaatattaatttcaaatatttctttgaaattctgtcttgtctgattatattattctctagactttaaagagtagaatgttaaatttcatttatttcaaaatgcttgtctcagcaaagaaatgacaaaacgagtagctaaaacataatctatttcttattagccagtgtcttgcttcaattgttttactcatattttaggatgagagatggttaagtggaatttggtatgtgcaaagccttccattataagactatccccacccatgcaaagaaaaacaaaatagtaattgaggtcattctctagtagttcagaccaaaaatgttttcctttatatttctgaggtgaaattcttccataggcatttcaggaggttttttgtcaaacattttaaaagcaaaattgataccatgtttctataaaatacgatatgcgaaatgatgcctattgctatttgctactgggctggaagttaggaaatagtgacggaaaaaccccaaatgcatacagagatcatgagtacagccagtgatgccagtgatgtattacgaagattacaaaaaaggccacaaaagttcaatgctaatcccttctgggtcgaacacagagtgacacattcggcagacaattatattttacttatgtaacgaataagtcatatttttctgtactgggcatttttagaggaacatataaagaaatggatagtgtcttaggggtctcattttctaatttagaaatgttttcactcccatgtgaaaagatttgctaatatataacagacaatctaacttggggcatcctattaaaataatctattttccataacttcaacctttttaaaaaataaagtcagtgggaatttctaatttccctgtgggttttatctatatgcattttttaggttttttttttccttatcatataccttccagattttatgtttaaataaataaatgatatttcaagataaagttagtctataaagggacactaaatcagcctacagatgtcaatctctaggtttaactacagagatagttccacataaatgccaaaaagaagtggttttgatgtcaatctttatgaaaatggttttatttaaccattgtatcaagtctaactatacttgggcagatttgagctttaaaaataaagctatgtatttcgtttttaaaaatgtgcttctctgtttcttcatttacttacaactgtggaacagaatcacgagtttgtggacgaacaagtctttgaagaaagctgcatggaagttgcaactgttaatcgtccttcaagtcacagtccttcactgtcttcacaacaaggagtcaccagcacctgctgttcacgacgacacaaaaaaacttttcgcatcccaaatgccaatgtatcaggaagccatcaaggtagtatacaagaactcagcacgattcagatcagatgtgtggagagaacacctctgtctaacaggtacctgagattaatctgtgttgtctacacacctgtgctggttcccagggtgtgtcttctgcactcatgttgtcacttacatggcatctaaatccctagctcctatggttcaggaagagacaaaaatggtagcgtaacaagtaggaaaatggttctgcttgcatatccattaagggttaaaaatagtggttatatcagtattaaaagagtcgaaagaagaagagatgattgagtgcacacaaatgtgtttttctctcttctgttccacaaccttttcttatttgggcaaggacttttatactcaggagtctcttatatattcaatagtctgaaatgatggtggacactactaaaagagtcaaatgaaattgagatcaacatggctaaaaattattgaacagcatgtaaaaatatacaaacacactgtctgtaacagtaaaaatgaaaactttgcctacataagtcatttctatcaatatataattttgatcagaaaggtatttttggccatatcaaacacaaaatcaacataatacaaaaaataagtgaagtactaaaattgtttgcctctggttagtttatgaacaaattaagtaaaacttccatattgatatatttcctttgcttttccttattcactgtttttaccacaaatgtgtaaaaataaaaagttgtacatttaaacaatatatgtcattaaaaatcagtttctgccaaaataattttattctgttttcaaattgaacagcatatattgttagagtgagagtctgtaaattcagtcctcttctttgttggcattcagaagtctttgttgaaatctggatgagattctgaattcaggtgatgttgatttacataaattggatgtctctgggactagaaaattaaaattaggagccataagacttctatcttcaagatattttagctttgcagttttatatcctttataaagtgaagtcgacaatggaaaattatctagcaagaaaatcttaggacataaacatcttaattatgttttccatgaaaataaaataatcagtttcaagcttctgtgtatatccttctctctcatttcccttttatccccttccccacatagagtatacaattcatccaataataccatttgggagcttgaagtgttagatagtaatagataatttttttatttctgtaatatgtgatcatcattaagttcagaggtttgagggcattatatatcccaaaaagacatgaaaataaaaatattctgtggtcaaaggaattaagaaatcaatgtgatatggctctttcatagtggtttctcaaacctctcagaggtctgtcttaaataaaacttctttgctcagcccaggctgtccaaatcttacttgaagctctttctttcttacatttttttataatacatttagtttgataaatacttgatggaaccaagtcaaactgtcttttagaaatttatttaatgttaattactatgttcatctttaacatagattaagatttggtgtttcatatttttaattataataactttccttagacaattaaaatatttttataagcattacaacacatattcttcagttgtatgaaaaacattttaagtaaacaacttactttcctaaatatttttttttctatcagccgatccagtttaaatgccaaaatggaagagtgtgttaaactaaactgtgaacaaccttatgtgactacagcaataataagcatcccaacacctccagtaaccacaccagaaggagacgataggccagaatcccctgagtactcaggaggaaatattgtcagagtttctgctttgtaagacaattggaataaggtctaagagaattcgagccctggctgtgaaaagaatctcaacatagaagaaagaagaaacaataaatattctgcagattaatgcagcaaagaaagaaggttggtagtgaaacacaaagcttccaatcttaaggatgtgaataaaaccaccaaatggcatttctagacagtttgacctgttatacagagtaatattctgtggccctttgactttgtgaatgagcacaatgaaatgccgcctactgatgcttcttatgatcagaactcttttttaataaaataaataacataaatcgttgaacataatgttccagttgaatgcaaaacaaaaaaaatatggaaaacattttgataaaattttttcctgttaaaaccatgaacattggctatgatgaagattattacatatgaaaaaaaaactcacacaacatatttgtattgactgaaggaaaccatcataatgcatgctagaattctttgaagcagtgatctcagtttccttatgttgtcttcagaataggcatgataaactataattgtagaaaggggtaatttctgtgcacttacaacaagctgagtgttcatgttccatggtgggctgtgcaaataaactccttttagacctgcagtatttctcatggggatgctcattagtaaatctaaagtgttcagatagttcagtattcattatcgtttaactttgcacctagatactgttacaactgcaataatttgttgtacaactgttgtatcaggaatcaggatttttttgttgttgtactttccagatccttatagatacggtaagagccacattcgtagaaaaacttctggtgtggccaggttttaggtaactttttaatccaaaactattgtgccataaatgtttttcagtaatattttttggtccactgtattcctgtgacacagtgcattatctgttcttgtatttctatagcacctctctattgggtttatcatcatcaacaagactactgtttactgtagttcaagtgactttcctacttttgtatttccaaaaaaaattatcttgtaagtagcttgtcatcaatccccttgtcgaaaactagaaaaaaaggagttgacccatataaattatctctaacgtctttgttgtttatggaaaagcccagatactggatatatcactatgtattttatgaacagaattgactgggactaatatcacaggatcaatcatctcagaatcttacttgatgcattatttattttgctttagatcttgaatacattttgagaataactaatgtggattgaaatgtagagatacactggagtgctttatttagcaatatttgatgaaagcatgctttctacgccattcaggaaggcagcacaaatttatctcagaaaggttcctgtgtattgcaaggtacaattttctccaataaatcaggagaacaggagtttgatgatgcaaagttgatctctgtacatttaagtgaaaagtctttataacttttcacccttaaaatatttcagcagacatgtctgcacatgacagtgtaaaaaagtttaatgtcaaatgcaaagtttttattcattccaagccaccactgtaaggaataaagcttagcttctgtacatggaaagagctaataattatccctctgtcagagatgagatttttaaatgcttatgatatttaatcataaaaagggattaatccaaccattttctagtaaagccagaaattcttgcttcccatttctagaatagtttctagaacagtgctatgcacatattagatcttaataaacatttgctgagtgaaagtaagataaactcaactatctcttgggaagaactggcttcattcctagtacatcttttaaaaagttactaattttccagcagtacaaatattaacaattatattaacacctgcctcatgtcagtttatgcttctagagcaatgtctagtgaaacttatctgatggcatttattgaaaaccttctaaaaagtagactaaggaaaccataatcagaattactatgtcttttgattcccaatgagaagttctattttcatgttcttaatattacatacaagaaaatgcagttaggttatttcaattgacaattctgcctcctcttttgatttatcacttacccaaaattattaattttattaggcttttggaaaagaaaaaaaactttttgatgttttaggtgatttaaaaatataccgtgttggtggtgaatgactattgatgactgtgttaagtgcatctgtattgtaagtgaaatgtaattatttctgtgtaccatatggagtaactaaggtcattgtttttgacaattttgtttgaaattcatatatcttatttcaaaggatagcataatatctgcattatgctggaaaaaaatagacctttggagaatacttaaataaaacatgtgcatgcttgaacaggacaaaatgttgactgttgccctattttcttagatttcattcctttcccaaaattaggatatgccacactcataatacacatgttggaggaccttgtgagacatacaactcaaaggacacagcaattgaaagtaatgcttaaatctcatctgaatgggtggagacagtagcttttgctagtaatgggaattaaggcagggactttaacagaaaagatagtatcaattaaggaaagccagtccctgaaccttatatacttcttaaacaccactacttgcattaagcagagaagctcaggggtaatggttttggtcagaacttaaataaattcttaatcaaaggctttattctacctaggaaagcggggtgatttatttgcctagccatttgtgtgcatgtatgtgtatatgtagatataaatttgttcatacacatatacatagattttcattcatttttaatatgcaaccactaatggtttctcttaatatcttgaaagggctaaaaagcaagaaaatgttaagagtttatagaagaaggaaaaagacacaaaggaaattatttagtagaaagactgattttaactggtgatatatatggtcctcttggtggatagtctctatcttttcttgttaattattttcatttatagcctttgatttattaggtatcaatcttgcattaaaaagttcaatatgcctccctattccttcaacttagtcacaatgttggcttagaaatagcctcttgggagctataatgtgtctgccagtaacattgctcaaaagaataaaaaagggttcttgaaagtaaattgataactccttagagtttcataagaaaggcatcttctcttccctacagtgtcattaaggtgtttgttttattaactcactggtacaagaatggttattactctgcactgtgtaaacatctgaattttcaacacaattgtgtaggcacacagtatttttttaatgaaggtttaaattgtacctacgaaggtttaagtcttatctacttcagctggttgtattaggatactaaaatattctttacagagtttgattttttacttctaaggaattactagctttgaacagcaagtttgcttaagataattataaaatataattttacaaaatatttttagttgaaaataatattaaatacatagcatacctttaatctttctctttactgcctgccctgccttttttctcctttatcttcaagcattaattattattgtagcagatctttgcctttccctaattacttttttctctagcttttctatggaaatcctttaggttacataactaatattcattctacatataatccagtttattaaatacagatgatgggccagacatggtgatagagaaatacagattaagaaaccagatcaaatcctttttaaggaattatctagtggaaaatatctcaactctcttctttacactactattcattatcttacacttcaaatcttcacctttccattttgacagtcgctcttctacttcagtctcctgaagacatctctccaacagaagttacataaaaatactaatcttcaaggtgctttctaaaatattttcatcacgtcattaaaatcttctttcactaggcaatggttctgtctctatgggggctggcaggcagggcaaatgaattcctacctgcccagagaaagaacaggaaacaataaaggtaaaacaaaacccaaaggaagaagagcttcatgtttatgcattacattaaagttaaaaggaaataaactttctcaagtatccactctaccttttcaactataatttcagagaatgtgaagaaagctattaaaatagttttgcaggaggactgatacacaatgcgtctgtgaatctgaacaccacacctcaaattctattatctgatgaatcctattgaaatatctgagtaattgggacaacagaaaggtaagtctgtaatcaggggcactcaccaataaggcg

SEQ ID NO: 14199 - DNA, 140844 bp, Human
  misc_feature (1)...(140844): n = A,T,C or G
attgcttgagcccaggagtttgaggttgcaatgagctacgatcacaccactacactccagcctgggccacagagtgagaccctgtctcaaaaaaaaaaaaaaaaaaaagagtcccagcagagaacagcaagcacaaaggccctgaggcaggagtgcacctggtgtgtttgagaacccacagagacaccactgtggctggagcagggtgagatgtgggaagggagtggctaaggaagctgagaggtcaaggaagaagtgtggttggagcaggccctgcaggtgccgaaggcttttgcttctttcctgagatggcagccctcacgagccctggagcttccctggctgccatgagatcaggtggaagggggtcgaggctgcaagtggggacgcatgagtgggtgacaggtggcagtagtagaagtgtaagaagagctgggagtctgggtctcttctatcttgaaaatagaaccccaggctgtgctggtagagctggatgcagggtggaagaagggaaaatatttttgctgcttaaatcctagcctggcttcccattgctcgtggggtgcattctcgattcctcttccccgcctgaggtctgacatgtgctggccctggctggcctctcctgtaccttctaccaccagctccagctcatggcctgatgtggttcctcccccgaatccagcgaccaggctgccctctgccccagcgcctcctccgtggatgtctgctcttcctgaactgccctcccaccggacggctgctccttggtagcagctcaagtgtccttccttccctaagccagtttccccaaacactgcagcacaacgcccttcatttctcatggcattcttcatggcctgtcaatggggcttttgttgttttaattttccgtcttcttgtttttgttggtcttcctagaatataaaccccatgagggcagaggcgttcagcctgactccagcctggcaaagctgtcacaaatctggaggaacacacacgttcacgggcactcagttctgtgaggtactgcaagccctctctgaacctgcaaggtggccattgctgtccccactttacaaaggaggaaagagtgcgcggagaggttctacttagacccgccaagggcacagtcgttctagaaagtagcagactgggagttccaacttgggcttgctggttccggagccccttctgtgccccttccaggctgtgcctgggtgagattcttctcctaccagcacgtcttcttcctggagggttcagtggctgagctgacaccggtgggcaagaggccctggcgggcttgttgaaggactcaaaggtggcgtctgggagcctggcgggactttctccctgtcagcctagaggcacttttagaggagtgtgtctgtttcgcagtcttcgtgtctcataattcataactaaggtagagggtacacatttagtttacagtaaaacctcaaacccacctccactcccagccggccacttctctccctgttcccttctctgccctccacaggtgagaacaagtgtccggggccgccccgtggggccccaggctgcccgccctgaaactgcctcgctgtgtgcccttgggcaaccccgccctgctccgtgcctcagtttccccactcatagaggctccacaggtgacacacctggctccgggccccgatcggccgccgggccccgcggggcggaaaccccgcgccaagcctcccggaggcacctccagggcagggcggggagcgcggggaggggccgcggggacttgcgccgctggggccgcctggccgccggccggctccggggggcgcccgcgggagggcgcggccggtgcggggggcgcgggtggcggcggcggggggcggagacgcggcgcggcttccgctcccgcgcgcccagctccctcctccccgtcgtcctggtccgcggcgcccgaggggggaggcggaggcgccgggagccgcgcgaggagccgccgccgccgcgccatggagcccgagtgagcgcggcgcgggcccgtccggccgccggacaacatggaggcagcgccgcccgggccgccgtggccgctgctgctgctgctgctgctgctgctggcgctgtgcggctgcccggcccccgccgcgggtaggtgggcgcaggccggccgggggccgcgggttgctcggacaatggcccgggcggccccgcggccaagtgcgcgggcgccgccgccgtctcggaagcgacttggcgagttgggagcgagttggggcgcgcgcccgggatccccctgccgtccccggcgtccccgccacgcgcgggccctttgtctccccacccgggccctccccggggacgctgcgtcccgggctggcgaggagggcgcccgctccgccaggtgcggcgcgggcgggtcctcacctgcccgagcccgcgggaagccgggagccgagccgagcccgcgctgggcccgtgtggcccgggccgggcaccgagcggggacttggggcgcggaggcgggcctggcccggggagccggttcgcaagcctgtttccagcggccgcgcggccgccccgcgtgctccgaggacgggctgaagttgcagcgagaaagttctgagcccgggcgcggggcggcctggccggtggcgctgctcctgtgagccgcgtggctgtgggtttccaagcggactgacacctgccaggtgcccgggcgacccgaatgccccgtgtggccgccgggtccccagatagtgtccatccccgggtcggctacgcggaggtgacgtggtcccagatcgcggggcagtgggggaggcaggcttgtgcctcagttgtacactcccgtggggagaggtagggcgggggaactttctctccaacttttggtgtttcccagggggtggagttgaggtcaggaggactcaggaaacttaagcagtcgtgaaacgctacacatgttcttttaatttggagattgccatgtggtttttcaagcaagcctcttgctacctaaatcattctcttcggatgtgcgtgttttgtttttctggagtatggctggccaagtggcacggccgcaagtgcctgtgcacgccgcggctcctgttctgtttgtggcagtttagcggggaggacctcgggcccctttgtctgggcctccttaaggcaaacagctgtctccctgaatatttccagtgtgaatggtgcagcggggtggccctgtagtcagatcccccaggctgcagcctctgcttggaggtgtgggggacagcggggaacaggaggagcttggagtttgtttcacgtcctcctgcctctgacccaagcctagagattctatggacagtttcaccccaaatctgcctctttcaggagcgtgtttacattgtggggccttgtctggagctagcaaaacaaggtgaagacaaaacagcgacagtatctggggagtacaggccagcgccgctcctttttccggaaatgcctgggtcaaggaggcaaaaggggttttggggaaactgtttgttttaaagggggggtttctaggccgaccgcgttgcctttcacctcattgcagttttgggttttgtgcacgttttggggtgatgttgctggagtcaaatgcctgtcgtccatgtggttcgagcccctgaggagaaagaattatagctgtagagttcagttgtgtgtgaggcaaaaatagagttgattattttaacattaggcagcaaggcctgggagccccagtgaatgtggtgatccaggcctaaaatggaaggaaagggaggaatctttctgcagaacggttttgatgttatatccctggttttactgtgtgaaatacatgcctcggacctcagcgaagccagtaagtgggccgctaattatttttcctgattgcttcctgttgcaattggaagctgtgaacgcacggaaatggctttgttctagtggtcccagtgctgagaacttccccagctcccaagccctagtcctctctcctcggggcccaagtgcttgttccagggccggcctgtccaggcaccccctctccccctggaggttcctcctgtagatgcccaaggccaaggccgggccctctgggagagcccagaagggctgagtggggttaaccaagtgctgtgtggagcaccctgagagagtcccctccaaagcagggccccgtgtgtttagctcccctcttcagttccaagaaattcgccggtgaacccgatccagcatttgttcagcactttcctggggagattcacttcgtgcttcctgtcgtttttggaacccgtttaatttcagccgtgctgtgtcactgctcaggcatttagtagaactcacacacacgggtgggggatgtaggcaggtgaggcctctgagttgctttctcccttgcagcgacgggttgcagggctgatgggggtggaggggtttggggtcagacccacctgggtttacatgctcagtggctgtttgacttcgggcaccatacctagtttctgttatctcaccccgttcctctcccaggctatggggagccctaactgccctgtgtgagacctttagccccatccctggcagagctgcagtgagcgcagttgtgtgtcagcgtcctcgatctttctggccccagccggtctagaggctgttattacaatagtctggatttttcctgtatgaccttggacatccagtccactgacaaactcactcactcaccgctgcagccctcgggggcaggagtagttagttagcactgtggacagagcccctgcgcccagggtctgattccagcctggccgcttcctgtgctgggaggcttaggaagctgatgctacctttgtgtgcctcagttttctcacctgtaaaatgggaatagaatccttcctaccatgaattcagtgagttaacgtgcacctggcccggtataatgctgttgctgttttgctttggtgtctgctaccgagtgaagtgctagggttgagtgcgatagaatggcagataaggccccgcccctgcgggcagagcttcccatgtagaggggaggacagggaaagaagctttgcagctatgcagaggtgggcccacgggtgctccttcaccctcggggtgtcctgcgagaggcccttagaggccagatcatgctgtggagtctggttgtgatccacaaggcagcggaagcttctggaaggctttaggcaggagttacaggaaatgcaagctaaagccagatctttcctaggtgaaaggtgtcgagttgttttttttttaaattgaggtgaaacttatataatataaaatattaaagtatagaaggcaggcatttggtacattcacagtgtttacaaccctctcttctatcaagttataagagatttccatcaccccaaaataaaacccatacccattacacggtgacttcccgttccctctccccggatcccctggtgaacaccagtcgactttctgcctctgtggttctgcctgttctgggcattttgcatgaagggaatcttacaatgcgtcttcgtggctgacttccttggttactgtaacgttttcaggagtcatccaagtagtaccacgtatgggtgtttcagccttttattttttttttgaaatggagtcttgctctgttgcccaggttggagtgcggtggtgcgatcttggctcactgcaacttctgcctcctgggtttaagtgattctcctgcctcaggctcccaagtagcttgcattacaggtgcccgccaccacgcccagctaatttttgtatttttagtagagacgggatttcaccatgttggccaggctggtcttgaactcctgacctcaagtgagctgccggcctcggcctcccaaagtgctgggattacaggtgtgagccatcacgcccggcctatttcagccctttttgtggctgaataatattccattgtgtggagggaccacattatatttgtcagttcatccgctgattggattgatcttggttggttgcatctcccagccggcacgagcaggtctcatgcctcctgcatcctggtggaggtggctggtgggaggatctggcctgagactctcctgccgaggttcaggaacgagccaggtgatggggacaagttggggagtcagtgctggcatctcagaggaggggcctgggccctgagaggagtgctgggagggcagagtgagggccaagttcaggttacagaagccgtgagacagccggacatctgtggtttgtgaggctttggaaacacttaatgcgctctccaaatggggagtctgttggggaggccctggcgggagccggggctacatccaggtcctcggcttggtggccttgttcacttatttgttcaggaagcagcagggtgtgggctctgtgccaggccgccctggagggctgtcctggggccagtgaggtccaagtgtgatgggcggaggcagctgtggcttgctacgagccggcctcagggacccaccggctggctccggctgctctctgcattctcttcagctctggagagccgtgtgccagccctcagcctcagtttcctcatctgcaaaatcgggacgatggtgtccaccttgcccatgctggtggggtcccaagagctggtgtctggggtgagggagctgggggccaaaagctcctgccctggggcatccagctgtcctttgaagagtaccccgagggtgtgactgagagccagtccccagcacccttgtccagatggggaccaggaggtgggtgaagatatttggggtctgagctctgtgctggttgcccccgagggggcctggagccctgagttacgagcagaacggggtgctggtcctatccgttccctacctgggtagtgggggctgccttcctgggttgggggtggggggagctccctgtgtccctaagccatgcagaggcatgcgcatacgcgctgctcttaggcatgtgggtggcgctctgaggtccctgcccattccccagccccatgtggtggtccctgtgctccaggtccagcctctggtttccagtttgtcctagtttgtcaccttgtagggggcagttgacactttgctggcctgactcgtggtgtgccagagcccgtggctgctgggcgactgtgcctctttctctcagtggcaagagccttattttctaatagagcctgatgggccagaggttccgccacagggacactgttctctgtctctcgtgcttggggtctcttgctgtggaccccctgggaggttgtcctgggggtgcggggattgtgttttctgggtattttcttatttgctctattggagtgtatttaatttaatatatatattttaaacatcttttagtttgccttaatgtaattttttttgagatttaatttttttttttttgagatggagtcttgctctgtcgcccaggctggagtgcagcggtgtgatctcagctcactgcaagctccacctcccagggtcacgcctttctcctgcctcagcctcctgagtagctggaactacaggcacccgccaccacgcccggctaattttttgcatttttagtagagacggggtttcaccgtgttagccaggatggtctccatctcctgatcctcccgctcggcctcccaaggtgctgggattacaggcgtgagccaccacacccggcctgcttttttttttttttttgagtcttgctctgttgctgaggctggagtgcagtgattcagtcaccgcttactgcagcctctacctcctgggctgaagcaatcctctcacctcagcccgcaagtagttgggacctcaggtgtgcaccaccacgcccagctgattttgttgttttttgtagagacagggtttcactatgttgcccaggctggtcttgaactcctgggctcaagcgatccacccacctcagcctcccaaagtgctgggattacagacatgagccactgcgctgggccttaatgtagtttttcttgtggttaaactgaggtgaaggttcactcaaggaggaaagtggtttttagccttttgaggggctcaaggaccccttcaaggatatgacaacggctcctctcctgagaaggtgcctggtgggggcggcacaggctccactccaccccattgcaagaatccagggccctgcagggctcagagccctctccctgcctccctgtggggcattgagaggcactcaccttctgagggcctcagtttcctttttttgtaaaatagaaccagctgattccaatctctatggtctcttctagcacggagcttcacgttttttctcccttcaggatcctgaggcctctggatcgctagagattgggggtgcccccagaagaggcgctgcttctgtgccctccctcaccccaccgtgcctggctccttgttttttttttttttttttttttgagacaggagtctcactcacgcccaggatggagtgcggtggcacgatctcggctcactgtaacttctgccaccctggttcaagcgattcttgtgcctcagtagctgggactacaggcatctgccaccatgcccagctaatttttgtatttttagtagagacagggttttgccacgttggccaggctggtctcgaactcctgacctcaagtgatctgcctgcctcggcctcccaaagtgctgggattacaggcgtgagccaccatgcccagcctgcctggctgattttttaaaatttgtcgttgagatgggtgtcttgctttgctgcccaggctggccttgaactcctgggatcaagcgatcctcccacctcagcctcccaaagtgttgggattacaggcatgagccgctgtgcccagcctattttattattattattatttaattttattttttctcactattgcccagctcctggcctccaactcctgggctcaaaggatcttcctgcctcagcctcctgagtagctgggactgcaggcatgtgccatcacaccctactttgtacttttgcttttctgtctttgctcttgttaaaagccaagtgccatttcatagtacacaggtgcacttgacagcatttacctgattgaggagtttttccagccttcattgctattacaaagcatgcttgctcgtgtgtctctgcatgtgtataagtgtttttataggatacattcctagtcaaagagtgtgtccatttctgtttttaaagatattgaggccgggcacagtggctcatccaggtaatcccagcactttgggaggttgaggcaggaggatcacttgagtccaggagttcgagaccagcctgggcaaaattgggagaccccccatgtctacaaaaaatttaaaaaattagctgagtatgattgcacactcctgtagtctcagctacttgaaaggctgaggtgggaaaatctattgagctcaggaggtcaaggctgcagtaagccatgatcacagcactgcaacagatctagcctgggcaacagagcgagaccctgtctcaaatacatacatacaagcatacatacatacataactcctaaaaggctgtagcagttcatacctgcaagcatctacgagaacacacactttcctatatcctctctgatgctggcaattacaagattttggtttttggtgttttctttggtccagtttggttaaaaattataacaccttttgatttgcacaaccctcatttctggtttattggtatttacttttctgcaaattgcctacacttatccttggcccatttttctgttgtctttttcttttcttttttcttcttcttcttttttttttttttttgagacagagtctcgctgtgtcctccaggctggagtgcagtggcgcgattgccatcttggttcactgcaacctctgcctcccgggttccagctgttctcctggctcagcctcccaagtagctgggactacaggcatgcgccaccacgcctggctaatttttgtatttttggtagagacagggtttcaccatgttggccaggctggtctcgaactcctgacctcaagtgacctacccatctccgcctcccaaagtgctgggattacagacataagccacggtgccagcctgtttatctttttcttatagatttgtgggaggtctttatttggtatggactttaattctttgttctgtttgtttcaggtttcactgctggtctgtagctagtccttcatccttgtttctggtggtacattatcataaagatattaagaagcttcatataatcataactctactttttccctatggcttttttcctatcccttgttactccatctccagattataaatatatcctccattattttcttccaggactgttactgttttatgttttacattcagacattattctgtctgggttttttttttttttttttttttgtatatggtatgaggtaggggtctggccagtgaatagggagttgtccaacaccttggtgggatggtccatcctatccattcattgtaaatgctgctcttttatgtgtagtgtccacagacacctgggtcctgattccagacccttcactgtgctccactgcctgtgagtgtctttgtgtaccggaatgctgctgtctccatctctgaagcatcagaacatattttaagatcagttatgtaaattcccacctcattgtccttttcaaaagacgtattggctctgcttgcacgtttatgcttttgtggtgaacttcagagccgtcctatcaggttccaccctttgatctcttgatctggggacggtaaatggtgatatccagcaggtgtcagagggctggattttaaatggcctccgatgagctggcggtctcaggctgtggaagtgaattcatctgctgggtgcagtggagccggccttgacatttgtgggttttgctgacatttgtggaaggctctggaggtgccctttgtgccgacttgcccgagccactcctgctgcccaactcactccggtgtctgctcaggaaagaaattctaatgcacactaattttagcattagcccgatggcaaatataattactgagttaattatcactcccctccctagttaatcccagagcaaaatgtgggcacctttcatttcttccttgggatgtacccctgtattagttcagatggggaggcggtacctgcctggcaaagctctcaggaaattgctcaacggggcattaatagctatctgagcgtgtggcctgggctggaacacaccagcctgggtgctgggtgccttccaggctctggccaccttgggttctgccccaggaaggagcagactgtctcctctaggggacctgaagcttaacgtcctcactgtacgagatagttttggagcaagatatgttctggggcttgcttctgcgggtaaaggccatttctccaaactttcccccagagcgaacttgcttcccaaaaggagtctggatccgggcgtggccgtgctgccctggccgcctcctcacttcagctggagcctccgagctgacgtccatgcctattcctcctgagcactgtagacacaggccccagctctgtcccctgccctctcctccactcagactccctgggctctgaggctttacctacaggccctgcggtgcatattcagtgaaagcctagattcagagccaatgacatcagcttttacttggtctccttgctttctggaacctcccctttgcccatttatcttatgctctggccagattaatttttctccaagtagttttcatcacatccttccctttctcagacagtcgtgcccattctccagcatctgaagttggaactttttggcctggcaggccgtgccgccctgagcagacctgcccatcttctgcccctggtgtgggcacttctcttgccagatctgtctggaaccttccatggtccacccaacctgggagggccttgaggacaggggctgtcttcgtctgcgcccctctgcctctagtgtgatgtctggtagatgatcagtaactgttctgaggccaaggcctcatctgtccagggagcagatcttacccatcttttacctcctctggctcgaattctgctggagcatgagctccctctagcctaggttgtagaacacctgtctggctatgtgacagcttctgggccaagtgtgaggacccccatggtcctgcagtaagagcccatatttctggggtgtgggaaacccagtgtaccccaaagggacttgactgtgaagtcccgggtccacgtggtacccaccagcctcctagggcccagactccgtgagatgccacggtgggggcttgggcatttgcagccttcacttggcattcttaccattttcaggaaactttatataaacatttttaatcatgcaaaaaaggaattatggaataataaatgtttatattaaaaagtcttggtggttttgattgatttatttattttttgagatggagtctcgttctgtctcccaggcttgagtgcagtagcacagtcttggctcactgcaacctctgcctcctgggttcaagcagttctcctgcctcagcttcctgagtagctgggattacaggcacccgccaccacgcctgggtaatttttgtatttttagtggagatggagtttcaccatgttggctgggctggtctcgaacttctgactcaggtgatccacttgcctcagcctccctgagtgctgggattacaggtgtgagccaccaagcctggcttggtgctttttaaatttattttgagatagagtctgactctgttacccaggctggagtgcagtggtgccatcacagcctactgcagcctctacctcccctgggttcatgtggttctcccgcctcagcctcctgagtagctgggactacaggcacacaccaccaggcccaggtaattttttaaaacactttttttgtagaaatggggtccctccatgttgcccaggttcatttggaactcctgggcttaagtgatcctcttgcctcagcttcccaaagtactgggattataggcgtgagccaccgcgcctggctactttggtacttttgagttaaaactatagagtaggtgactgagtgatatttttaatgcgttctcaagaatttgaacacgaagagagtgtcaccctcccaggttatgcccccgggagttcatgcacttgccacctggtcgctgctcagggggcccagggagtttgctgcagtgccggaggactcctgggtcccggctgtgcctccccgcagccgcctgctcccttgggacactcattcatttgctgtggccactgccacccacagtccttgcctcgtagactccactgcagctctggttacaaagagcgagtggtcagggactcctgacctgccatgcagggccccgtgggcttgtggtggctttggtgccgtccgctgcgtctgcctcttagagcatggagttctccttctcaggagggctgagctgctggagctctagtcctgccgcagagcagcccccaagtgcggcgttgcctgtccctgtggagcaggtgactacctggctgcgggcggaacagcaggccatggctctggtagtggtctgtgacagcatatcaccctgtgggacagatccccgggacctagtggggtgggatagtgagagctgcgtccacaggggaggctcagagacttgtgtgcccagtgtggccctgtgtgctgacccagctgggctctgccctgtgtggcccccagggtgcccggcgtgtgccctgatggcctggggcagagctccagagagccacggctggccgagggctcacggattctcacccgcccccagtgcctcaggagacacctgggcagcgaacagcttgaggtgtgcagaggatgggtcacgatgggagggaggcacaaggggtgctttccatctctttggccaccagttttaattaaaaaaaaatttccatctgttttgaaaggttttatcctcttaaggaaatgacgtttattaagcaacagccccttctgctcatcgtccagctgtgcccactggcagagcagaggctggtgggattccgcctgctccacaccaggaggtgccacttggcttcccagtgtcgaaggccttcttggactcagcacaccttcacggccccgtgggctgtgggtccctgggttgggcatgactgacttggagggtgatgagagatctccaggatccaggcaggtctggcacgccactgggtgctaggcgctgggctctgggcggcctccttgctgtgcttttctctgagggttgagggagccctgctcagagaccaccaggtgagctctgggggtccctctgggctcctgtgccctgcacagcccggttctgaccacagacctcctccatcagggtggactatagcccagagcgggataccaccacgcccatcaccccccacccctggagcccctgaccaaggcccttctgggtacttaaccagtgatctgatctcaccacagtcagggattagggcctctcccggagggctggggtccaatggtatgatgtgtttcaggtgagaaacaggttcagggatgtccccagcctcactggctgttgttggcagagcaggatgaaaggcagacgggaatgcagaattgggatcttgccctgacccctgtgatccgtgaggcccttgagctagagggatgcactcagtcgaagtgcccgcctcttgctttgtgttagtgtgaagaggaggggtgggccctgttctattcttggctgcccacagcacctaaggccagcttggtcaccaaggcatgctggaaggtcaccacaggtggcacaggtggcttggggtgtgctgggcagcaaccattatgcagcagtggcctccaagcagaagctgctgtttcggacacccgaggtattcccagcctccttcccctaccccgaggtttgctggagtcactgagggggcagtagcgagctgcaggtgcagggtcggggtcctgggggttgcgtgtatgcgcagcctccagagaagcccatgcaggcccccctcacccgttcctgcctgacctgctgttgtgtcctgctcctagctctgcggtctgggacaagcacgttaactgcttcagagctcagtttccccatccgtgatagggaatgatctttatgctcccacaggctcgtcctgaggctgcagagaggcagcgttgaaaagtacctagctcagggcctggctcagtgacggttagctgttagggttaccatcgcatcgcaattgttactccatagtgacgaccccccggggactctggacttgttcagctcagctgagaggctgcttggccgaaaccatctcagctctgcatagtgtggcctggtggcctgtgggttgcgctcatgacaacgtggagcctattcagtcggtaccgagtgtgcgtccttgcctagctggcctcggcatttattttgtagctggagccctggtgggatggggtcaggtgggctctaggagtctgggggacaggtgcaggtaccttcgggtgcgcctcccctgggggcctctgctttgtcagaagtatggcagggggctgagggctgactatctatttgtaggtgtcaccagagcagtccccgcctctccttttcagaggacattgttgaggggaccctgccatctgcgtctgggctggctgcttcctctgtggggggctcctcccggctgaccagcagccctttctggccccctgcatcagcgcctccccactcagcttcactgctgaaggcagggccagcctgggcaccaggttcttccccctctgcccaaggtccctgcccacccgtcttccctcgccctggccgtgacggtcagtgcctttgccccgctctgacgaccaggccctgtgcgcagttggcgctccgtggttgctgagagatgtgctctccagtctgtgggccagatggggcctctgaagtggagggggcccaccctctctcctgcagcctgctgtggctccccatcgcctctgggatgagagcagaccctgcgaagccttgagctcctggccctccagctgtgagcccaggtgggaccacccagttacaagagcgttaggcctggctgtgtaggagacgtgtgtctccacaccagagtccttgcggcacatgggaagccttcatggtcctcatggtggggaggggtccccggggaggcatggagtctcgctcctaggttgctgtgtggcttcagcgctctgtacctccatgcccctgtcctgcagatgtcaacacccagttgaggagaacgtggactttgcccagtgttgtgcagggatggtggggccaggctggagcccacgtgtcctgccttcgccctggccaaggtgggggttatctgccctggccaagctgtgccgcccgtccctgcccgccccagcaggtgggggcctgcggtgggatcccacccatgagcagtagaggcttgttgacttactggcctcccaggctccccctccaaagccaagtcctccaggacggttcttgcccctgagaaggggcagtgtgggtgctgggctgcagcgagcccctcttcgttccatttcctcacagtcttggggacggagggcttgtcctggagcacaggaccgggattgtgctgaggtcctgggaggccacggtcatgaggggacccagtgaaggccaggaggggacaagcatccctccaggtatggggagggtcaccccagcgcctctgcggatctgacccactggctgcggctcctgtgcttgacccttttggcaaagatatgcagtggtctttcagttgcccccccttaggcagcatgaaaacaatttaactcttgcagaaagaacctgggaattgatctcccctgtcactgatcccacaagtgtgactttgcattggtttcttggtccccttgtgcccagtctccccatctgtaaaatggggtgacagtagttccacctcctatgaggactgagtgaagtcaggaaccagaagcagctcccacatgagactcagaaagtgtgacaggcgtggagggtagggacccatgaagctaggcccggcaccttaggaagaagagggagctttcctgcaggtttcccccggacggaatgtgtttcgtcctgtgcacctgcctgcagagcccctcgcacgctgtcagtccacaatgaatgcttggtggaagagttcacccagggcctgcaacaccatagtgctcagcttctccaaattcttcttaacttccagactcgacacgtaaacttgattccaaggaaatcaaagctgatcgtcaacactggactttgcaggcagctcccaaacccacatgcatatttacaactaagaaatgccagttcctcaaagaatgttagcctctgagatgcatcaggagaccaggaggcaaggggttaaaggcaaaccgtggcattccccaaatctgtccagttccctggcatggtacagtgtcgcggagcccgaggtggcatcttttgtttggctgctgatggcggccttcgggccttggcatccacgttgctgcaattttccaggaacagtaatcatttgaaagtagagctgccacgttttgctcaataaagggattttgtagagcgatgataaatttggcatgtctttattattattattttttcaacacttaaagaaaataaaagctggtacaaaggtatgtttgtttctgaaatgtgtttccttccccagatgttcttttctgccagttctaaaatgcgttctgagctcggtcctccagtttcctccctgtgaggaagaacaatgagacctttgtaaccacacaggggaaacggccgcttccctctgcagtgggcatgggggaggggctgggacgtcccacctcctcccacctcgatggaaaccacgagtctgtgccagcccagccgactgtcggggggtttggcagcctcctttcccatggtggtaatttgcagggtcatggctcaggggcaccgcagtctgcacctccgtccctggatccgtgcgtttgctgtgtggcctcgcagtaaatgcttccatctgcgtggcatttatggaccctggggcttggtactgtctgtgttatctggagtcgaacttgcccttttccttttctgtctgcctttcttgcatcaaatgctggtccccacccaaagggtagcccagtctgcaggacacggcgcagaggtagagttggtggcttcacgagggtccagtggggcacagaccttcctcggctgctctgtcgctttgtgacttgagactgcgtgggtggggtacctgagggatccgtgagcccgcccttcccacacgtgtgcatgcacacacacatgtgcacagtgcttcagaagtaccaccttagttggatttgaaggacagccaagagacctgtataaagcttgtagttagagtcgtttcgatactggcctgaattaagagcagtctccatggggttgctgtctgtggggtacgtgtttaatgaaaatccttgtttttaaataaatgtatcctgctttagaacacccaagatataaaatctagacttcatagacaaaaatagctaacatttgttgtgtatcacagtgtgccaggtgggctctaagagatgtttgatttctttaatccttccagctgccctgtgggctgggggccatccctaccctcattttacagacgaagaaactgaggctgggagaggtcaattaacttgctcaaatttggtataggcaaaactaggaattggcagacggtggttccagtgcctgccttttaattggtacttgaattatacgagtgttttcttccatcaataaaagaaatcggcgaacagcctcccatgggtttcagtaagtgcaagccctccttgtcatcccagacctcagcctgcccatttaatggatgaagacactgaggcctggagggaacagtgacttcggagccactctcctggactctgccactcctctcgcctcccatatgaacctgagtggccacatgaccctgggggagagctactcaactgtcccaaggagagggtgatgactgctggcctcccaccggccatcagcgccccactgactgacacccctgagtcagtctccaccctggaactgtttctctcactatttgccatggccttgggccgcttccgggggcttggcaaggcaggaggcgtggaaccaagatggtatgtaatcagaatgctatattttgttgaaaataagaatgttagtaatgggctggtttctggcaggtcaaactgggactctgaaatacatatttttctctgctctgccctaaaccttctaattagtgaaaacgcacatttgcagacatcaatcaaatgtcatattccctagcagcttgtcctgggatcactgagctggtcacattccacagttgctaactcagggcttgcagagtatgtgtgcacgtgtgtgtgcatgcgtgtgtttgtgagagagatacatgccttctggggagccctggtggcctgtttccttccctcccaggcccctgagcttctgctccccaccccgcccccagccccttgtcagcacatgcgcggccactgcaatgagatacagacgttcgcccaattaaaacacagttagtggaggacacatggctttcagggaaaactgctttctctcaggaagatctctgctgtgcagtattccatagctagaccccagctccactcaacagtggactccattaatagcctgggttttggaagaggcgatttgcttctggtaactggctccggtgcatggatgttccctcctcttgctggaatctctgcccgacccagacagtgcttgtgaaccagccctggtgggctccatggggttctgggtctgggaggcaaggacttgcctggggtcattctcattctgcacggcactagccatgctggctgcatgaagccgtatcacagagacctgtgggtcctttacatctgatcatcctgtcatttgtatctgtatctggggtggttagttgcaaacaattccacagtagccaaatcaagaaagtcactggctctcgcaggagcgcgattggtgtggggcgagcctgggggtgtagcccaggcaagcccttcaccctgatgcgcattagccttcttatccaggaaatggggggaggcggtctgggcccagggaggggagcatgccaagctggggatctccaccggtccaggattcagggcgcctctgaccgttctctgcccagtgcctcctgttcagttttacttttgtgttttccatttcacttctgcctctaggccagtgtttttcaaaatatgtttcctgagtggaaatgaaaaaatgttctgtgatcaggcgcagttgggaaatcctaggggagagaaagtgaactaggcttcctcaccgcaggacttctcagagcctttaaaatggtaattatgctccaggccttgtgcccctctacctaggcatcctttactggttgggaagagacggcaggttacgggtgagtccgggtaagtggagttgtgcctaagctgataacctgacgtcaccaacactgttctgtcaccttgctttggtgtggcttcttcacagttgtcacatctgggccgtttggagtgacctagcaagtcctttgcttgtctcccaggactttccggagtagccaagcagagccttcggccagttcccttgtggggccaggccctgcccgggagcacaggcaggagaacagctgcctccccgcctgccccagggccttggtgtcagggccatagcccccagctctgcggtggagcagcagggacctgcctggcccatctccctgttgagggaagacccggaggcgcctgtcctgttctgtgtgctccgaggtgtctgaaaccagctacctcattttctttttatcttttgcaagtgatttcttatttcctgctccacccccaaacgtgccccctgtatgtttcctgttcgcctgcttccctgacctttgaaatgtggtccctgctcgggaaacttgcctggacctcagtcaattatggttttcctctgggctgtgtgtgtgtgtgtgtgtgtgtgtgtttgagtgtgcaagtgtgtgcattaggattagagagaattcgatggggggccaggggccaacaggaatgggggtggctgagctgagaggccaagggcaggttccaggttgcattgagagccgaagctggtgagtgtgaggcgggcagatgtgaggtgtgtgtggggagtggggtgctgtctgggtgactgggctgggagagggcaggtgggggccaagctggaagaggtggtgttattctgtagcacctgatgtacacagaccttgggggtgcagctccaggctttctctctccccacccgcccctgaaggccccactctcccgccttctgcagccagccttccttttgtctgcccctgagctcctccgctcttgtggtcgttaagaaaagctttttataatccaagttggtttgggaagaggcaaactgtcctttcccaacagtcatatgccaaccctggccacatctattctggatttgaagcaaaatatggtatttattcattattgtcatgcaaatgtcagcagctcgctcattcttgatggagacagcacctggaatgggagggatgggtccacggccagcattggaggtgctcggccccagcacccgggccttgctctgcaggcagccctgctctgcaccgggccctgctctgcaccaggttccactgggtggcatcagccatgcctgccctgaggaggtgaagtgcgggctctctccagtgaaggtgcagaggcagggtgagctggcgggcttacggaggacgtgggcttcacctgggtccaggaggccaggtcacattcagccaagtattcatcagctgggtgtagagaccagggagggtttttaggggtgggaatggctggaggcatggaggtggtcagggtggagtctacgggagacttggtctactctggtgcggtgggattcatgtagagagagcccttgtgggctgaggccaggctgtggggtagatgggagagacctcctggcttagcaggtccttgggtggatggatggacggatggagggatgttgggggaattggtgggatatagatggttcagccaaggtggaaatgggggagtagagctattcctggggtgcttgaagatgtcagcaagtatcccactccagcttgagtttgcagagctttctctaaaaggcagaacatgtgcttggttaaaggaaacccaagattttattattgttgtaaatgtcaagtccctcattttgaatctttagacaactgcagaattgtgtcactgacttgggtaaaagcccaaggaaaaacatgaaattatgttgccaaaattgcggtcatcgtagctgcatgagggtttgagtggccaccgccaccccagtaggagagacgcgtagatgttgaatacactgtgagctgcgtgcaggtaattgaaacgtggatgtggggaaggtccctggcttcatggaactgtctacataaaagcgagcctgggtgtttcctgtttcttctaccttaagaaatttccacgagaagctaaggtatggttttgccaagaatgttgttaatggcccagcaatgaatattttcagccacttgtagacacctgaacttcattcttggcaaacaggtgtatgattcttggacttggagagactgaactttgctgtgctcagaatggaggagaccagctcacttgtactttgatttctccctggtccctgtcattttagcctgatcagtgctttttcaagcatttccccttgaaggggagataggactttctggctcagggatggggaggcttccaggcagccttaaacattgtccctgccccaccctaagtatctttgaagtttcatgttttatcataaagtctgtgagaatgttgcagactccgttatagtcatgctagttttatttttttaaatgtggtttgaattttatataaagtatatggattatatctgagaactaatatgcaaggcctgtatgcaaaacataatacaactttacagaaggacattggagaggactgcagtagatgttcacggataggaagacaggagatggagatggcagttgcccccagattgatcagtggattcagtgcaggggccggcagtgcgctctcctccctgttctttcctcccaccccattgcacaaatgttggtgcctggcatttaaagaagcagaccaggcgcggtggctcacacctgtaatcccagcactttgagaggccaaggtggatcacttgaggtcaggagttcgagaccagcctggccaacatggtgaaaccccatctctactaaaaatacaaaaattagctgggcgtggtggtgggcacctgtaatcccagctatttgagaagctgaggcaggagaatcacttgaacccaggaggcggacgttgcagtgagcctggatcgtgccactgcactccagcctgggcaacagagtaagactccatctcaaacaaataaataagaaataaagaagcagcatgtcgagggtggtgctatgtagaggtgtcgggggtgattggcatccagcatccggaagcaaggtggggtagggtgcagaggtgactgacagcagaggctactggagcagatgggaagctggttatggagctaataagtaaattgattgagcaaataagtaaacatatggatagtaacacaagccaggctttgcactttggagaaggtgcttacaaacttggacgagacagtacccagacacatagctgaaactgtaggtactgccacgcacacatgcacagaaatagagaaatagtcatagatgcatgtgtgtataaaagtgtatgtaggctaggcacggcagctcatgcctgtaattccagcactttgggaggctgaggtgggtggatcacttgaggttaggagtttgagaccagcgtggccaatgtggcgaaactccgtctctactaaaaatacagaaattagccggttgtgggggcacacctgtaatcccagctacttgggaggctgagaatcacttgaacctgggaggcggaggttgcagtgagtcgagatcacgccattttactccagcctgggtgacagagtgagactctgtctcaaaaaataaaataaaataaaataaaagtgtgagtatacatacacacgtacagttggttcttgttattcttgaaagttatgctccataaagtcactgggaaccctgaattattgaatactgaaccattgctcctaggggaaacatcgggctaggttcctgtgagcctcaggtcacaacgtttttgccaactgttcgatacctgacctggcttttttttttttttttttaagacagcgtcttgctgtgtcaccccaggctggaatgcagtggtacaatcatgggtcactgcagccttgacctcctgggctcaggccattttcctgcctcagcctctccagtagctgggactataggcatgcaccaccacacctgtctgatttaaaaaaatatacagatgaggtcttgccatgttgcccaggctagtctcaaacttctggcctcaagtgaacctcccaccttggcctcccaaagtgttgggattacaggcatgagccaccgcactcagcccataaccttgtcttatgtgtgtttctaagacaccttatttaggctgagtgcagtagctcacgcctgtaatcccaacagtttgggaggctgaggtgggaggatcacttgagcccaggaggttgaggcggcagtgagccaaggtcacaccactggactctaaagcctgggtgacagagtgagaccctgtctctaaaaagcaccttatttactgtatattgttgattcattaacattgaattcatggccaactacgctataactcatacctgaataaagcctctcatgcatattctctctgtaaggcgtggggcagcctcatgcacctaggagcactacacagcagcatatgtgcaggggacattttatacagcaaaattgcccacaaaaagcacagtgatgtggaaagcatggcactagctagaccgagagaaggacacttgcttacatctcgacagccggagcaagaagatggggcgttgtggcctcagttgacctcagtttggaacgtgtgatggtgactcagttttttcacactctgcaagtcagtgagtgattgcagaagtgctgtgaggtttaatttgggggatataaataaatgttagcaagtaggcgagctcaagtacggaatctgggaagagggaagactgtacgtgtatatcctacctccatcagcagagaggcctagaagcaatgaccccaagtagcagtgagcacaccagagcccaggtctgggtttctgaataccattctccacccaaaggagtcagagcttgtccacgaagaagctggttctagggctggggcaaggaaaggtacaagccgagcatggggcatcttattgtgtaagaaagcaaagaagttctggaggactggtggggacctctgggacagaagagccagcttagaggggtgctcactgtccaaatctaggaatatttgaacgtcaaaatgttgtgtacatgccttagcgaccaacccacatttaaaacaaattcctgaatgagggctgtaactgtagtcccaagtcattcttttttgtagctcataatagcccataatattactataccatatgtttgcatttacctatttttattttattttatttttttgagacagagttttgcttttgtcacccaggctggagtgcaatggtacaatctcagctcatggcaacctctgcctcccggtttcaagctattttcctgcctcagcctcctgagaagctgggattacaggcatgcaccaccacatctggctaatttttgtatttttaatagagacagagtttcaccgtgttggcgagactggtctcgaacccctgacctcaggtgatctgcctgccttggcctcccaaagtgctgagattacagtcgtgagccaccgtgcccggcctgcatttacctgtttttaattgtggtaaaatacatataacacttatcgtcgtaaccatttgtaagtgtgaagttcagtggcattaagaacattcatgttgctggtaaccactgccaccatccatctcccaccacaatttaataaatcattgaaaacagactttcttgaccacaaacaatggtgcagcagaagcatcatagatctctgtctgtcctgctggctgagctgtggcatccttccttttttatattgtaaaaactgtaaataaaatgccataaaaacgccagcgttgatctttgtggaacttgcggagctgactgtagaatgtgttgggggtataacaggaccagggcagcccaggtgtttctgaaggagacgaatcgggagggactcgctccgccaggcatcagggcagattgcaaagccttgtttttgcacatcatgccgatgcggggtggacagttagaccaagaggagcccggaagcagacccaggctttggcatcaggagctttggcatctggcagaactcctgtccctggggttggggtgtgaggaggtgtgcagggtagtagcgtgaataactgctttgaggagctgaagctagaaggtgcccagagctgtgttaggtgtcagagaagttgtttgtgaggcattgtgagtagaattaagtaacttgagtgcgtaattgcctctggggatcaggcctgggcatgctcaacattcaccaagtcatgtttgtttttcaatgctccagctcttcctcctccaggaagcctgcccagtctacccacagccaggtctacccacagtcagcccttcctcttcttagaagcctgcccactctaaccgcagccagatcttcctctgtctaggaagcctgcctggttcacccacagccgtgtcttcttcctctaggaagcctgcctggtccacccatagtcaggtctacctcctccaagaagcctgcctgatccacccacagccagatcttcctcctccaagaagcctgcctggtccaccaacagccaggtgtacccatagtcagctcttcctcctctcggaaacctgccaactccacccacagccagatcttccccatctagaaagcctgcctaccccacctacagccaggtcttcttcctccaggaagcctgcctgggccacctgcagtcagcttatccatccccaggctccaggcattacctgtccatgcattcatcccaccttttcttcttgggtggttttgtgtgtgcgtgtgtgtgtgtatgtgtgtatatcctgcccaactaacctgcaggctccttgactctggagccctgatgtcttctgtttctctgtctcttccatcatgctggcactggacgcaggatcattcctgactgattaatctctagcttgtgtccaggctgcagcttgctccgatgagcagttggaggcctagtgtaatgcttggtgaatatatataaggcatggactgaaaatgttgcttattttggtatagtagcaaaggattgggttaccttgaattgagtcttgtttggtgtaaccatgtaaataaacagtgtaaaatataggctattggaatggaagcccagacatctgttatgaattctatatataaatattggatatgcttacatgggttaaaatgagattgttggcacttgggttttcaaactcctgattctgctccgggtaggactgatcacgggtcctgggactcaaggcaggaggggccacgagctggcctttctctgacactgacttgccagaagtgggcgttcctgggagtggcagacatgcacccactagagatagatctgaatcaccccctcacattctcctaatagtgccaagaacccacagcagagtgcggggtgtactgagtttgtgctgagcaggggtgcctgaatcccggattgaagaaagtgttctacgcccgattaaaccaactgggaatccaggcaaaagaagacgttcccaggggaagccagcctgcccagtgtgcatggtgccttttaaacaaattatctgcattcccattgggatgaagttcacttgacaacattactcattggtttttttgcttttgtttagtttttttttttttttttttttttttgagacagaatctcactctgtcacccaggctggagtataatggtgcaatgtcggctcactgcaacctccgcttcctgggttcaagcgattctcctgcctcagcctcccgagtagctgggattacaggcatgtgccaccacacctggctaatttctgtatttttagtagagatggggtttcaccgtgttgcccaggctgctctcaaactcctgacctcagatgatctgcctgccttggcttcccaaagtgttggcattacaggtgtaagacaccgcgtcgggccttttttgtttttgtttttttgagacagagtctccttctgtcacacaggctggagcgcagtggcacaatctcagctcaccgcaacctccacctcccgggttcaagtggttctcctgcctcagtatcccaagtagagctgggattacagggacccacccgccaccacacctggctaattttttcttttttttccgaaacggaattttggtctgtcgcccaggctggagtgcagtggtgcaatctcagctcactgcaacctctgtttcccaggttcaagggattctcttgcctcagcctccggagtagctggtattacaggcgccctccaccatgcccagctaatttgtgtatttttagtagagatggggtttcaccgtgttggccaggctggtctcgaactccttacctcgtgatccgcccgcctcagcctcccaaagtcctgggattacaggcgtgagccaccatacctggccataatattcgtttttatgcatcattcctttttatggcccctctcacctccgtcaggtggtgaatagactacgtttcatttatccgttcatcggttatggacatttgagctgtttccatgttttggctttgtgaacactgctgttaacatgcgtgtacctgtatgtgtacatacatgagtagaggggttcagttcttttgggtatatatgtaggagtggaattactggtcataggatcattctatgtgtaactttttgaggcactaccaggctgttttccacagcagccagaggtgtctttaaaagcagttgtcaactgggcttggtggctcacacctgtaatcccagcactttgggatgccaaggcgggcggatcacctgaggtcaggagttcgagaccagcctgaccaacatggcaaaaccccgtctctactaaaaatacaaaattagctgggcgtggtggcgtgtgcctgtaatcccagctactcaggagactgaggtgggagaatcgcttgaaactgggaggccgaggttgcagtgagctgagattgcgccatcatactccagcctgggcaactagagtgaaactccgtctcaaaataaaaataaaaataaaaataaaaggaatgatcacttcctgtttcatgaatgaggaaactgaggctctgggagatgggaaatcctgcccggaatctcacagctggaggccaggccgggctttgaatccaggcaactgagtctgagtggatggtgtgtgctttgtgttggagctggcccagggctggatgaaggcaacatttaattaatgaaaaccactaccccctcccggctgttacctcttgagcgcttttctatgaagcatcctgtttaagcctcgcactctgtgatgtggaggtgcagtaattatccccatttcacagacaggatgttgaggtcagaggggttgagtgattgtcatgggccaggtctcagccaggcttgctaaccctggagtctgccgtctgctctgaagtggtcactctcagctggagagctgacctggcccttttgcctttgtgatgtacggtcctgaaaaaaatatttgcagaaatagcttcataggaacatatatggaatttggaattaaaaaatatattaaaaactatatatttaccagtattacaatatattacccagagacttgtctccctaatgaggccacctttactttttcaatctttgtctccgctggtgctttctcataactgccattcattctagtagaaatcatggttcacggttatgctgggtgtgtggtttttggtgttgacatgtcgaacgttttgttgttaccgcagtcattttgttactagttaattggtgctacctttccacggagacaatagtctagttacccctgccgctggagattgttctttttttttttttttttttttttttttttttgctattacaaataaggcctcagcaaatattgtgactcagacgttttccttctttctggtgtttcttgggacagactcctgcaggggtgatccctggggagagggcgtaattattttatgttcatgatgcggcagtcaccaccgtgtttctgaaaggtttgttctgcactctgggctgccagttgacattcggtttttcatggtgatctggtgggtcctggggtgtgatggtggccgggcccagctgcttcagccctcagcctgtccatcccccacccacacccagaactgaggctccaaggtgcagcctcaggtgtctgccaccctgtgcatccctcatcgccccaggtctgttgccctcccttctcctccttctcaaattacgctgcccagaggtcaggctagaggtcagcaggtccatcactggatggaatgacctggggcaggccaaggtatctgggggctgtgtagctgtgacccctgagcttcagggggctgtgaaacgagagaccttgggcacatgggcacatgacgtggtgggaaggcgcccagaggaccagcacccgccatgctacccccacactctgctccagtgtgctcccaccccaggacctttgcccaggcctgccggctccttctttcccagcaaggcctgctctgtctcaggtagcatgcagccccccgacccacttctcatgtagcatgcagccccccgacccacttcaccctgcaccatttccctgatctgcagcgtttatgatgtaacattactaaggtgtccttattggctatgtgtattgcttgtttattaccacccacgtgaatacggagccattcaggccgtgtcctgggtgtctgggtgggccagctggtgctgggcactcgcctgctggaggagtgagtgcccatggccagcccctcctggtgcctgggctgcgtctcctccttagtgtgctgcctctacaggcttttctcctgaactgtcctctttgcttttttttttttttttaagctttaaaagaagtttttgtagagatgcggtcttgctgtgttgcccaggctggtcttgaactcctggcctgagatgatcctctctcctcggaaagtgctgggattataggtgtgagctacggagccggcccttcccttctactctgctactctgctgttctctctccctcccgtcgggttctgctcctgccacgttctcccctctccccaccaaaggctgggttttctttgtcagggctcctttcccctttggagaagagggggctgtagggccttggtgcgaggccctccagtgacaggatcccccatcacccagagttccacaggccctggtagggaggagggggagcagaagaggaggtgccatctttgcctgctggggaagggcaggggccacccacacagagctctcccatttgctgtggaccctggggccactgccagttccttccaaaggaaagccagctccccaggtggtgggagagtgatgtggcttcctcttaaacttaggaattgagtgtgtggttgcttctaagtgccttagaagccggagcggctcctggaaagagcctgcctgccacagcgggccttaccctggctgtgcccacagatgtccctggggcctgccgctcctgcccggctctcctggcctcccccggtgtgggttgggaaaagcacagcaaattaaaaaacacctccatctctggcctttgaagaatgcatctgaacagccgagagtgtaaaccgtggtgaaatgtggtctttccagtttggggagaagcagggcagagctggggcttttgtacccagggtttccaagagctcctgcctccctcggctgggctggccagggccccccgctgggacctccagctgtaatagggaaggttttactgggttgctggccactgtggactgcccctaagggcaggtatgcctgcctttacccgggttcccctcctgcctggaagatacagcccatgggaggcctgttgtctgtgggatcctccagcatcagagacactggggccagcgtctgcctggtgaggtgcaggcctggcaggcccggtcccccacctgcttgagcacccacggtggtgggggctcgctgcctcccgagacaatctatgtcattgttgtccaaggaagctaatttagagtagaaagttccgtgtccagtcccactctgtgcgtgtgttagcaggggactctcgggccggagctgggtccaccctggtagggggacttcatggggcctgggcgacagcactgtgtatttgtgtgtgtgtgtgtttgtgtgtgtgtgtgtctgaggaggtggaccagtttctcaaaaggcctgtgaccccaagaaccaaggaatttcagcctgggtggatcacaccttcactggtgagtgggacaagctgggggccctcgccacaggagcagccagggcatggggcacagttggcctcattcacaaaatgggagtataagtgatccctgctctggcggccaggacgatgagtgggaacacaccgtgtgggggctgcctggcctgggtgtgccgcgggtgtccttgttggtgatggttccacctgcttgtgccaccagtgccctctgggtctcacacacaactctcttcccagcgaaggcccctcctgccctcaggcctcagtgctgcttccgtctcggaaggccccaggagctcctgcatcctgggcgtgattcctgtgtgcctgcagaccccctcgcggctgccatctcatcctttggtgcacctgttggccagacctcctggtagcgggtgctgcactcccctgaatgtgccggggcctgggggcagggacctgggctcctccctcactgagtggagggaactcagtgtcttggagttggggtgcctgcaggctgggtggtgcaggtgaaatgcagacctctcagctggtgttccagagcagctgccttcccccgcccgagggacttcacccgcagcccagtcaggggtggcgcctgggtgcatcgcccgcaggctgggtaggggtggagcctgggtggccctgcctgtgagctgcatagttgtcgcctttgaccctgagttttcttcgttatctgtttggacctgtttggggcaggcaggggatgagatctgaagataaatgccttagctgtgaccatctccttttgtgagaggtcaatgtccagttccgctgcagttataacatcccattttttgatttctttttattttttcctttttctttttgagatggagtctcgctctgtcacccaggctggagtgcaatggggtgacctcagctcactgcaacctccacttctcgggttcaagtgattctcctgcctcagcctcctgactagcaggggttacaggcgtgagccaccacgcccagctaatttttgtatttttagtagaggcaaggtttcgtcatgttggccaggctggtctcaaactcctggccttaagtgatctgcccgcctcggcctcccaaagtgctgagatgacaggtgtgagccaccgtgcccggcccagaactctttaattcccacctgaaacttgccgccttaagcaggtccccagtctccctcccctagtccctggtcccaccattctgctttctgtctcaatgaatttgcctaccgtaagtacctcatataaattgaatcataaagtatttgtctttttatatctggcttatttcacttagcataacattcttaagtttcatccatgttgtagcatgtgtcagaatctctctcttttttttttttttttttttttttttttttgcagacagagtctcgctctgtcatctagactggagttcagtggcacgatctcggttcactgcaacatctgcctcctgggtccaagcaattctcctgcctcagcctccttagcagctggaactacaggcgcgtgccaccatgccttgctaatttttgtattttttgtggaggcagggtttcaccatcttggccaggctggtcttgaattcctgacttcaggtgatccacccgcctcagcctccccaagtgctgggattacaggcatgagccaccgtgcctgaccagaatctttttcctttttgagactgaatagtactccattgtgtggatggagcagattttgccccgctattcatccctcagtagagggacgcttgggttgcttccatgtttgtttgtttttttgtttttgttttgctgttttttgagacagagtctcgctgtgtcacccaggctggaatgcagtggcgcaatcttggctcactgcaacctccacctccagggttcaagtgattctcctgcctcagacttgtgagtagctgggattacaggtgcccgtcactacgcccagctaatttttgtattttagtagagacggggtttcaccatgttggccaggctggtctcgaactcctgacctcaggtgatccacccgcctcagcctcccaaagtgctgggattacaggcgtgagccaccatgcctggctgcctccatgttttagctgttgggaaggatgctgctgtgatccaaggtgtatgcatatctgattgtgtccctgttttcagttcttttgggtatataacccaaagcgaaattgctgggtcatatggtaattctgtgtttaagtttttggggaactgccatgctgttttccatagtagctgcaccatttcacatttttgccagtggtgcacaagggttccagttgctccagatcctcaccaacacttgctattttgtttttttgatagtagccgtcctaattggtgcaagatggtatcttattgtagttttgatttgcatttccctgatgattagggatatattaagcctgttttgatgtgtttattggccatttatatgtcatctttggagaaatgtctgttcaagttgtttgcccatttttgagttggcttagttgttttctcattgttgagttttaggagttctctgtatttcatggatattaatctcttagtagatctatgatttggaaatattttctctcattctgtgggttgcctttttactctctcgatagtgtcttttgatgcacaaaatctttagcttcccatgaagtcccgtttgtctttatttgtggcctatgccttcctgttgtttgactttcacagtgtccctcgttgccacaaagaactgtagacctaagatgatgacagcacgggtggggcggcggaggcgccgctgtcattttcctggcctcaggtcctctgtgtgtcctcccatcctgtggagcatgtctcctgggaatgggaggggccaggatttgagccagtgcttgtcttggcagggaggcctgtgctcggaaccatctaccccactgcgctggggtctcctgggccatgctctggccctttgtgttcccagctaccctcatagaggctgcaaatctttcccctgctgaaatgaaaccaactgaactaactacaggattcagttctgtgattgtcattggctgagttgagtttgttttggctttctctttcttggtgaaggtgggagtgtggggttggctgggctcccccatctgcgcaggaggacccaggggtctgcagttttcatgaggaatgtcagctgtttcaagccaaggcttcagatgttttttgggggtgtttgtggccagcccagcctagccctgctgacagcagacacggactgatggagctccctggaggcccttaacctcctcctgtccacatcttgtgttcactcctcatgtggcttcttagtccctctgagtctgtgttgggggttgctggaccctcctggtccgacgtctgaggtgtctggtggggtgatggtctgaaggcctctcctgatttctcattgagcccgttgtgggaatgagaccgttgtctgtgagatgaggcttcttgcacaggcagaaggggctgagggctgcggtgcagagggaggtgagggagccagcctggccgcaggcagatcaggaatgcttggggtggggtggtggagagaagtgtaggtgaggccagaggccaaggccttggaggccaggctagggggtctgaccttgttctgcatggcactggcacagggagctgtggaaggtgtctgagccaaggggtggcattccagagtgaccctttaaatgtaggaatgtccagaagcagggtgggagaaacatggaatacaggggtggatgggaagctgatgccacggccaaggaaacgggcctgagcttggacagtggtcaaagacttgtaagggaatcttgaggctctgtctggcctgggctctgaacccctcaaaaaatgtggccctgtggctgggtctgtagcgagcagcatggccagtgctgtgcctgcatgtccccgtcccctgtgtcaggccaacaaaggggatgtggcttctctgcagaacaggacagggcccctgtagcctctggaggacgatgtgggaggttttgggcatggcaggaagggtcacccatatctgggggaacagacgtaacagttggtaaacaaacaggtgctgtcaccgaatgtgggaagaaggctgtttgctgcgctgcaggagcctctgaatgatgcgggccggggctgcccaggcaacttcctgacaacgccttaggggtgggaggaaggaactggaggtcttgggcatgggcagggcagtaccaggagtgctctgggcatagtgctccatcccagggctgtgtatcttgctggcttagccagtggccctcacggtttgcttctgccccacagcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtaaaccctgctgcgactccacctgggtccagggggcggggagtgtcaccatttctctctcgaatttgcatgagcccaagttgtttttcagaaaaagggtgtgactctgaaaatgaacccgtgggggggttggctcaggcctgtaaccccagcactcggtgtgactctgaaaatgaacccgtgggggtgttggctcaggcctgtaaccccagcactcggtgtcactcttaaaatgaacccgtgggggggttggctcaggcctgtaaccccagcactcggtgcgactctgaaaatgaactcgtgggggggttggttcaggcctgtaaccccagcactcggtgtcactcttaaaatgaacccgtgggggggttggctcaggcctgtaaccccagcactcggtgcgactctgaaaatgaacccgtgggggtgttggctcaggcctgtaatcccagcactctgggaggccaaggcgggcagatcacctgagtccaggaattcaagaccacactgggcaacatggtgagaccccatttctacaaagtatacaaaaatgaatcgggtgtgatggtatgcacctgtaatcccagcttcttgggaggctgaggtaggaggatcatttgagcctgggagatcgaggctgcagtgagctgtgatcccaccactgcactccagcctgggcgacaaagtgaggagatcctgtctcaaaaaaaaaaaagagctcagctttcaagatttgttattgttgaaggaattacttccccttgagattccatagttatgttcctttttttttttttttttttttaattgagatggagtctcccttgttgcccaggctggagtgcagtggcacaatctcggctcactgcaaccttcgcctcccgggttcaagtgattctcctgcctcagcttcccaagtagctgggattacaggcgcccaccaccacgcccagctaatttttgtagttttggtacagatggggtttcaccatggtgtctaggctggtctcgaactcctgacctcaggtgatccacccacctcggcctcccaaagtgctgggattacagacgtgaaccaccgtgcctggcccatagttatgttcctttttaaaacttgcatgtctgaggcaaccgatgtggttggccatgggtttgaatggttaaacacatctttgctgtgtgtatggtgggcggcctgggaagtgcggacgctcaggcaggtggaatttgcaccttctcctggctttctaattgcattggctgaaaaagtgcagctccttgtctggaagcagaacctgctgggagtggttctcgggtccgttctggaagctgccctgtgtcctcctcagctcctagtctggctgagttcacctgggcccttgaaggctcagggcctggccgtgatcccaggtggggagagcgtgggtggcaggaaagctttggagtcgaagtccggggtggagagtttaaggggaggtggcccagctccactggccagctaggccaggtcaccccagactcccgagcagagggaacagtttgcttggccaccccttgtccctcctttgtcccttttcttgcagcctgggagtgactctgggggccgtacacacacccttacctgggctgtgctaagccctggcccttgctgacctgtcaggttctgtgctgggtcagtgtcagaactggttggcagaggtcttgactagaacacaagagccatttcccaccacccccaggctcagttggaagccctttgcctgttagttcattcagtgtcaccacagtctctcagcactcccagcctggacctcaccggttgaggggccggcctagatcttctttgcgcaatggcacgatctcagctcactgcaacctccacctcccgagttcaagtgattctcctgcctcagcctcctgagtagctgtgattacaggcgtgcactaccacacctggctaggttttgtatttttagtagacacagggtttcgccatgttggccaggctggtctcaaactcctaacctcaagtgatccaccctcctcggcctcccaaagtgttgggattgcaggcgtgagccactgcacccagcctgacctagatcttctaggttagaaagtcccaggagtgggcggccatgcatccaggcctgccacaggagcccgcctgccctcctccctgaagtcagggctctggaagcccttcccttggccatgccctgtgggacagtgtccaagctctggagtaggactgaagacccctgggctctagtcctggggccaccaacttgctgttgccctttgcagtgacctccccctgactcccatggtgccggctgcaggagccgggcgggaggggctggttgccagatcctgcagatgcccctcctctgggcctgcccagggtagtgggaatgagggtgtggggtgagggtctgtcctcaccaaggctggtgtttgggagctcaggaagcagagtgccatgtggccaagttcacctctttgatctgtgtggtgacttaggaagccattgactggcttctgacgagcatgggaagggctggagcctttcagagcccaacaggtttgtgtgagagccaggcgtgtgtgtgtctgagcaactgagtgtgggagtgggaggatgtgagcgtgtgtgtgtgtgtgtgcgtgtgcacgcatatgcgtgcatacgtgtgagcctgtgtgtgtccgtgtgtgtgcatgcatgcgtgtgagtggatatttgtgtgtgtatgagtgtgcgcatgtgactgtgtgtgcacgtgtatgtgcccgtgtgagcgagtatgtgcgcgagagtgtctgcatctgaaccagtctgtgtgtaagtatggggtaccagcaggggtgggacacggtggaatttatcgccaaagtattttgagtccctgaggtcaggccagagcagcctcgtgcccccactacctgagaagtgcccccggcctcccaggggtgctgtgctgggcaaccactcatccctggagcccctcgtatgccctcgctgccctccgagtgggctagccacccctgcagctgccggggagccagctgacctccggggcagcctctgttccgcttggtgaactgttgccctctcagccctctccccctgcactgtggctccaggagtcgcggggttactgaccttctttttggaagggtcggctggtgtagcagtgtctctggctaggagggggcatctgcagtagtcggagaggctgaagatagcagcttgctagaagccctctcccagggccggcctgcggttgctcaccagcggctgccatggccatcgtgtcgccaggacctgcgctcctcctgtcattgcgttccctcccagcgtgggtcgctgcagctccctcacctcccaaccaggcatccactgcatttgtgagcccttgcgcctggtcctgctccccacgcagcgggtatagcccagtctctggccctttcagtgagtgggaggagatggtaaatgaatagtatttgaaagggacgtgtgcgtagggggataaagcagtgcttgggtgctgtggcgaggggcttccgtcggagctcaggtgctgggaaggcctcttggtgacttttgagtcgagactggaagcagatgaggctgagaaccgtgtggctgtctgggggcagcgcggtccaggcagagggatcagccagtgcaaaggccctgggctggtttggggcggggcctgtttgaggggctgtagcagaatgtagggaaacagggcccaaggtgtgaggagaggacacatgaggtctcgagcagaggaggtgccagctctgactcgtgctggaaggcatcccctggtggctggagcgagagtgagctgtggggtgggtggcgtgggggcaggagccctctccacggttattaccgggatcctggcgacagaaagcagcagcggggacacctcacttgtgggggtaaggagtggcgagatttgggatctgttctgaagagaaaagacagctggatttgctggcactctgcatgtaggttcgataaaaagatgagacaaggttggcacggtgccactctgtgcctcagtatccttgtctgtacagaggcgtgaccatgctgcatgtcatgaggaaaacaccaagaacagtttgtgagttcaacaaatgttagctgtcgttataataaaaatgccctttcctcgccaccagaagtccagtctccatgcctacgtggttttgtctttttacttctttatggcttttgctatgttggttgggaagtgctcagtgctaggttgggaggtgatcagtcgggaggtgctaggtgatttgttgggaggtgcatgatgctcagttgggaggtgctaggtgctcggttggaaggtgattggtactttgttaggaggtgcttggcgcttggttgggagttgttggtgtccagttgagaggtgctaggtgcttggttgggaggtatttgattgggaggtgcttggcacttggttgggaggtgctctgcacttggttgggaggtgctcggtgctaggttgggaggtgatcagttgggaggtgctagatgctctgttgggaggtgcatgatgctcagttgggaggtgctaggcgcttggttgggaggtaattggtacttggttgggaggtgcttggcacttggttgggaggtacttggtgcctggttgggagtagttggtgtccagttgagaggtgctaggtgcttggttgggaggtatttgattgggaggtgcttggcatttggttgggaggtacttggtgcttggttgggagatgctgggcccttggttgggagtagtctttcccatgctcagatctgagctggctttgcctgcatcatctctgcgagccaactgtccctgtttggctctggcttttcttaactatttgaaatggttcctttacatgcttgcctctgaattctctcccagaagccctccccaggatcacacctgtggctgttcactcccacccctgcccctggggcaaagttgaccttagtgttgattcctgggcctctccccacaccttccctttgctccagtcatttgaatgagagagtgaaaacagtgagatgccggctcccactcatcagatccagtgatgctgatgacgccagccatggtcctaccctgaggtgctgactctgtccctgtaggctccatgtctccggagagggagagggagagggagaggattccagcctgtcacagcgcccgcggcagcaacccctgctcgccaaatactgacttgaatagtggtcctcaggcataagtgtgggcgctgagtcctggggcaggactgctgtcctgagagtggggacagtggagggtgggtttgtcctctgtcctggccacaggcacacggttgcgaggagcatcttggccttcctcccggccctgctagagcccccgtcatctcctgtgccctcctgcagtgctgtcccccaccagggtccttcctcagaggagggggttcctgccccggccatcatcaggaagggggtctctgggtccgagcgtccacctcagtgtgcacgtggccaaaaggatcaagagccctgcagccaggggggcccctcctgagactcgacttcgttgcagtttcagcaatgcaggtggccccgtgcggacatccaggcagggttgagggaaggcacatccctcccaggcccagggtacccatgtgggtggcagagcgggctctggggatgaccctctggcccctgaggatctggggccagaaagacactggcttagcatgggaggagtccccggcctgtaccagcctgacaaggggctgcagtggcccccgggtctcaaattaaagccagggtgaaacccaaccccctctttaaaatgcaaaatggcccttccctaaaataacacacaaccacaaccgcagctggctctgcacgaaggccatgctgcagctcttttcttcggaagtcgattttcctccgtggaatttggctgggcttgtggtagcgtttgagactctgcaagagcacgtccacgccaaccagtctctggtcaccgactggctcgcaaattccccatttaaggaaaccagcaggcctctgttatgaaactcggggaaggaatgtgaattatgctccatgcggaggctcctgctcctgcacgttttccagccttttccatgggccacggtggagcatttggggaaggcctgtgtggattcccccccaagtccagactgatgcccctgataccttctcaggaggtggcggagggtctgggctctgtccaggctcctaggggtggggacgtgcaggtaaagcaaggcgtctgccgcaggcacgcgggagccttccctgggctggctgccagcaccttggagtcccaggctgccaggaaaagttcacccacacccgggctttgctggcgaagggtgagtcatatgatggccgggctcgggccctcagcagacaccaagtgtgttcccagagcagccgctcagcgcctgtaacctggaacaggccagcctttcggggcctcagttttctcatctgcctaatgggaatagcaattcccaccttccctttgttggttgggttctcactagatgcacaggagacagcagcttgagagggactgtttggagagctgttccatgtgacacccctcttaccctgtccccacggggccggaggagcaggggcttggtgatagcagctgggcgcagtcagcctctgcagggaagagggcatgtttggttcgaggctcctatgccctcattcttgttgatcttgtcacagcccctctggaaggtggagatggtactcgctcaggaacgataccactcaaggaagcatggccccctggatggggtggcccttggtgcacctgaggctcctgaggctgcagagcaccatggtgggggaggaggcggctgtgtgtctgtcatttgcctcttctgctgaatggagacccccagagggcaaagcggggcttgttctccctgtgtcccgggatcactctcatgcctggcttgggcgagctgcctgtttctaaatcacttgctaaggctgaggggaatggggtttgccgcccaccccaggaagaagggagcaagggagtcagcaccattttacaaggaccaagagtgggaggaggctcctcagaggacattctgggcactgtcccctttctctgctgtgaagggtggacaaaacacaataggtctgccagcccttgtgtcctgtggctcatcccagctggctgggatgggaactgagtcctccaagctggtgtggttcccctctggtctccgctgagagtcacgcccagcctctgggcacacaccctgtggtcacctccaaacagggcacactgggcactggtgggggtgggacctgccatcccagacctggtgtctgctcactttgtcttggttcattggccagagatcacgtaagggcgccctgaggatgtgcttgtttctcatggatgggtgatgcttgtctcttgggaacatggagaagcaaagccacgtcgcccacagacctacccaggaacagctgcagctgcaggttcagggtccatcccagccatgggttttattcttttttttttgagacggagtgttgctgtctcccaggctgagagtgcagtggtgtgatcttggctcactgcaagctccgcctcccgggttcacgccattctcctgcctcagcctcccgagtagctgtgactacaggtgtccgccaccatgcccggctaatttttttttttgtacttttagtagagacggggtttcaccgtgttagccaggatggtctcgatctcctgacctcgtgatccgcccatctcggcctcccaaagcgctggaattacaggcatgagccaccgcacccagcctttttttttttttttttaggcagggtctcactctgtcatccaggctggagtgcagtggtacagtcacagctcactgcagcctcgacctcccagggctgaagggatcctcccacgtcagcctcccaagtagctgggactacaagagtgtgccaccatgcccagctaacttttttttaatttttattttttgtagaggtgggattttgccatgttgcccagggtggctcaagtgacccacccacctcagcctcccgaagtactggaattacaggtgcaagccatcgtgcctggccatgttttgttgtttttaaatagacttaattttttcaaacagttgtaggttcacagcaaaattgatgagcagcaggtactgagttcctatacatccctgtcctcacacccacacagccttcccaactgtcagcatcctgtgcagggtggtacatttgttacaactgatgaaagctggctgacgcaccatcacccaaaatccacgtttacacgagggttcgcccttgatttgtacattcttggtttagacagatgagtaaggacatgcacccaccattccatgtcatacaggatagttccactgccctgattttctgtgctccactcattcatccctctcctctccaactcctggcaaccactgatgctttactgtctctgtgtatttgctttttccagagtgtttagaactggactcatacagattggctctttcacctactaacatgcatttaagtttcctccatgtcttttcatggcttgatagatcatttcttttcttttcttttttttttttttgagatggagtctcgctctgtcgcccaggatggagtgcaatggtgcgatttctgctcactgcaacctccccctcccgggttcaaatgattctcctgcctcagcctcctaagtagctgggactacaggtgctcactaccacgcctggctaatgttttgtatttttagtagggacggggtttcactgtgttagccaggatggtcttgatctcccgacctcgtgatccacccgccttggcctcccaaagtgctgggattagaggtgtgagccactgggcccagccgatagctcatttctttataccactaaataatattccatcctgagtgttttgaattgccttttagaggttcatttacagcattttcatggtagcaaaaaaatcagaaataacctgaagttctttaaaaaacttacagcagagtacactaggcaatcatcaaaagaacaaggaatctttctatccacaagaagggaaggtgcccagaatttactgttaactgagaacaagttggaaatagtatattttgattgcccagcttaaggcaggaatacctgaaaccatacctgttggttatttccgatgggtgagattttagggcaagttcactgtctgttgtttcatgtctgcatctatgcagacaaaaacaaaaaacagatctgtgttagctgcttctcttgccctgcccccgtcacaggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggtaggtacccacgcagtcctggggcacccctttcccctttgtccccagggcttttgaaggcgttccttcttaactcaggcctacagactcttctctgaaactctggggccctgaggaatgcaggacttctcagaacttggaacagcgtcagggtctgtgtggcatttgccaccagcccttgaatatttctatagcaaatgtggcacgttcattctaagtagggcagaaaagactatctgtagcccacacccatgcacagtttttttttttttaactttgtttttttgagacagagtctcactctttcacccaggctggagtgcaatgtcataatctcagctcactgcagcccccacctcccaggctcaagcgatcctcccgcctcagcctcccgagtagctgggactacaggagtgcgccaccacacctggctaatttttgtatttttggtagagacggggtctcacatgttgctcaggctggtctcaaactcctaagctcaagggatccttcccctcggctcccagagtgctgggattacaggcgtgagccaccgcacccggcccatgcaccaaatgaggttttgtcaccagatgagcaacaaaagctttccatcttcagagcgttttggattttggaattgttggggagggcttatggcccggcagggttgtgaacagtaaccctgtcacacgcaccacccccaccctggccctatcccagctcaggcatcctgagggcaacagccggaagctgtctcagttattggtgcattccccagtctcaccagggggccttccacatggtcagtgctcaataaaatgggccgagaatgagtaggaagggttttcccctcgttggttaattgcttttagagccttctggtcagcatagcttcccagctctgtacttaattaccccttatagaaacatcccttctgtgtacaggtgaagggcagtttattcactaaccaagtgctgcctgctgctagccctgtgctaggtgtcagggatcctcctgggacggcagaccccattcctgcactagtggagctcctggcccaggcagggatgtggcaggtgtctgtgcagagggcagtagtgactgcatgggaggactcagtggctggatttctgcaaacacaggccaacacccacatgaacagacttgagggcttgggcagctttgctccacacttgccaggcctcgtgtgttagttatccattgctgtgtaacaaaacagcccacaacttaacagcctgaaacagcaaacaggttttttatggggagggagtcagtgatgaggagtggattagctgggtgcttctggctcagggtatgacctgagggtacactcaagctcctggctgggcctcagtcatctgaaggtttgagtgaggccgggacatccacttccaagctcattctcagggcaagaggcctcagtttctcctgttcctcttatgctgagccacacatctcttttgggctggtttgaaaatatcctgttgtccctggaagtgcagaccagcgggtctggtttgagatttggaaatgtggttaccctgtagactgtggttcttgggagctgagtgatcttacagttatgaagggtggacaagaggatagaaaggctgcagctgggagtgccctggtcaaaggatggtgacaggggacagtgagggtgatggaggttgaaacatgctaatggtggtggcggtggcggcagcgaatccttccatagcacttactgttttccagggacgtttatcagttcatttaatgctcataccacctctatgaaacgtttgctattatgttttatttttatttatatttttattgttttgaggcagggtctcactttgtcacccaggctggagtgcattggcacaatcatggttcactgcagccttgacctctttttttgtttgtttgtttgttttttttttttttgggatggagtcttgctctgtccccctggctggagtgcagcggcaccatcttggctaactacaacctccacctcccaggttctagcgattctcctgcctcagcctcccaagtagctgggattacaggtgcccgccaccacgcctggcaaattgttgtatttttttagtagggacggggtttcaccatgttggccaggctggtcttgaactcctgatcacaagtgatccacccacctgagcctctcaaagtgctgggattacaggcgtgagccaccacacgcggccacagccttgacttcttgggctcaagtgttcctcccgcctcagccttccaagtagctgagaccacaggcacgtaccaccacgcctggctaatttatttggtattttttttgtagagacgaggtttcaccatgttgcccaggctggtctcaaactcctgagcttaagccatgtgtccacctcggcctctcaaagcactgggattataggtgtgaaccactgtgcctagcctgtgtttgctattttgatcccctgtgcacagagaagcatgtgaatttgcccagagccacacagctagtcccagccagggttggaacatagggtctgtagctccagggtctggtctgttctcagcctctctcccacctgcttccccgcgggattcttctgcctctgcagcggccatcgctcttcatgatgcacctggggctattcacatggaagcgtcgtgtgttgggtgacgagctctggagccacacagacctgtgcaggcccctttatctgtgactgtggctggggcaagggccgaggctgaccttccctcagtgcttctggctgaggcagagcatggcccagggagcaaccgagagtgatgggcctctggcttctctcactgaaaaatggccacatgggctgggcgccatggcttacgcgtgtaatcccagcactttgggaggccgaggcgggcggattacgaggtcaggagatcgagaccatcctggctaacacggtgaaacctcgtctctactaaaaatacaaaacattagccaggtgtggtggtgggtgcctgtagtcccagctactcgggaggctgaggcaggagaatggcgtgaacctgggaggcggagcttgcagtgagctgagatcccgccactgcactccagcctgggcgacagagcaagactctatctcaaaaaaaaaaaaaaaaaaaaaaaaaaggctgggcgcggtggctcacgcctgtaatcccagcactttgggaggctgagacgggcggatcacgaggtcaggagattgagatcatcctggctaacacagtgaaaccctgtctctactaaaaatacaaaaaattagccgggcatcgtggtgggcacctgtagtcccagctactcgggaggctgaggcaggagaatggcgtgaacctgggaggtggagcttgcagtgagctgagatcccgccactgcactccagcctgggctacagagcgagactctgtctcaaaaaaaaaaataataaaataaaataataaaattaaaaaattaaaagtaaggccgggcgtggtggctcacgcctgtaatcccagaactttgggaggccaaggcaggtggatcatgaagttaggagatcgagaccatcctgggtaacacggtgaaaccccatctctactaaaaatacaaaaaaattagccaggcgtggtggccggtgactatagtcccagccactcgggaggctgaggcaggagaatggtgtgaacccgggaggcagagcttgcagtgagctgagatggcaccactgcactccagcctgggcgacagagcgagactctgtctcaaaaaaacaaaaacaaaaaaaaataaaattagaaaattagctggccatggtggtacatacctgtgttcccagctactcaggaggctgaggcaggaggatggattgagcttaggagattgaggctgcagtgagccatgatcacaccaccgcactccagcctgggtgacagagcaagaccctgtctcagaaaacaaacaaaaaagacaacattgtggaaaacagtttgttgattccttgagacgtaaacattgatttacgtatgacccagcaattccgctcctagctgtatactcttaagaatcgaaaacaggtcttcacacaaaatgtgaatggacagtaatgtccgtagcagcactgtgcacaacagccgagggtggaaatgacacaaaggtcccccagtgggtgaatggatgcacagattgggttctgtctgcacactggaatatggttcacccctaaaacgggatgaagcactgacatgctacagcctggatgaacctcgaaaacatggtgccaagtcaaagaagacagacatcagaggctgtatattgtgattccgtttatatgagatgttgagaatgtgtgtagttaagtccatcaaaagtgtttgccggggctgggggcggggactggggagtgactgctgccgggtgtggggtttgcctgtggggcaatggaagtgctttggaactagacagaagtggaggctgcaccgccttgcgaatgcactaggtaacactattcactttaaagtggtaaatttaggctgggtgcagtggcttatgcctgtaatcccagcactttgagaggccaaggcgggtggatcgcctgagctcagggcttcaagaccagccttgggcaacatggcgaaaccctgtctctaccaaaaagataccccccaaaaattagctgggtgtggtggtgcacgcctgtggtcccagctactctggaggcggaggtgggagaatcgcttgaacctgggaggcagaggttgcagtgagctgagatcacaccactgcactccaacctgggtgacagagtgagaccccatctccaaaaaaaaaaaaaaaagtaaacgtatgtcctgtgaattttacttcaataattttcttaaaaaacagcatcaacaaaaatgaacagaagaggtggtggatctgcagagcccacagctcccatcttccctgtgccacttcatgagtgtcaccctctcctggcaactgtgctgagggctggggacgtggcggggaccctctgcccccaggcccaccctcagggagcctgtcacggggcgagggtcattaagcaaataaaactgcacattaccgaccacgtcacattatgatcctgtttccagtgtccataatctcattacacccgagtcctcatttgctgggcactgtaagcatctagaaaagaatagctgtttctcgggttgatgccaagtttcatttactctgaaagtataaattatgagcattgtaagaaggagcgagtgcacatggcctgatttgtatacagaggttaaagcgttgggcaggagaggtgtgctttttgccaggcatggcttcctcctttcttccctgggggagactttgccacttgacctgggggagcccgtgtgtcaccatcacaggctgtgtttgggaggtgccctgtgcacgccgggagaaatgtacgagggcgccagctcctggggctcttgacctggcctcacttgtctggttgaaagcaaatgggaagcctggcatggtggcgcacgcctgtaatcccagcgctttgagaggctgaggtgggtggatcacctgaggtcaggagttcgagaccagccttgccaacatgatgaaaccctgtctctactaaaaatacaaaaatcatctgggcgtagtggtgggcatcagtgatcccagctactcgggaggctgaggcaggataattgcttgaacccgggaggcggaggttgcagtgagctgagattacatcactgcactccagcctgggcgacagaccgagactccatctcaaaaaaaaaaaaagaaattaattgggtcagcagcaatgactgtcgggggaccctcctgatggctcctccaccccgcttccctgactgcaggcagaaggtggtggagggcagcctgacgcaccccttcgccctgacgctctccggggacactctgtactggacagactggcagacccgctccatccatgcctgcaacaagcgcactggggggaagaggaaggagatcctgagtgccctctactcacccatggacatccaggtgctgagccaggagcggcagcctttctgtgagtgccggctggggcgcgggggcgagggtgcgggggctggggggagcgggggcgcggggcaggggagtgggaggatgcgggggcgtgggggtgcgcgggcgtgggtggggtgggggggcaggtgacccctccctgcagaagcccatgctctggggggccccctctctaaaggggtacctgctgcaatggagggaggtatgtggctggctgggggacacgggcctgcagaggacccctctgcagagctcatgggggctatttcaggctcagcagtggcaaggggatttccaaggaaggttgcctcgttttcaaggcccagaagaagttgtctgtgtgtgtgtgtatatgtatttatatacacatacacgtatgtgtgtatatatatatatggttatttatatatacatatatatgtgtgtgtgtgtgtgtgtgtgtgtgtgtgtgtgtgtatgtatttttaatagagatgagagattttgccacgttgcccaggcttgtctcaaactcctgggctccagtgatcctcacaccttgacttcccaaagtgctggggtcacaggtatgagccaccatgcttggccctgcaagtcgcgtatttatcaatgaataatctgcccagaatcagcagttctcagcctgggggccacgctgggttgtgacagaggtccctgatggggaaatgcaccagcttctgtgacagtggggctgcggctctggggacagtggcccactcccacagggaccagggatggagatttctggccaggccattatggaaggtttggactttgaattgaaatgtggggcctaggggtgccagctgttcccagagcaggacacaggagggtggggctctctggagctgtttcctggtgagaaagtcgtggtcacaaaacccatctacacttggggcagcatgagggagggagaggttcattttgatgagtttgttgttccagttatatccgtattttggggctgctacacccagctttcccctggtttgaatgaggtgctggaagcatttatcgagttccgttcaattgctgttggtcatagaagggcttgggagagtgacaagcttggccatcccagcaagagggacagtgttcctatggaagctgctgggtccacacatagcacaaagacaagacaagccttttgcccaggagcccattgtctctggggttcccgtcactaccacacaggcaggtcctgaccccggccattggagcgtggggggcagcctttgcagaggggtgtcctttgggggctccgaggagctggggagggtgttctagtcataggagcttggtgggaggaagcagatggggaggatgtcactccatgggcaggtcacatctgggtgtgagggtggccaggaaggtcacggctggttttggggaaattgcaggccgtctggccaggctgagggccccatgtggacggggccagcgatgaggcaggtggaatggtgcccgcggggaggtccctgatgccacttgaggccgatgtttgggcagagggacacactggaggctgtcacgggggacgaggcaggatgtgactcattcagaaacaagtgacggtcctcttctggaaccttctctcactctgtcctggttttctcagtccacactcgctgtgaggaggacaatggcggctgctcccacctgtgcctgctgtccccaagcgagcctttctacacatgcgcctgccccacgggtgtgcagctgcaggacaacggcaggacgtgtaaggcaggtgaggcggtgggacgggacggggcgggcgggcggggcggggcctggcgggaatgggttgcggccgccgggggtgccccagaaggaacctcggcaaacccgttcgaaatgatccacttggcgggtgtggtgattcaagtctgtggtcccagctactcgggaagctgagttgggaggattgcttgagcccaggaggtcaatcctgttttgttttgttttatttttgccccagatattttccacttttttactctccgccttggtcctcaggcacttggtgcttcctgggactgtgttgcagtgaggcatggctcttctcctctggggcaccggctgaggatctttctttccaggtgtcggttcggggcgggcccttcgggaaatcacacacgttcaggatgcagctcgccttcggggatgctcccgggcctgggatagccagtctggcctctggggctgaccctggggcctggcaagcgagggggtaacgagaggtgtcaggaaagcgccatccctgggaccagtcctccccgtttctgtagcgtgatggggcccagcttgcagaaggtggtgggggacagggcctgcttcctgtgccggtgtcccactcgggagggcagggggcttccaagtgggctggcttccacactcaggaacagtcctaagggcagagtctcggtgtggggccccctagaaggactctcctggcatccggtggatggagaagtgtccttgctctcactgctgtctgagcacatgggggtcctgactttaggaacagtttcctggtccccctgttcttgctggctagggtctgtgtttgtgtgcagcggctggggtgtgtgtgtggtcgtggcgcccgtggcgtgtgggtcttttctctgctccctggcaggggtcctgcgtttggtgaggattttccaggtttgtatttgtctttctctttctgagagcagggcatctttaatgaagacatggctgttacatcaaagggtctgtccgctgtgccggctgctgcaggggatggttggagagcctccccgaccaagcatcttgtttcccaagtcgggagaaggagaatttgagaaatggggacttgggcggcctagtcctcacggctctggacagcaccccattcattcatctgcttgctcattcattcgttcatccatccatttgctcattcagcaggcatttgtcgaacacttgccgggtgctggcattgctccgaggcactggggaccccgcggtgcagacagaatcccgggcctctggcgctcgcactctgggctctggggctgggtgggtgggggagacggcacaagtgagtccacgagggagtcagtgcattagaaagggtgagtgtcttggacacccgctcctccatcacctctggggcccttcgctgttgaccgttcacctcggcctcaaaggcaatgttgagagagaaactggacccagggaaggagtccagatgagctgcctcctgagtgacctggcgacaccaggggtttggaccaagcaggttaagggaggattatagacccttgaaggggaggagtggtttgaccaggttggatgagccctttgtttacagaggaggccagggcaagtcaccagcctggggttgcccacagcaggtggcatagtaggttctagcaggtggggtctggctcccagagccatgagtttgctgctgccccatacctgggccctggtggagcaaggccctggtctccctcgcagactgccccaggacgctgcctgctccctggaggagggggtgcctcggctgcacaagcctcagcggagaaggatgcttggcttgctggctgcccgggaaccttggccttctcagagtttgttttctttcctgcctgtctgttggtgagaagaggctgaactcagtgctggagctggaccctgcgctctgcagtgttggttgaagtcctggcggaaagggaaagagtgaggacatacgggctcatgacggcagggagtggccaccacagtcagggccgggggacggaggggagagagaatcaccggaatatggcaaaggtgtaaaacaggcagctcgggccgggcgcagtggctcacgcctgtaatcccaacaatttgggagtccaaggcaggtggatcatttgaggtcaggagttcaagaccagcctggccaacatggtgaaactccatctctactaaaaatataaaaattagctgggcagtagtggcacgggcctgtaatcccagctacttgggagactgaggcaggagaattgcttgagcctaggaggcggaggttgcactgagccaagatcatgccgctatactccagcctgggcaacagagtgagaccctgtctcaaaaaaaaaaaaaaaaaatgcagctcgtcctggctagtctgaaaaaggtggagcatatatgttgcccaatatccacaaatattccagaaaatatctgagaagaaagcagttaatgagacgggcctgttcccctgccccgaggcacacgtgtggtgggggccatgtcaggaagcaagccggcacacagatggacataggacagacctggatcgggtacggaacacagcaggggctgagccggagactcctgtactgggggtgtggccgcctgagccggcaggtcagaggtctctctcaggaggcctgagatctgaaggactaaaagagggaaaggcgagaaggaacagcacgtgcagcggctttgaggcaggagcatgctggtgttgggaccgacttcacgggctgtgtgacctgtgtagtcatatgaggtgagctctgttgttgacctgaaattcctaccttttgagtaaggggctgtctgcacttccattttgcagcggtccccgcaaattctgtaacgggcccggctcgtgtgtttgagaagctgaagggaggtctggaggtggtctcttactctcttggtgtgtctgtctccacattttatcttctgtttttttgttccccagccctccctgcgtttttcctgtatgtgactgtgtgtctgtgtgggtgatcgaaccgtaaggcttcctgctatttatttcactttatgcactgcagaagcatttgcgattgcaggaggtaaatatgtatcaaagacatgagttttagtgaaggatatctttttttttttttttttttgagacagagtcttgctctgttgtccaggttggagtacagtggctcacagcagcttccacctcccaggttcaagcaattctcctgcctcagcctcccaagcagctgggattacaggcgcccgctactatgtctggctaatttttgtatgtttagtagagatggggtttcaccatgttggctaggctggtcttgaactcctaacctcaggtgatccacctacctcagcctcctaaagttctaggatcacaggcatgagccactgtgcctggcctatgcctgaacaatatcttatcaagacatgtcttttagtcatcctcccgctatggggcgtttctgttctctttgtgtttttgccatttctgagtcttgctgctgtgggttgggagtgggcaggtgagagctggcttggggcctggccactggagttagagggagcagggcctggtgtctgttgccaccatcgattggtgatgtctgcctaaacactgtgttgcatctgctggggatgtctgccttgggagagcaatgggcatgtaggaagcaggtgtcaccatctctgttcttggggtgtcaaagcaaggctgggtgtggacatttgtcgaaggagtggggaatggacacagcccccaacaagcagatcgtgcagtcgtgcctgtcaggtgccttgccctaacagtggaaggatcatttgaggtcaggggttcaagaccagcctggccaacatggtgaaaccctgtctctactaaaaatacaaaaattagccgggcggtagtcgtgcgcctgtaatcccagctatttgggagactgaggcaagagaacatgttgccctgggagcttttgttaagggtccctgtgtggctccctcacgtatcagagttccaggaacgggtgtgggccctgataaaatcccagactcatggctcagtgaagtcgcacagctggacaagcttggagacccccaaataacttgcccaggctaccctggcttgcaaagggccactgctcatccaggggtgacggagccgtgctgggtgcctggcatccagtgggtgcccagtgtccagctgccatgtccactgtccatgcccttatcaccttcatgttgtcaccatgaccggcgccttaggtgctgtggctggtgccaggcccgtgagagctggggcaggttcactcagggtccaggtttgcctgcatcgtcccagaatcctcccatacctgggggagtgggctgtcagtgggagccagtaaaggggcgttgatttctttcccaaccagaagaggcaggggctatagacttaggtggagcccctggctctttgctggctcccagggttctaacagctgggccttctgagccctggggactggctgctcgtggctgagcccttcaagggcattgcgctccttctgcaaatgtaattcccagtctccatgtccaggcccagagcagccctggggagtcctcagggctcattttcctgcaagcgggggagagggggggacaggccctgtggtgattagaggaggctgcctgcgctcacagggggtggttaggctacccagaggaggaggcccctgcaggctggcagggggcctggtggctctggccccagccctgggctctgtggcatggagctgacaccacagacacctgtggggttggaccgctggactagcagcgagccctgcccttccagttggatagcttttccattccagagccgtcagggccgcagggctgagcacgcagctccacgctccctagagactcagccgtcaggggtcacctttctctagtcttgtgggaactgtttttgccctcagccgtgagaggcacttttacacataactcagttggagcatgactggcacgcaggagaaaaacattttgtgtcatttataggccctgcttgggcgagactctgggccgggaacgtccacatgcagccagtgtggggactgttttactctgagcctgaatctttctgctttggttccagatgccgtgtgtagggtgttctgtcaaagggaggaaaaagctcctcaatgagacagaaagatgcaactgggagtctggttttgcatgaggacgtgagcgtttcagttcacttttttttgtaagcatggttccccagtctgacctcagagctgcctggagatgggccccacccgcttcccgttaattaacaggctggtgctcggtgtggatgctggctcctccgtctccctgccctgggcccttttgaagctgaagtgttccaggggcagctggtgtggaaatagagttttctagaggttttagagttgagaagaaacctaaactcttcttagaagcatttcaagggtttgtcaccaggatggctctctgcaaatttgaggtggttctagaagatcttcccatatttcttaatccagagggagatggggatgggcgagaaacggctttgtccttaaggaagtcatgttctggttggaggacaggcacggcctagcattgaagctggtgagtcagagccggacctgtgagcggggccagaatggggcgcgggcttcagacttcacaaagcagaccacgcggcagcctggggctttagtatccaaatgtcctgccctccaggtttcattccttgccgtaaaatatcacgttaaaggaaaatgttttgttaaaagaccacagtcctgtcacctgagcacagtcgctgttctcggttcctctgtggctttccaggctgcaggtgcccattggtattgcggccgtgcgcccggcgggcatgaattagctgtgccgcctggctgctgacgggacgcctcgcctcgactgaaaactacctggagctgctcacccaggggcaacgtgaagaaaacgtgaaattctgtcgcttgttgcagctgacagcacggctgtgaggtcccagtgggcagaggcctcgtgcagggcacctcaccagccgggatgtcagagctggccagaaggagcggtgcccatggagggctgccagtgcccagagagccttccgaggtgtcacgttgggcagtgaaattcagagtcgggcagaggaggccctggggtcacacagggatctcctccaggctatgggttggtgaggtccagtgtccgggggtgaaggatagaggctctgtggtgagggctctggagctggccctgggctagcggaaacgcaggtaacgaaggaggctgtgctggtgggacttgtgcctgttcccgagggaggcattgtgagtgatgtttaggccaagaggattcaggatggaagacatggcttggtttgtagttgggagccggccaaggagtggtgttgagaaagtgcagtgtcaggcagacccgggaccgtggcggtgaggaggtgcagtgtcaggcagacccgggaccgtggtgatgaggaaatgcagtgtcaggcagacccgggactgtggtgatgaggaggtgcagtgtcaggcagacccgggaccgtggcggcgaggaggtgcagtgtcaggcagaccggggacttggagcacctagttccacttgcgggctgacacttctattttttgtcatcgtgttgggagcttaggaaagtgacttaacctctctgtgcttcagtttgtccgttggtagaaagggggtgattatactccccgctccatggggtttggaggaaggctgtgtgggttgtgctgagcagcgtgatggtgcaggctgtctgggtcagtgccgagggagcgagtcttccttcggcggttgtaatcagaagtagcttccaaggctgggtgctgccaggaggagctggggtgggtgaaggggcagtggggagcacggctcacacggccagcgggtgacctggggaggacggaggggggtgtgctgggcgcttcaggcgtgtggctccctttcctgtggggcgaaggtcaggaggggggcagggcctggctgtgtcagaatcactcagactcttaagacacatccagagtccccagccccaccccaacccaacgcacccactccaccagaagaaacggggcaggtgggggccaaatctgtgagttcccaagggaggactgtgtggggcaggttgtggggggcggcgctagcatggctggaaacatctcgaggtttgaagccagagcctcaggtgagactcaagggtccctgggactccctcctgggtgtctgaccgtttatctttcatggagttacaggcgaagacatttctgtgatgtcttgaattctgctttttcctgattttgagcaaatgaaagccagctgggtgtagggagtcaggtgccttccccaaggaaggggctgagagggtggtcacaccaggaccccaagggacagggagcagcgttcccaggggcacacaggcggcctcctagaggtagggatgcgttggtggcggggggggccccgcactgctgtgtgccttcaaggtggcactatttacgtggcccctgagctgcagggtgaccgctagccctgggctgtgtcctggctcccccgcccctcctgaagtgacccccatgagacagggcaggtatatcccacgagcctctgccgcccagcgtggccggggctcagtgggaccatggcggctgcgatgctgctctctgcagctcagagtcactctcatccccagcagtcgagtgcagagcctgggcctccggcctccccaccccctccacacagccccaggaccaaggcagcagctggcttcggtttctgccatgtttttccaattatgtggaatgagctaaaaacagcaggagtgaggccttatttgggagttgccaccgccatcctcggaagctgctgttcctcactgccacccctccagccccatcctctgtggaacgtgcccctgttcttttgacttttgtctcctgcacatccctcctgcttgggggcctttgggcagtgggcttagcggcgtgcaccatgccactcgggccacacatgccctggccggtggctctcagagctatgtccagagggtggccaggcagtgctcccggcagcgcccagatgaggctggggtgcggcttggggatttgtgggccgctggccacagctcacccagacagagttttaacagatgttcgtctgtcagggacaggaaacaaaaagaagtcggggatggagtgggggcagcgggaggaacagagggggccactgtcgagtctgacgggcagactgacagctggagccgacggcaaagcccctcacgtccctccgtctgtccgggcggattagctcaggaagcagggcccgctcagctcggggccgaataacgggcgtttgttcccagagtctggctgtcttgtcacttatcagggaagtaggtcaaagggaaaaaagaaaggaggtcctgtggggccgagtctgccgcggccgggcagtgattggcgttgactttgcaaacagaaggcagctgctgttctcagccatggaccgtgaatttttaatagcaagaaaatcagctcacacggttcaggaagttgtggaagaagcctgagtgctaactttatttttttaattgaggtataacttgcaggcaataaaacgcacacattttaacgtgtacatttggattaactttgacagctgcatatgtctgcataactaccacacggtccagacagagaacatttctaccactgggaaagttcccggtgcccctttgccatcctcaacccccgccccctccaccactctcctgacttctatcaccttggattagcgttgcctgttccagaactacatggaaatggaaccacgcagctgtgctcttctgctttttggcctgaatactcactgtcagggctgatgcaagaggagaggggcgcatcatattcctggagaacgctgtcaccgtggagcgggggcacagggggaatggcatctctgggatgggtgaatgctgtgggcgcctttccacaggctcagagttagactgtggtcactggttttgtcccctgcagcctcttccatgtcccccttgtgactgcagcataagcccagctccatgcggaccccagaccagctccgcagctccaacagcttccctttatcttcagtggcgagctttgcgcttgcagggtgcggggcctggtgggacgcccacgttgcccagacagaacccttgtgcggctgcgggcactccttgccctttccgcatttggtgatgactccttgtttcgtttcactgaccgtgccctgtgcctctgctctccctccccagttccgtgtgccctggggtcagtgatagaagacacggcccctggaccccaagtctgctgagctgacacctcgggctgccgctcacctgcagagagacactagaaggctccgactcccttcctggcccccactctgtttttctaccttttaccgcctattccaatggaaatgcacgatttgtttctccctgtgcacatctgagtgtggacctccctgcccctgctcgtgctgtgcccaccacctggagcacccttcccctgccccctgcccccggccacagcgcccctccatccagaccccactcctgcacacggctcctccgcccgtgcgcagccctctgagagtgtggcaggtgcaccaggctctgctctagggagcttcttcctcttcctgtgtcccacgggaccaacatcgggacccaggaaacaggctgggagagttcggtaacaccttcaagagggtttgagagctgaggttctttggtcttcagtggagctggcagtgactttcttgactttgtcaagagaagccccccgtctctgtgccacctctggggatgtgattgaacggaaatcagagcatccgagttccagcctcagccctctgctgtgtggctgtgaaatgtaggccctgtgtgccttgctgacctgggagggtcgaaaggacggtgtctggggaaggatgcataagttgtagagtgccctgcacttgtgataggtggggccgcgtgaactgctgatagccatcttctgtcagttggggcagtggcattgtcacatggttccattctaatccgttattttggctactgccactgaggcggggtgggtgacaaaagtaacgtttcttgggggccactgcagcggtcatggtcctgagccctatacccaggcacgcgtcctgggagctgtgtgaggggtcgtccgtggctggccctgcttctttttttttttttttttttttttaattgagacagagtctctctctgtcacctaggctggagtgcaatggcgcgatctccgctaactgcaacctctgcctgctgagctcaagcgattatcctgcctcagcctcccgagtagcttggactataggcacccgccaccacactcggcttattttttgtatttttagtagagatggggtttcaccgtgttagccaggatggtctcgatctcctgaccatctcgtgatccacccaccttggcctcccaaagtgctgggattacaggcatgagccaccatgcctggccggccctacttcttaaatgggcctgaggcacatggtgccgagagctcgctgaggtctatggaggaagggcgcagatgggatctgggcctggcgtcctggccggcccccaaggccttctccacagagtttccatgtataccggggtggccttgcggaggggcgcagccatgcgtcaggctggagccagctgcagaggccacagacagggtgtcatgagcagtacaagtaaccgctgctgtccattgaacacctactgtgtgcctgggttcagaaaggcaccctgtgctggcttttaaagaattaggccgcctgcctaaaggggggagtgtggccttctttttcatttaagtcaccaactgttttatacatccacgcccctaaattcttcagttttaggcaaagatgagagggctgcccaggcgtcatttgctcaacaaaaccacacttcacttgtgaggctgtgttccctcaccagggtccccagcaagggggtgtgagtgtttagtaccacagggagggctggcgcggtggctcacgcctgtaatcccagcactttaggaactcctcacctgaggtcaggagttcgagaccagcctggccaacatggtgaaatcccatccccactgcctgcctggggagtggccatgcagccatgggcctgaggttgtggtggggcatgggggcagaggcaggcagtggggggccacaggaggggctggctggcaccgagggatgggagaggaagggacccgcctgcaggtcccttcctgaggccggcactgacttggtcactctctggctgccctgaccccaggcagagcagcgactttcctgttttagagctgagcagacagagcccctgactgcaggccaaggtgcctgccagctgctcctggagggccatagcctctctgtgcttgctggaaggtcccaggcaccgtgcaggtgacagtggccggcctcaggttccagcagagccagcatcgggcccagccacttcccttgtgctttgtgaccctatggtcacttggcacaggatcccgggtcaaatgctgcggttgcggcatttgccccaccacttacccctgggggcagcggagaaacttaatcaattgctaaacaacaaaaataatctggccgcctgccagctgggaagccactgtggccaggctgtttatggccttgggatctgcgcagtggacagtggcctgcaccgtgaccccgttcatcctgcgtgccccaggcccaggaggtggctcaagccctctgcctcctgtaagggcacctgagaaggaggccctggagctgggagcagagctgggggtgggcgtccgggcagcagaggccgattctcagctttccctggatctcagctttccccggatctcagctttctgctacccgtgtgaaaagaagccaggagaacacagctatcctgggttggtgccggctgtggtgggaggcctgcggtgggagcctccgggggccactggacctttcctgggtggcctgtggcctgggagctgcacttggttcggtgcagggaggttgtgacatccactctgtctgcagggatggccggggccctgcggctgggtgatgaggtgggatggaggtgtccggggctgccctgcctccttttgccaaaataacaaaaattatcttgtttgttgtgaaaaaacctgttttcccacattggggcatggagggtattaactgtgatgaccttctgagttcctgcacactggtgacccattggcagggtctcctcctggctctggcaggggtggctcaggccgctgggtgacggtgtgctggccagatagttcctggggctgcaggtggcttctttcgccccatccctcccatcccctttcattcttcctgtcaacacatctcagaccctggacaccgaatgagccgtcggtacccacaccccagggcaattcagtggaggggtaggtggctcgttcccccacgttgccccaggaagaggaccctgtccccggcatcctgacccacctcccttagagaccgagagcctctaaggataaacccattcacccgtgtttcagaggcttttttttcctcttataaaataacatttatacgttcgctgtagcaaggaaaacattataaaaaatagtgaagaaaatagaaattacccataattttgccacacagacttagttgtgtccatgtatcttgtgcaccttttttctgtttacggatcaaaatcgacttttagggtcaggcgcggtggctcacacctgtaatcccaacactttgggaggctggagttggggttggggggtggatcactgaagatcaggagtttgagaccagcctggccaacatggcgaaactccatctctactaaaaataaaagattagccaggcgtggtggtgggtgcctctaatcccagctactccggaggctgaggcaggagaatcgcttgaacccaggagacagaggttgcagtgagccaggatcacgccactgcactccagcctggcaacagagcgagactctgtctcaaaaaaaaaaataaaaataaaataaataaatacataaattgacttttaggagattggttcaaacaatgtgtgtaatgttgtgtctgagtgtttttcatttatcgttcatgcaaattccgacatcattcactcttctccagagtgtgctgttttcctgcctgtgtcatcacccgtcaccttgaatgccctcgtttaggtaaaataagtacattttattcaaaaatatttgaggacatttgggttgtctccaggttcttggtcttgagttttgctgttcttgtggagccatggtggtgtctggttgcaggaacctccatgcgttccagctgctgcttctgcctgtgttcttagagaggaaatgctggggtccgcggttcccgggctgctgaccaggaagcctgcggtgctttacggcccttccagaagcgggagatgcccccacttaagtgtcagacaggcctttccacctcactggcagctctgagcggctcccttctatttgcagatgactgagaagttaccaatttccacgtttactgactgctgtttctcctgttaatttgtatttatagtcttcgctaatttattgctagggttttggtgttgtccctattgacttgtatgccttttaattttttaaacaacattaatagacttcatttttttagagcagttttaagtttacaggaaaattaagggacaagtacagagagttccttccacctgctgtcctcctctcctcctccccaccttccctccttcccctattgtaactttctttctgatattataaaagtcactcatggctgggcgtggtggctcacgcctgtaatcccagcacgttgggaggcagaggcaggcagatcacctgaggtcaggagttccagaccagcctggccaacatggtgaaaccccgtctctactaaaaacacaaaaagttagccaggcgtggtggcgggcacctgtaatcccagctactcaggaggctgaggcaggagaatggcgtgaacctgggaggcagaggttacagtgagtcgagatcgcgccactgcactccagcctgggcaataagagtgaagcttcgtctcaaaaacaaagtcacacacgcttcttgtacgagggtcatttggccgaggggccagatggctcaccatctagttgggacaggccatgagctcggaatgctttttacatatttacatggttgagaagaaaatcaggagaataatgttttgggacatgggaaaatgacatggaatttgcattttagtgtccataaatgaagttttgtttgctcccagctgtgttgactgaggcaggctggcttcctacagctgcggcagagctgaggaggcgggaaggagaccgtgcaggccgcagcaccgaaaatatttgctctctggcccttcccagagtgcttgccgacctctgtccgacagctagaaggaaggataggacccgtccgacgataaccactgttgacatttgagcgcgtttccttcccggcttttgtgtgagagtggcagtctgtttgcttttgtggtcgggatctgctgcacgcacggcgggctgtttgcatgaggcttcctggaggatagggctgggctcggagctgcacgcagtggggcgtgtcctgcatgcagtggggcctcagaagagagctgtggtgggcggggcagtgccaacgctggtgggtgccaggcctccacgctcagatcagccccggcgacaggtttgggccaccctctctctggcctctgtgcagtggcccaggccgtctgctctgcctggcacacttgcctctgtccttccactgaagcgctcctcttaccctctgctcccggctgggtacgttgaattgtgtccctcaaggagatatgctaaaggtctaaccccaggaacctgtgtatgtgatctaatttggaaacagggtcttggctgatgtaatcaagcgaggatgaggtcaccctagagtagggggcctatatccacggtgctggtgtcctcatgagagcaggtgagcagacactgacactcaggggtgaaggctgcatggagtcagaacagggcttagtgcgatggcggccacaagccaaggaactccaagtatttcctgcaacaccagaagctggaagatgccaggaaggatcctgccctggagccttcggagggagtctgtccctgcagacgtcttgacttttgattgcagggatgcatgtcttagggtgtgtgggggggtgcatttctgatgttagaagccacctggttggtggcgatgtgtcacgggagccctctgcaggttctgcgtgtccatgtggtcggggacagaggtgggcagggacggacggtgtcgagctggacatgtccatgacgtcggccatcccttgggatggcttttttgttttgaggataaggctgcctgccaggaagctgtgccctgcctggcccttgccccaagcccctggcctgtgcttggcctcgcggaagggatgtcgcccttctctcctgcatgcgtgcagggaggaaggggagaggtcagcagcccgcctggaggaggctcgggcgaggggaaggtttcactttcaggcaatgttgtggggctgtttaaacaaccccaaagaaaaccatttggccaaactgttagtttccaaacattttacttccttggtgtttaaataaattcctaccaagactctgtagctggtcccagggaaggagttggcctctcttctttatagcccggcacagtcagtcccctgcacctgcccctcccaaccccaggcctgcttccccgtggccatggctgctgcccggacctctctacacacagaacctcctggaggccagctgtgggcaccagccttggcagggctgtggcggagcccaggctgctggtactctctctgcagctgctccctgctggcctggctggacagagtccccaccaccactggggtcacctctgtgctggtcacagctcactcagaccttcaggcaaatgggttggatcctgcctctctcccaggtgtctcagtctctgcaaaactcaaaaacctcagaggccttgcagcctgaggggtgtcagagacacctccttcgaatcagtaaacacctacagattcaccccagcagtgaaaggactgcttcgccacagaggtttgatttactcctaagtaattggaagggatgccgagaataggttcctcatggtgggactagaggccctctgctgacctagttaacagagggctagggctgggtgtgctcagcccctgaaggttctaggcccatttgggacaccccgccagaacctgccacaacctgccatgtggtgacagctacctaaatcccagaggctcttgagctggagagcagacctctcaatctcagcaggccccccacacagaccccataaccctagtctgccttcacagtacagttcgtggctatgtgttcacggatggtgttgttcacctaaggtctctgccctgtgaccccaagggcgtcctgagggcagattccaagtctgtttcgtccacccctccttccctagcagcgggtccagggcctggcctgaactagcttcccacagagatactggtgggatgatgaaggcagccaggcggcaagtgaaaaacgcacttcctgcatgtgctggctcctgggattgaagtgtttgaggaagcaaagtgaagtgagctttcctcttgcggctgtgtgtccttgggccgggagcctaccctctctgagcgttggggtccttgtcagtagaatggggcatcctcatagctcaaggggtggtgtgtgaaaattgtgctattgtgttactttaatgattttttttttttcgagacaaagtctcaccccaacgcgcaggctggagtgcagtggcgcgatctcagctcattgcaacctctgcctcctgggttcaagtgattctcctgcctcagcctcccaagtagctggaattacaggagtgcgccaccaggcccggcatatttttctatttttagtagagagggggttttaccatgttggctaggctggtcttgaactcctgacctcaggtgatccacctgcctcggcctcccaaagtgctgggattacaagcatgagccaccgcgcccggcctactttagtgatttcttaggaggacagagggaacgggctggcaagacaggcttggaatgtgttttgggatcaagtgccggtttctgtctggcactggcgttctctgtggggccatgatggacacactgctgaggtcaagcgtgattcgtcttgcgctgtgcctggcagtctcattggaaagttctgtagacatcgtgtggatggggctcttcccggccaagcccttggggaccttccaggactgtgatctccccacagtggctgttaagcagggacctttcgtgaagtggagtctctggtcccctccaagtcatagctagacagggactcgggcatcgccaagcctggctgattattcactggatgaggagacaggcccagagaggggcaggaacctgcccgaggtcacccagcaggccccagaggtttcggtctcggattctccctgctcatccctggatgtagtgctgctgtggatgtggttctgtgctgggggctgtggagagcagggggcttgtgccaggaccccagtgagggtggcgccctcgccatgaggccgactgttggtatggggcggccatccactggggtgtggggaggaacagctttcctgaggaggaggtggcgggaggaacagcttccctgaggaggaggtggcggtgctgtgtgacctgggccttgaaggacaggtccattgtcaacagaacattttgggagtggagcctagagggagaaaatttgttgaaattcagattcccctccccctaccaatacacaccaaatcagatgcccctgaccagatctaaatttggctctcagagatttccattgtagctgggcacttggggaaccttctaagtgctgcctctgcctctccccagcctgcctgcctcagtttccccagccctgggcccgtgtcgctgttgccatcacgtgggcgccctctagtggaggaatcagattatgcactccggggcttggagcaggagtcaggaggggctcctgtctttccttgaaacgttggatgccgggatcctggaacagtctctgcattcctcctggcgagaaccagagcctgggcacaggggaccatctgttgtttgaaggctgcagcctggcagggcactcaggagatctggcagttggctgcagggccaggtctaggggccagggcatcagggaggctctgggctggttcagccccgggcccctttgcagattgtgacctgggcccctgtgcaggggcatggccacaggatgctgggaggggtctctgaccctgaccttcttggctctgtgcatccttgagaccagaaaggtctggaacaaatgagtagacgatgccctaacctggggagggagccacatcctgatcccagcaacctcgggaaggatctgtcaggattatggggcaccctgggggccccaagtctgcatgggtctccacttgcaatttctgtaggaagctctgataaatccaaactgggggtcctaggacacagtcagaaatgctgataccgttgtgtgtggagcctcgggccctgggggtcaggagcatgtggagggtgggccacgggggttcagaagagaatcctgtaaccccccaccccccaaactgaagcccacttgagggccatggctgaaaggttggggggtctccgtgcgtcctgtggagtgggtggtgaggagtccttgggtttgcacgcctctgggcctgagcggcgggaccccgtccacagcggatccctgggccctgttgctcagatgctctcagagtgttgctgtggccacggagggagcctgagttaagcttctcttgtgccggttgtacgctgtcaggtcacactggtgagttaggcagggcacagatgcccagagcagagggaactttccttggggattcaacacgtgcaagtcttaggggctggcaaatcctgccctcagctagagagggggcttttatttgagaccagaatcacctgagcatcctcctgtccccagctgtgtccagcctgtctgcagggacatcctgagaggaccaggctctcccctcatccacctgcctaagtgccactctgaaccctgtccacctgtgccgtggaggggcgtgacctcaagctgctcagccagcagcaggcttggccctggggggcagcagagacccaggtggctgtggggtgggtgcttcgtggcgtggttctgaaacttcgttggaagtgtgtggacagtgccttgcctgttctctgtgggaccctatttagaaacgaggtctgagttactgggggtcatcactgtgttctgatggcccagctgtgtggaggccgcggtgcagccccatccaaggagccagggccctgggtctagccgtgaccagaatgcatgccccggaggtgtttctcatctcgcacctgtgttgcctggtgtgtcaagtggtcgtgaaactctgtgttagctcttggtgttcctgaaagtgcccccgggtctcaggcctcagaaccagggtttcccttcatctcggtggcctgggagcatctgggcagttgagcaaagagggcgattcacttgaaggatgtgtctggccctgcctaggagccccccggcacggtgctggggcctgaagctgccctcgggtggtggagaggagggagcgatgaagtggcgtcgagctgggcaggaagggtgagcccctgcaaggtgggcatgctggggacgctgagcagcatggccagcagctgggtctgcagcctggtacccggcgggacttgtggttggggctggtttgtggccaggagaggggctggcaggagacaagggggactgtgaggcagctcccacccagcagctgaagcccaatggcctggctgtgtggctctcagctgcgtgcataacctctcagtgcttcagttctctcatttgtaaaatgaggaaacaaacagtgccagcctcccagaggtgtcatgaggatgaacgagtgaccatgtagcatgggctgggtgcgtgtcacctaacatcaccagcctttgcaaggagagccctgggggcctggctgagtatttcccttgcccggcccaccccaggcctagacttgtgcctgctgcaggcccttgacccctgaccccattgcacctgtctccacaggagccgaggaggtgctgctgctggcccggcggacggacctacggaggatctcgctggacacgccggacttcaccgacatcgtgctgcaggtggacgacatccggcacgccattgccatcgactacgacccgctagagggctatgtctactggacagatgacgaggtgcgggccatccgcagggcgtacctggacgggtctggggcgcagacgctggtcaacaccgagatcaacgaccccgatggcatcgcggtcgactgggtggcccgaaacctctactggaccgacacgggcacggaccgcatcgaggtgacgcgcctcaacggcacctcccgcaagatcctggtgtcggaggacctggacgagccccgagccatcgcactgcaccccgtgatggggtaagacgggcgggggctggggcctggagccagggccaggccaagcacaggcgagagggagattgacctggacctgtcattctgggacactgtcttgcatcagaacccggaggagggcttgttaaaacaccggcagctgggccccacccccagagcggtgattcaggagctccagggcggggctgaagacttgggtttctaacaagcaccccagtggtccggtgctgctgctgggtccatgcgtagaaagccctggagacctggagggagccctttgttcccctggcttcagtttcctcatctgtagaatggaacggtccatctgggtgatttccaggatgacagtagtgacagtaagggcagcctctgtgacactgaccacagtacaggccaggcctctttttttctttttttttttttgagatggagtctcactctgtcgcccaggctggagtgcagtggtgtgatctcagctcactacaacctctgcctcctgggctcaagtgattctcctgcctcagcctcctgagtagctgggattacaggtgcctgccactgtgcttggctaatgtttgtatttttggtagagatggggtttcaccgtcttggccaggctggtcgcaaactcctgacctcaggtgatccacctgcctcagcctcccaaagtgctgggattacaggcatgagccaccacgcccggtcaggccaggcctcttttgaacactttgcacaccatgggtcttttcatccaggggggtaggtacagttgtacagttgaggacactgaagcccagagaggctcagggacttgcccagggtcacacagcaggatgtggcaggtgtggggctgggcctggcagcgtggctccagctttccagcatagaaatctgtgaaagcagatagtttgtcggtcggtaggggagactttctgagacccgccccagcggctcagagggtagtagccaggggccttcctgggggctcataacccagaacactgaatgggaaaaccctgatggaggaggcgcagtggagctgtgggtgccgatgggaagtcccagaggagctgggaggtcagtagcggtgctgccctctgtggagcacttagtgggcaccaggtgtgtttccaggttcatggccctgggacctgaagctcagaaggtgaagtaacttgcccagggcacccgtcgggcagcggcgggcagaggatttgtgggctgtggagcctgtgctcgtggcccagccctgggggttgtgagtgtgctggccggggagcttttcctgcaagtggactggtgtctaggagccagcatgtcaggcagcaggcagcgggagtgcagcaggcagcgggagcacagcaggcagagggcggggctcgagcagccatccgtggaccctggggcacggaggcatgtgggagagggctgctccatggcagtggctgaagggctgggttgtgccccgaggagggtggatgagggtaagaagtggggtccccaggggctttagcaagaggaggcccaggaactggttgccagctacagtgaagggaacacggccctgaggtcaggagcttggtcaagtcactgtctacatgggcctcggtgtcctcatctgtgaaaaaggaagggatggggaagctgactccaaggcccctcctagccctggtttcatgagtctgaggatcccagggacatgggcttggcagtctgacctgtgaggtcgtggggtccagggaggggcaccgagctggaagcgggaggcagaggggctggccggctgggtcagacacagctgaagcagaggctgtgacttggggcctcagaaccttcacccctgagctgccaccccaggatctgggttccctccttggggggccccagggaacaagtcacctgtcctttgcataggggagcccttcagctatgtgcagaaggttctgctctgccccttcctccctctaggtgctcagctcctccagcccactagtcagatgtgaggctgccccagaccctgggcagggtcatttctgtccactgacctttgggatgggagatgagctcttggcccctgagagtccaagggctggtgtggtgaaacccgcacagggtggaagtgggcatccctgtcccaggggagcccccagggactctggtcactgggcttgccgctggcatgctcagtcctccagcacttactgacaccagcatctactgacaccaacatttacaaacaccgacattgaccgacaccgacatttaccgacactgacatttaccaacactgtttaccaacactgacatctactgacactggcatctaccaacactgacatttaccgacactgacatttaccaacactatttaccaacactgacatctactgacattggcatctaccaacaccaacatttaccgacaccaacatttaccaacactgaaatttaccgacaccgacatttaccgacaccgtttaccaacaccgacgtttaccgacaccgacatttaccgacactgatatttaccaacactgacatctactgacgctggcatctactgacaccgatgccagcatctaccaacaccgacatttaccaacactgacatttaccaacactgacatttaccgacattgacatttactgacactgacatctactgacactggcatctactgacactgacgtttaccgacactagcatctactgacactgacatttaccaacaccagcatctaccaacaccgacatttaccaacactgacatttactgacactgatatctactgacactggcatctactgacaccaacatttaccaacaccagcatctaccaacaccgacatttaccaacaccagcatttaccaacaccgatgtttaccaacgccgacgtttaccgacgccagcatctaccaacactgacatttaccgacaccgacatttaccgacactgacatttactgacactgacatctactgatactggcatctaccgacactgatatttaccaacgccagcatctactgacactgatgtttaccaacaccgacatttacgagcaccgacatttactgacaccaatatttactgacatcaacatttagccatgtgatgggggccggcttgggggcaggccttgctcttggcactggggatgctgcagagaccagacagactcatggggtcatggacttctgcttcttctccagcctcatgtactggacagactggggagagaaccctaaaatcgagtgtgccaacttggatgggcaggagcggcgtgtgctggtcaatgcctccctcgggtggcccaacggcctggccctggacctgcaggaggggaagctctactggggagacgccaagacagacaagatcgaggtgaggctcctgtggacatgtttgatccaggaggccaggcccagccaccccctgcagccagatgtacgtattggcgaggcaccgatgggtgcctgtgctctgctatttggccacatggaatgcttgagaaaatagttacaatactttctgacaaaaacgccttgagagggtagcgctatacaacgtcctgtggttacgtaagatgttatcattcggccaggtgcctgtagacacagctacttggagactgaggtgggaggatcgctggagtccaagagtttgaggccagcccgggcaaaggggacacaggaatcctctgcactgcttttgccacttactgtgagatttaaattatttcacaatacaaaattaagacaaaaagttaatcacatatccactgccctgcttaagacagaaaacatgggtgttgttgaagccagaggcagctgctggcctgagtttggtgattggttcctaagcagttgaaggcagttttgtttttccatagatgtctgttctccctttgctgggtgcagcctcgccctgctgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcccgtggacgcagcctcgccctgccgctgtggtcgggtttcagtggcctcgtcctgtggacgcagcctcgccctgccgctgtggtcgggtttcagtggcctcgtcccatgggcgtgctttggcagctttttgctcacctgtggagcctctcttgagcttttttgtttgttgtttgtttttgtttgattttgtttgattgtttgtttttgttgtcgttgttgttgcccaggctggagtgcagtggcgcgatctcagctcactgaaacctctgcctccttgggttcatgccattctcctgcctcagcctcccacatagctgggattacaagtgcccgccaccacgcctggctaaattttgtatttttagtagacagggggtttcaccatgttggtcaggctggtctggaactcctggtctcacatgatccacctgcctcggcctcccaaagtgttgggattacaggcgtgagccaccgcgcccagcctctgttgagcatattttgaggttctcttggtgccagtgatatgtacatgtgtccccatcgcaccatcgtcacccattgaggtgacattggtgcctctcctcggggtggatgcctccctctgtttccagcaacttctgaaggattttcctgagctgcatcagtccttgttgacgtcaccatcggggtcacctttgctctcctcagggctcccaggggaggcccgaatcaggcagcttgcagggcagggcaggatggagaacacgagtgtgtgtctgtgttgcaggatttcagaccctgcttctgagcgggaggagtctcagcaccttcagggtggggaacccagggatgggggaggctgagtggacgcccttcccacgaaaaccctaggagctgcaggtgtggccatttcctgctggagctccttgtaaatgttttgtttttggcaaggcccatgtttgcgggccgctgaggatgatttgccttcacgcatccccgctacccgtgggagcaggtcagggactcgcgtgtctgtggcacaccaggcctgtgacaggcgttgttccatgtactgtctcagcagtggttttcttgagacagggtctcgctcgctcacccaggcgagagtgcagtggcgcaatcacggctcgctgtagcctcaatctccctgggctcaggtgatcctcctgcctcaccctctgagtagctgggactacagacacataccaccacacccagctagtttttgtgtattttttgtggggggagatggggtttcgctgtggtgcccaagctgatctcaaactcctgaggcacaagcgatccacctgcctcggcctcccaaagtgctgggatgacaggcatcagccgtcacacgcagctcaatgattttattgtggtaaaataaacatagcacaaaattgatgattttaaccattttaaagtgaacagttcaggctgggcgtggtggcttatgcttgtaatcccagtactttgagaggctgaggtgggcagatcacctgaggtcaggagtttgagaccagcctggccaacatgatgaaatccagtctctactaaaaatacaaaaattagccgggcatggtggcaggtgcctgtaatcccagctactcgggaggctgaggcaggagaatcgcttgagcccgggaggtggaggttgcagtgatctgagatcatgccactgcactccaatctgtgtgacagagcaagactctgtcttgaaaaataaataaataaaaaaaattttaaaaagtgaacaattcagggcatttagtatgaggacaatgtggtgcaggtatctctgctactatctacttctagaacactttcttctgccctgaaggaaaccccatgcccaccggcactcacgcccattctcccctctctcccagcctctgtcaaccactaatctactttctgtctctgggggttcacttcttctggacgttttgtgtgactggaatcctgcaatatgtggtccctgcgtgtggcttctttccatagcattgtgttttccagattcacccacacattgtcgcacgttatcagaatctcattcctgactgggtgcagtgggttaggcctgtaatcctaacattctgggaggccaaggcgggacgatcacttgaggcaggagtttgagaccagcctggccagcctagcaagaccccagctaccaaaaaattttaaaagttaactgaacgtggtggtggtgggcacttgtggttcccagctacctgggaggctgaggtgggaggatcgcttaagcccaggaggtcaaggctgcagtgagctatgatcgcaccactgcactccagcctggacaacagagcaagaccctgtctgaaaaaaaaaacaaaaaaaaaagttcctttctttttgtggctggatgacatcccattgtatggccacagcacattttgtttgtctgtttatcgggtggtgggcagtggtttccaccttttgtctcctgtgaataatgctgctgtgaacatttgaattcaagtttttgtttgaacacctgttgtgaattatttggatatatgtgtaggggtaggattgctgagtcctatggtaatgttaggtttgacttactgaggaaccattaaactgttttcaacagtggctgcgccgttctgcatccccaccggcagtgtgtgagggttctgactttacctcctcacaaacgcttcttttccatttaaaaaaatattcagccaggtgctctggctcacgcctgtaatcccagcactttgggaggccgtggcgggcggatcacctgaggtcaggagttcgagacgagcctggccaacatggtgtaaccccatctctaccaaaaatataaaaattagccgggtgtggcagcgggcgcctgtaatcccagctacttgggaggctgaggcaggagaatcacttgaacccgggaggcagaggttgcagtgagccaagatcgcgccactacactccagcctgggtgacaagagtgaaactccatctaaaataaaacaaaaataaaaataaataaaaatttattaaaacattcatcacagccagcctagtgggtgtcccatgtggctttgcctcgcatttccctgataactaggatgctgagcgtcttgtcccaggcttgccacacctcagcactttgagatacgtcgcacagtccccatttgcgaacgagaaatgaggtttagggaacagcagctgtgtcatgtcacacagcgagcagggggtctctgagccgtctgaccccacagccgaccaagctccaatccttaccgcctcctagtgttgtggatgtagcccagggtgctcccacatttttcagatgagaacaccgaagctcaaaacaggagcgttttgtccacattggatacacgatgtctgtggtttggtcctgaagtcactttatatctcagtggtccagactggagtaggacagggggttctggggaatggggaaggtgtctcaggtgaaaggaaggaattccagattctccatactgtccttgggaagttagaagactcagagggtctggcaaagtcagacaaagcaagagaaatgcagtcaggaggaagcggagctgtccaggaacaggggggtcgcaggagctcacccccaggaactacacttgctggggccttcgtgtcacaatgacgtgagcactgcgtgttgattacccactttttttttttttttgaggtggagtctcgctctcttgcccagtctggagtgcagtggcacgatctcggctcactgcaagctctgcctcccgggttcatgccattctcctgcctcagcctcccgcgtagctgggactacaggcgcctgccaccgcgcccggctaatttttgtatttttagtagagatgggatttcactacattagccaggatggtctcgatctcctgacctcatgatccgcccgtctcggcctcccaaagtgctgggattacaggcgtgagccaccgcgcccggcccgatttcccactttaagaatctgtctgtacatcctcaaagccctatacacagtgctgggttgctatagggaatatgaggcttacaggccatggtgctggacacacagaagggacggaggtcaggaggtagaagggcggagagagggaacaggcggaggtcacatccttggctttcaaaatgggccagggagagacaccctctgagcatggtaggacaggaaagcaagattggaacacattgagagcaaccgaggtggctgggcgtggtggcttacgcctgtaatcccaacactttggaaagctgaggtgggtggattgcttgaggccaggagttcaagaccagcctggccaacatggtgagaccccgtctctactaaatatacaaaaattagccaggcgtgatggtgcatacctgtaatcccagctgcttgggaggctgaggcaggagaattgcttaaacctgggaggcggaggttgcagtgagccgagatcccgccactgcactccagcctgggccacagagtgagactccatctcaaaaaaaaaaaaaaaaaagataaaaagaccaaccgaggaattgaagtgggggggcgtcacagtagcagaagggggatcgtggagcaggccaccctgtggtcatgcactggaagctcattacctgacgatttggagctcatcactgggggcctaaggagaatagatactgaaggatgaggagtgatggcgcggggcacgggtgtctttggtggccagaacttggggactgctggggtgcctcactgcaggccttctcagcgccctttatatgcttacacaggctgtttctaagagggggatacattgcataagcgttttcagactacctcatcatgggtccctttctttaccctctgtggccctggtggcgcactctctgggaaggtgcaggtggatgcccagacccgccctgccatccacctgcacgtccagagctgacttagcctcgagattgctgctggcacctcctgccccgggacacctcggatgtgcccgtggagatgctggctctgtgttttctgctggagtttggtgcgtcttttcctcctgcaagtggccaccgctcttgggtatgtcctcaggcttctgcgagtcatggctgcttctcaggtccttgcccagcgccaggagcaaaccctcctggcactttgttcaggggtggatgcgccagtgttcctgctgtggacccccatctcacatgagggtcttgggcctgcaggctcgttcaggaaacacccgctgagtacgcagtgtgtgccagctgtgtcccaggcaatggcggggacagtggctgctgctggggttgtggtggcttctggggactctggggacagctgaggtgcaaggagccacggctccttgaggatgcagttggactccaggtggaagggatggttgggggaggtataaatggggtcagggaggagacacatttggaacaatgggaacatttttaagatgctatgtcgggaggcaacaaggtggccaacccaggtgctgaggagcccacaccagccctggacgtgttttgccgctcacctttgctggggagtggtgggagagaggattccgttccacgtggtggtgtgcgcagctgggctgtgtggagctgggcgctaggaggaaggtgctttctgcggggctagccgggctctgcctttgaacacaatcaggctccaggttttcagcatccagtgcatgagaggacttcacgggcagctgtggctgatcccttgatgaattgggagaagaacaaaggtctatgaaatgaggtttcatgtagatggcattagagacgcccacaacagatttacagagtggagcggagacggcggatgggtctgggaggcccctcctgctggccttgactgtgacagctgtcctgggaatcagcttccaggccgccccagcagcctgactgacacacacaggggttttagccccatcctgcgaccagctgttgccatcatcagtgacagctgggagtggcggtggttccagccctgggcaccctccccacctgctggggcccacccagggcagtcctgacacctacaggttgcttggagccgcatccgagtcctgccccaccacgtgtgaagcccgagtggtcgtgggctgaggtcccctgattgcatccccacttcccttctgcttcacatagctgcctcttctcaccgtttttccagcctcctgggctaggaattccagtgttgtgctggctttgccccaggacacctccttagccctcttcctgagtctagagccccgggggttggaagttctggcccctgggacacctgcagccacactcagcttctcctgtgagcctccagcatgtcccctcaggaccaagccctcacgttcttgcctccccgcccacctgggctcagccaggggaaggcctggctgggagcgtctcccctctgccctgcccttctcccctctaccctgcccttctctcctctgccccgccatggcttttatatcctgtgccacaagacatggctgtgtgtgaaagtggcagggtctggcatctctgtgggtctctgaggcccacgctccagtgccactcttcccacccgctggccgtgccctcatgctggagggacagcccagccctctcccgaaccccagccccatgtgcccagctgcccccggccctctcccctggaagccggggtcactccagccgtatgccatggtggggacatcctgcttccttggccttccagggaaggtcctctttccaaatggcgacacctggtccctgcctggaggctggaagctgtggcccttgtatgcccctccagggtctgtgcgctcggttggcccgagttcccatcaccgtcgtcatcatcaccatcatcattgtcatttcgcttgtctgtgagccggcctggtctcccagagcagagaccctctgaggtccagcctgagttggggtctccgtgctgacccctgacggggactcaggacgtaccaggtctgggtcaggagtgacccccaaacctcgtgccctttgacaggcacccctgacttttgctaagtgggtggaggtgacatcacttacagcgggagtgatgggacagggtctgttggctgcactgtgctcccagggatctggggagaggctatatccctgggctttggcactgcagagctgtgtgtgtttgtgtgtgtgtgtgtgtgtgtgtgtgtgtgtgtgtgtgtgtgtgtgtttgcgtgcgcgcacatgtgtataagatctttttttattacatgaagcaagataactgttgctgtttccttttgggttttgtgttcaacagagtggggtacttcttccctcagacaacagaactctcccctttaaacacgtgctgtcagagggtgggtcttgggctcatgtctgtttgcacagccgagtcagaggaaacacagggttcttcataaaaacactgcacagcaggcgactgtccagagtcagcctgcaggacggcagcagccctgcccctcagagcacagctagggtgggctgctttgggatctcccgtcattccctcccagctggcagccggcggccggcccattccttggtgtgctggtcaggggggcgtgcgcctgctctgctcaccctgggaatgggacagaagctggcagctcggagaggacagggctggacccttgggtggcctctggctggaccatctcattgtcctcagacacagcctctcgggtctagtttcatttcctgaaaaacaagtgcacagaactagagcaggagtcgagagctacggcccccgggccagatccagccctgccacctgttttcacaccatgctcaagctgagtgggttttacattttttaattacttgaaaaaaaaaaagccaaaggaggtttcatgacccatgaaaattatatggaattcaaaaaaaaaaaattatatggaattcaaatttcagtgtccataaataatttcttgagacagggtctcgctctgtcacccaggctggagtgcagtgctatggcatggctcgctgtacccttgacctcccaggctcaagcgatcctcctgtctcagcctcctgagtagctgggactacgggtgtgtgccaccaagcccggctaatttttttttaattttagtaaagacagggtctttctatgttgcccaggcttttctggaactccatcttggcctcccaaagtgctgggattacaggctcgagccacggagcccagcctgtttttgttttttcactgataaagttttgccgggtgtggtagtgtgtgcctctagcgatttgggaggctgaggtgggaggatcgcttaagcccaggagtttgaggctgggctcaagtgatcaggaggtgaactatgatcatgtcattgcattccagcctgggtgacagagcaagaacctatctcttaaaaatatatatttaaaaagtattgggtgtggtggctcacgcctgtggtcccagctacttaggcatctgaggtgggaggatggcttgagcccaggagtttgaggttgcagcgagccaagatcgtgtcactacactctagcctgggtgacagagcccagaccctgcctctttaaaaaaaaaaaccaaaaaacatgtattggaacacagccatgcctgttcagtcacgtgctctccatgctgctttctgctccagagacccttatggcctgaaagctgaaaatattttctatcctttacaaaaaagtttgctgacctctgtcctggaaaattcatctcccaagttctcttccggcactggcgttcctgggtgtcctaaatttggcccctgttatttctgaactctgttttggctctgttccctcccaggagccaggacaggcacgttctctgcatcttgtcccctgacgcccagaggcttggctcggctcaggcattcttggaaatatctggctccaggaaaggcagaggcctcctgagtcggcccagagggaacctgccccaggtctgggggaggcctgacccagcagagtggcttttgccgatgggttgggccggtcaagatgtgctgaaagttgtcctcagaaggccactttgggattccttcctccagtattagagcaactgagagctgctcattgcaagcctgatgttttcccagttggccgggtccaccgggtgccctgggattctgggatctgggtggaaagtagggggcttgggggagtgtcctgggttctggaatccaggtggcaagtggtgaggttcagggagtggcttctgagccaccataggggtctctgtgggaggctctgcccatccaggagattccgcaggccctgccggcccagagccagcgtcttgcgcttgccgaggctacagccagccccagccgggtggaacagcccgtcgcctcctctcactttgttttggggccacctgggagtgtggagcaagggtagagagggaggaagtggctgccggccgctgcccagcacccttgtttgccttgggccctctgtgggctcctttttattgctcttcaatgaagccagggaaatggacttccttgcctcacttcagttcaacatgtctggaagtttggtattaaaattaagaaagtgtggaaatagagcaagaagagaaaaatctctccaagagataatagtgacctctgagctgggcgcggtggctcacgcctgtaaatcccagtactttgggaggctgaggcgggcagatcacctgaggtcgggagtttgtgaccggcctgaccaagatggagaaaccccgtctctactaaaaataaataaataaataaataaataaatacaaaattagccaggcatggtggcgcctgcctataatcccagctaaggcaggagaatcgcttgaacctgggaggcaaaggttgcagtgagccaagatcacgccattgcactctagtctgggcaacaagagtgaaactccgtctcaaaaaaaataaataaataaaaaataaaaatagtgacctctggccaggtgtggcagctcatacccgtaatcccagcactttggaaggaaggccgagatgggcagattgctttagcacaggagtttgagaccagcctggccaacatggtggaaccccatctctacaaaaatagaataaaatttaagaggtaatagtgaccttttggtagatcgaaacctggattgctttctttttctaaatgctgattcttttctttgtggtgtttgtgttctgtgccgatgtccctcccccagccctgttattgtgagtggaagaaggggaaagggttcgcccgctactgtgagcccctcctctcacgctgggtgtccttggagaagcctgcacttcttcattgtacgccagggctgggtccctccctggagtggttctgtgctgctgggatggggccaacccctcagatgttttctgagtgtcacacacaggtgtgtgcattcatggcctttgcgtgtcttcctgttgtggaggcaaaaatgtgaagaaccctagatgattttgggaccagggctccatcacctgctgttcattgcacaccggagcatccaggcatgggtggagagctcagacttccaggcacggtcgcaggggctggtctaaccatgttcccgcccgcctgctcgtcagaaccgcctgttgggagctgttatcatgataccatacctgggccctgggctatccgattctgacttaattgctccaggttggggccaggccgttgtttgctgttttgttgtttcttctgtgacgttagccactgggctaatctgagcccctcagttacaggtggagaaactgagacccatgggggtgcaaggacttgccgaggacccagagccccttgggggcagagctgaggcggggcctggctttgggtcccagagcttccagtccccttcccgctctcctaacagcttttttttttgagacaagatctcaccctgtcacccaggctggagtgcaatggcatgatctcggctcactgcaatcttcgctagctgcgttccagcgattctcctgcctcagcctcccgagcagctgggattacaggtgtgtgccgccatgcccagctcgtttttttttgtacttttagtagagatagggtttcaccatgttggccaggctgatctcgaactcctgacctcaaatgatccgcctgcctcggcctcccaaagtgctaggattacaggctgggatcacactgtgcctggccctagcagctttgtcctgtgccatccaacaacagatgaccgaagtctttgtttcttaacatgcattccatctgccttacagttttgccacctgcaaaacagaggacttgtcgcttttctggtaagctggaaatgtaatctggtagcaggaggcctgtggaagcttgcctttaatggccttgtgtctctttcatcctgtcctgagagccggagaacttggatgttgcacctaactcaaccttcctgttaacatacagttctgcaggctcatggatcatcagaaccacgtcctatctcacgcggctgtatgcttccgttggttcaggtgtttttaccttgacagtattttctcctcggtggcttttgcggtggttgcttttaatcagcattgactcttcaagaaaaatatttagctgctacatctcagaggagacagggtggaaagcatctgagacctgcaggctcagacttagaaccagaagtgccctcagagttcatccggccctgacccagcgggaaatgagttcacagagaagcgggagaactttgccccaggccctgccgttgctcataactgccccaggtccttacatttgctccaggtcctgccccaggccctgcagttgctcataactgccccaggtccttatatttgctccaggtcctgccccaggtcctgcagttgctctgtgtggtgggtgtgatctggagccctccgcccattgctgcacctggggcaggcattgctaattgatcccaggactccttcctgcggagcacgccctggttctccaggcagccgctgcctgtcagcctgcagtggttcgggagaggacacctgcttgcctggtctgttccaaatcttgcttctcatcccagcacaggtagggggtgctatgggaaagggatcctcagttggccctgtcactgctctatcagctggggacgtggcatcctagtgaaaacatcatggccgggcgcggtggctcacgcctggaatcccagcactttgggaggctgaggagggtggatcacttgaggtcagaagttcgagaccagcctggtcaacatggtgaaacccatctctactaaaaatacaaaaattcgccaggtgtggtggcgggtacctgtaatccgagctactcgggaggctgaggcaggagaatcgcttgaacctgggaggtggagcttgcagtgagccgagatcttgccactgcactccagcctgggcaacagagtgagacgctgtctcaaaatctcaaacaaacaaacaaacaaaaaacaaacaaacaaagcgtcatttatccagcacccctggggaaccatgctacctggtgttttatggtacctggcaaggtgcaggtgaagttgctgctcttgggcattgaacccgtcttgtttggggcagctcaggccccaggcagggtccgggttggctctcgttggtgtggccctggcccatccagacctatatttctgccgtcctgcaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatggggctcaaagctgtgaatgtggccaaggtcgtcggtgagtccggggggtcccaagccatggctcagccatgcagacttgcatgaggaggaagtgacgggtccatgcctgggcataagtgttgagctcaggtgccccgacctggggaagggcaggacaggaaaggtgacagtatctggccaaggacagatgggaagggaccaagggagctgattagggagtggttatggactaggaatgtcggtaacaatggttagaaagtgactaacatttgttgagcacctgctgtgtgcccggccctggccgggagccttcgtgcccacagtgaccccgtctgcaaatgtagttccttgccctactcgcactggggagcaggacgcagagccgtgcaactcacaggtgccaagctcaggactccctcctgggtctgcctgggctgggctgtgcttgttgcccctgtggcccacgcatgtgcaccttccacctgaaagccaggatcttcaggacgctccccgaggaggtcgttgtctggcacaatgatttgtctcttcctgaaaaggtgacagagttacactggagagagcagcatccaggtgcggcagggacaggcctggggctcgcgggcagggactctgtgtcctgccggggtcccacactgcacctgcttgtcagaggcactcagtcaatctttgctgatgaaggatgagaggacagaggacgtgatgcttgctgctgcattgcctgcagtcctgggtgagatgcccgggttgactctgctgcccgtcgggtggatgtgatgtcagatccccggctttaaaatacgagggagctgggaattgagggagcaggttggggcagaaagcacagccccgtggaagcctggagctgaggcagtgtgggcgacccctggagcagtgagtgcttccttcatggccttcatcgcaccctgcagtcctcatgtaggggatgccatccatgaatttagttttcccagcctcctttaaaaacgcgttcatgctggggccggggcagtgcagtggctcacatctgaaatcccaccactttgggaggccgaggcgggtggatcatgaggtcaggagatcgagaccatcctggctaacaaggtgaaaccccgtctctactaaaaatacaaaaaattagccgggtgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaagtacaaaaaaaaaaaaattagtctgggtgtggtatcacgcgcctataatctcactactcgagaggctgaggcggagaattgcttgaacccaggaggtagaggttgtagtgagcccgtatcgtaccactgccctccacctgggcaatagagcgagactctgtctcaaaaagaaaaaaaaaaaaagaacatttatgccaggtgtggtggctcatgcctgaaatcccagaactttggaagactgaggcaggaggatcacttgagcccagaaatttgagagtgtcttccctgggcaacatagagagacctcatctctaccagaaaaaaaaaaattagcccggcatggtggcatatccctgtggtcccagctacttagggggctgacgtggcaggatcacctgagtctggaggcagaggttgaagtgagctgagatcatgccactgcactccagcctgggtgacagacagagaccctgtctcaaaaaaaaaaaaaaaaaaaagcatttactatccaccatggaaggtgagactgacctgtgagtgattgttcaaagaacaaaaaataaaccccagagataagacaaaagggtgcctccatgggggtgtgatttaaagctgagaaattgggcttcttccccctcccctctcaccccgtggtttgctaaaggagatgggaaaaaggattctttttttggctgaaatatttaacactaaattaaagccaattttaacagcactttggttgatgagtgaaattaacagactggccaaaaataaacgaacggtctgtactatgtgaaaaagaggcagctttggccatgctgggccaatgtgagttttcagggttgctgggaatgtctgtgaatcggaggaagggcctagctgggactctcaggagccaaggccctgaggggcaacttgcctggtccctgccctgaggcgttcactgctttcttcctgggccagatcacaggcccggaggctggaccactgggctggcactcttgccgagctgctccctgacttcctgaccatgctcctttcagcagccttgctgcactttagtttccttgaatgaaaaatggggatgagaatagctcctacctccaaggtgaatggagtgagttcggacaggtgactccctgggaccagtgcctggcgcctgacaaggtccagtcagagcccgcactgctgttactgatacccttggctgtaccaggggagaacttggttgccattgccaggtgttctcccaccacccccactactgtccctgtttgatgtgtggcgggaataaagctgtgcacattggagcttttggcacatcctggctttcaggtgaaaggtgcgtgtgtgtttgagggtttagcctggccaacccagccatgaggtcggacctgacctgggggtgagtcctgagctcggcacccctgagctgtgtggctcacggcagcattcattgtgtggcttggccgcacccctttccctgctgggctgttgatgtttagactggagcctctgtgttcgcttccaggaaccaacccgtgtgcggacaggaacggggggtgcagccacctgtgcttcttcacaccccacgcaacccggtgtggctgccccatcggcctggagctgctgagtgacatgaagacctgcatcgtgcctgaggccttcttggtcttcaccagcagagccgccatccacaggatctccctcgagaccaataacaacgacgtggccatcccgctcacgggcgtcaaggaggcctcagccctggactttgatgtgtccaacaaccacatctactggacagacgtcagcctgaaggtagcgtgggccagaacgtgcacacaggcagcctttatgggaaaaccttgcctctgttcctgcctcaaaggcttcagacacttttcttaaagcactatcgtatttattgtaacgcagttcaagctaatcaaatatgagcaagcctatttaaaaaaaaaaaagatgattataatgagcaagtccggtagacacacataagggcttttgtgaaatgcttgtgtgaatgtgaaatatttgttgtccgttgagcttgacttcagacaccccacccactcccttgtcggtgcccgtttgctcagcagactctttcttcatttatagtgcaaatgtaaacatccaggacaaatacaggaagactttttttttttttttttgagacagagtcttactctgttgcccaggctggagtaccgtagcgtgagctcagctcactgcaacctccgcctcccaggttcaagcgattcttctgcctcagcctcctgagtagctgggactacagacatgcaccaccacacccagctaattttttttatatttttagtagagacagggtttcatcatgttggccaggctggtcttgaactcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggctcacacctgtaatcccagcactttgggaggccgaggtgggcagatcacctgaggtcgggagttcgagaccagcctcaccaacgtggagaaaccccgtctctactaaaaatacaaaaaaaaaattaaccgggcatggcggcgcctgcctgtaatcgcagctactcaggaggctgaagcaggagaattgcttgaacctgggaggcggaggttgtggtgagctgagatggcaccattgcactccagcctgggcaacaaaagtgaaactccgtctcagaaaaaaaaaagtttgattggtgtaaccaaagcgcatttgtttatggattgtctgtggcagcttttgttctgccgagatgagttgtgacagatctgtatgggctctaaagcctaaaacatgtgccatccgcccctttacagaaaaagtgtgctgacctctgttctaaagtattggacaactacaatgtttgctcatttattattctatgatttgttttctgctttttgttgttgttgttgttgttgagatagggtttccctctgtcactcaggctggagtgcagtggtgtaatctcagctcactgcagcctcgacctcctgggctctagtgatcctctcatctcagcctccctagtagctgggactacaggcacacaccaccactcctggctgattttttttttttttttttttttttgtggagacagggtttccgcatgttgcccaggctggtttcaaactcctaggctcaaacacccacctcagcctcccaaagtgctgggattacaggcgtgagccaccatgcccagcctattctactgtttgtattacatagctttaaaagattttttatgactttaagtcacaagggttctttgtagaaaaaaatatatatataggaaagtataaaaagaaagtaaaaattgtccataacctctccagccagagacgaccgttgctgacacctcagcatattgcctttaagtcttttttctctaagatagcatttctcttcatcacagtcatatgctacgcagaattctgtatcctgattttttcacttgacattacaacaggtatttgatggcgctgtgacaaactctttggcacaatcttttaaatgtatgaaatactccactgcacagatgtttgcttttaggcttaactgttcttttattttgcgtgtgctggttacagccgggcacagtggctcatgcctgtaatcacaacactttgagagggtgaggcaggaggatcacttgagcccagaagtttgagaccggcctgggcaacatagtgagaccccatctctacaaaaaacttttttaataagtcgggcgtagtggtgcatagctgtagtcccagccaccaaggaggctgagttgggaggattgcttgagccccaggaggttgatgctgcagtgacctgagattactccactgtactccaacctgagcgacagagcaagacttgtctggggaaaaaaaaaaaaatatatatatatatatatatatatatatatacatatatacatacacgcacacacacataatataaaaatatatatttataaatatataatatataatataaaaatatatatttataaataaaatttataaattatatttataagtaaatatataatatataatataaaaatatatattatataatatataataaaatatataatataaaaatatatatttataaataatatataatacatacttataagtatatatttaaaatatatgtaatgtatattttttaatgtatgatatataatatacatttataaatacacatttatattattttatataaaatatatataaaatctccaagttgctttttccaaaaaggtgtcttgctgcatttcaaacattcatttaaaaacttgaatgctggtgatctggtccagaatgtgttcagtagctgctgccagtggccaagcatctcgggagatgtctacaaaacacgctggttctggcctggcgtggtggctcacgcctgtaatctcagcactttgggaggctgaggcaggtggatcaactgaggtctggatttcgagaccagccttgccagcttggtgaaaccccatctctactaagaatacaaaaaaattagccaggcgtggtggcatgtgcctgtaatcccacctacttgggaggctaaggctggagaatcgcttgaacccagggggcagaggttgcagtgagccgagatcgcaccattgcactccaggctgggcaagaagagcgaaactccgtctcaaaaaaaaaaaaaaagatgctggttcctaaaatgtggcccttttcctcctcacctgctgccagaccatcagccgcgccttcatgaacgggagctcggtggagcacgtggtggagtttggccttgactaccccgagggcatggccgttgactggatgggcaagaacctctactgggccgacactgggaccaacagaatcgaagtggcgcggctggacgggcagttccggcaagtcctcgtgtggagggacttggacaacccgaggtcgctggccctggatcccaccaaggggtaagtgtttgcctgtcccgtgcgtccttgtgttcacctcgtatgagacagtgcgggggtgccaactgggcaaggtggcaggctgtccgtgtggccctcagtgattagagctgtactgatgtcattagccttgatggtggccaggactggtagggccctcagaggtcatggagttccttcgtggagcgggtgctgaggctgtatcaggcacagtgctggctgctttcacctgggccgtctcaccgaagtgtccatggagcctgcgtagggtgggtatctgtgtcgattttacagatgcagaaacaggctcagagaaaccgagtgacttccctaaggtcacatacccagttagagcagagctgggccaggaagtgctgtctcaggctcctgaccaggtctccttgctttgcactcttgccaaaaccatgatccagaactgactttgaggtccccggacctcaggctcctccgaaatggcctcttggaggctgctgagccacagcttaggacccacctcgagaggcaaatgtgctttgagctgccaggcgtcctgggggccctgccttgggcacggggttcagacaggccccagatgtgtggggcgtctttctggacttgagttttcttttctgtgtggtggacacagtgctcaccccttaaagcacctgtgatgtgtgcagcagcccaatccctgcctgtcgcctgttctgctagggaaggaaggaagacttcaggatggcaggacaacagaaagaggtccaggttttagagcaagggcaggtcaaacttagaaaattctggaatgaggatgtgcatttcctcttctggatctgctaaaagaagagggaaggaggggctgctgggggaggagcccagagccgagtttacatccggatcccgcaaggcctcccctgccctgaggtcttgttttgtgatgtgcttgtgtccatcctggtttctgccgtgtccccaacatccggccaagcttaggtggatgttccagcacacactcaccctgtctgtgcacctgtttttgtgtccgtaagtgggtatttactcgccttacgagtgagccactgtgggaattcagggaggtggcgcagtgaccacccctggagggatatgtgtgtggcaggggtcgagggtctcgcccttccctgcttcctgcgcgtggctttctccaggacggggagggctgagctgaagaggtggggacagttgcgtccccccgccacccactgtcctgcggtgagagcagactcactgagcctgcccttctcccttgtgccttccagctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtgagggccgggctggggccttctggtcatggagggcggggcagccgggcgttggccacctcccagcctcgccgcacgtaccctgtggcctgcaagttccccaacctggcaggagctgtggccacacccacgactgcccagcagcctcaccctctgctgtgggagttgtccccgtccacccctgggtgcctttgctgcagttatgtcgggagaggctctggtgacagctgtttcctgtgcacctgctgggcactaggtcccagctaatccctgtgccaggactctaatttcaccctaacacacatggtggttttcattgctggggaagctgaggcctgagcacatgacttgccttaggtcacatagctggtgagttcaggatcccccagagataccagggccagcactcgatccccacccagccctgaaccccaccatgtgctgggattgtgctgggagtgtccacacgcccgggaccccagggctggtgctctcatctcctttttccagatcatgagaatgaggctcagggaagtttgaaaaaaacctatcccaagtcacacagcaacaggagcaggatttgaacccagaaaaggggaccgcacactctgttctgctagagtagttagctgtcctgggtgatatggcaggtgacaggggcaactgtgcttaacaaaggaacccccatcccccctgccaagttgggagactagaaggtcaggggcagaagctctgaagggccaggtgcagtggctgacacctctaatcccagcactttgtgaggccaaggcgggcagatgatttgagcccaggagttcaagatcagcctgggtaatgtagtgagacgccatctctacaaaaaaattttttaaaaattagctgggcatggtggttcatgcctgtagtccaagctacttgggaggctcaggtgggaggattgcttgagcccaggaggttgaggttgtggtgagctgtgatcatgccactgcactccagcctgggcaatagagtgagaccgtctccaaaaaaaaaaaaagaagaagaaaaagaagctctgaggctccaagtccccaggcaccccttggcttgagggcagacaagggaggagagggtcacctgggcagccctgacttttgtcccctggcaaagggaccttcagtgaccttggccctaggagagcctctgagcacgtcagccatgtcgaaccgctcaggaagggcagcaagaatttggcttctgacctctgcctctcctactcgccatctgcactgggtgtggttgtgcccattttacagatgaggaggctggggcatcgaccagctgaatgccttgtcccaggtactgcgtaggcagagctggcagttgaaccccgtgtcctggttgtcgctgggggtgggctgcaccctgacttgtgaggccagtagcaaggtttgcacgtgacttcgtgaccgtcacccagctctgcagcacatcccgtgacccagctcatccaggccgcatgcaaacctgttgccaggcgagaaaccagtcaccgcacagctgtggttgcctgaaatgattaagctcattaatcaccccggagtgaggacagactcagatgaaaaccagcaaaagccctggaaactcatgtgaccctgccaatgagggcggccatgtgcattgcagcctggccgtcactcctcggtacgtgttttggacttaaacgctccggatgtttactgagtgcttgattaataacatggaaggcctggtctcattgctgtgggagtgaaggatgcacagccaggcctgacatgatgagaacaagaacctggagtctcgctgcctgggtggtaatcctggccctgccacttagcaactgtgtgactgtagccaggtcacttaattttgctagatcctgcctgcgcttcagtggatcttgctggttttccaaggtggccaaacactttaaggcattcatgtggtcgctaggctgcagggttgaaccctggctcaccccgcagggcgccgtgtgctctgtggcctggctgtgcctttgctgacaccgtgcccgtgtgtgttcatgcaggtcaggagcgggtcgtgattgccgacgatctcccgcacccgttcggtctgacgcagtacagcgattatatctactggacagactggaatctgcacagcattgagcgggccgacaagactagcggccggaaccgcaccctcatccagggccacctggacttcgtgatggacatcctggtgttccactcctcccgccaggatggcctcaatgactgtatgcacaacaacgggcagtgtgggcagctgtgccttgccatccccggcggccaccgctgcggctgcgcctcacactacaccctggaccccagcagccgcaactgcagccgtaagtgcctcatggtcccccgcacctcactccctcgttagatcaggctggttctgggagctgacgctgaaaggagcttctcatctggggttcctgggtgtacatagatggttgggtaggttgtgcactgcacaagctgcatgatgctacctgggggtccaggtccaggctggatggacttgttgcttcatcaggacatagataaatggccaaaactcctcagctggaaggtcctgggcaggatctttgggtgtgaaaaccagtcacaggggaagggtgcttgctcatactgccagcacagtgctgagtgctttccatagcgctcgtttactcctcaagcctggagggtggggagtagcatggtcccatttcacgtacaaggaacccgatgcacagagaggtgtggcaacccatccaaggccatacaactggggtgggttgagccggggttgactgtggcaggctggctcaagagtccctgctcctgaacccttgccaggcagcctggcatcagctcggggaatttttgccctgacccttggaagcaagtgggcctctttgttctcatgtcagtgatgagaagagtgactttcctatggcccctctggagtacaggtgtttcctgttggcgggctcttcccccatgacatcagcagcgagctggttatgattccctacgcagaacttgatagtttataaagctctttgtcatccaggccccgttggagtctcacgcagacctggtcgcaggcggggctggtcttgcctgtcccagctgcatggatggggaacttgaggcttgcaaaggttaaggggctgttcgaggcccaggctggcaggagatgggcctgggccagagtctgggacttcccatgcctgggctgtctttggtcctgttgctcaccatccctccctggggccatgaccttagagagccaaatggaggtgcaggtaacccacggcaaggaggggttgccatgactcagagtccccgtcctgtggccggcagtacctggtgcaacgacttggatttcagaccagccactgtagcccgctgacggtgcgctcgaagtgccacagcttctgaagccaggcaggactcaggccaggagactctgttagctgttgagagggagaggccaacggatgttctggttctgctagagagctggttcttcggatcctggtaccagtgcactgagaggaggcccagcttgattctggggctgccttgtggtggcatgtgctgctcactgacaccctcgaggagtgtcttctctcgggcttgttgactgtgcccggttttccgcagttcactggtgcacacataggcacatagcaaaccgcacacacagtcgtgggtatgagtttcactacattccaccaccagtgttcactaccattacctgccttccgtcttaagtgttcatcatttaaaaataaatttattgggctggacgcggtggctcatgactgttatcccagcactttgggaggctgaggcgggcagatcacctgaggtcaggagttcaagaccagcctggccaatatggtgaaactccatctctactaaaaatacaaaattagctgggcatggtggggcatgcctataatcccagctactcaggaggctgaggcaggagaatggcgtgaacccgagaggcagagcttacagtgagcccagatagcaccactgcagtccagcgtgggcaacagtgcgagactccatctcaaaaaaaaaataaataaataaaagaaaaataaatttatgatctatttcaaaaataacacatgtactttgaaacagcagagacacatatgacacggagaatgaaattccccatagcgcacccccaagagacagccctggtccccccgtctttcccgtggacctccagcggggcagatgctgagccgcctgttgtcgagtggcgtgctatcccgtcctccagctcctctgtggcttacagacacccacctgcagccctgtctttgcctcctctagcgcccaccaccttcttgctgttcagccagaaatctgccatcagtcggatgatcccggacgaccagcacagcccggatctcatcctgcccctgcatggactgaggaacgtcaaagccatcgactatgacccactggacaagttcatctactgggtggatgggcgccagaacatcaagcgagccaaggacgacgggacccaggcaggtgccctgtgggaagggtgcggggtgtgcttcccaaggcgctcctcttgctggtttccaggctgctgcccctgtccttagcagagggaggaaacagaggatggctctgggtgaatgatgacttgggcttcgattatgtagtcacagggtatgaccctgagatgcgtggaaccccgagactgtgattatatgtagaaactgggtttccccgttgtttaagtagtcatggtggggtcagaccccacaggacttttgtcttttcaagaaagaaaatggtcgtgtgtcatgcaggggtagttggtactggttaatccaggtttatcctttattttgtgggaactgtacagtcatttctgctacaatgctgtatatgctcttctgaaagacacctatgcaaaatcgcacagtaaaaatgacacaactcatagggaaagcggggccagggcacagccctcaaaatctccatcaatgacatgtaagaaaagagaggaacctgggaaatagcaaagtgccttttgcacattaaatggttagctatatcccacaatactgtgcattcgtaaacgttaatgctgcaataaatacggcacttcaccttgggaagatctggagttggcttatgagtgtggaagggtgtagcgcatgagtttttgtgaaacactggaaggaggattgtgggaaatcaaatggaaagttctcaccccaggcgtggagaagagtgggtcatggccccagcagtgagcccagggaggtcagagacggaggtgtgtgtgtgggtgtgaccctgcgcagttccctgccggctgtagttttttgcattcgcttaatgtttctcgtggaggaaattgtgcatgagcaaatgtgaaaccgtgctgtgctcaaattgtcctaatacatcattgcattggaacagattggcttttttttttttttttttttttttttttttttgagatggagtctcactctgtcaccagcctggagtgcagtggcatgatcttggctcactgcaacctttgcctcctatgttcaagtgattttcctgcctcagcctcctgagtaactgggattacaggcatgagccaccgcggccggccagatttgcatttttgaaacaactgctaggctgggcgcggtggctcacacctgtaatcccagcactgtgggaggccgaggcaggtggatcacctgaggtcaggggttcgagaccagcctggccaacatggtgaaaccccgtctctactgaatatacaaaaatcagctgggtgtggtggcgggtgcctgtaatcccagctactcaggaggctgaggcaggagaattgcttgaacccaggaggcagaggttgcggtgagccgagatcacaccattgcactccagcctgggcaacaagagcaaaactccatctcaaaaaataaaaaatagaaaaacaagtgctgtagcggaagtgagcactttgcggagtcaggcttgtgtggcctgttccacaaatgatgtgctcacggtggcctcaggcccacctggagtctgcagcatggggcacaacaggttcattagtgtagaattccaggacaggcctggctcctaagcagccttcttttacaaaaactgcagagcccgcctgtatcctagcactttgggaggccgaagtgggtggatcacgaggtcaggagttcaagaccagcctggccaacatggtgaaaccccatctctactaaatatacgaaaattagctgggtgtggtggcacgcgcctgtagtcccagctactcgggaggctgaggcagaattgcttgaacctgggaggtggaggttgcagggatctgagaccatgtcattgcactccagcctgggcaacagagcgagacgccatctcaaaaaaaaaaaacctacagagccacacggcctctttctccaccgagtgttggtgtgggagcttgtgttattgtggtgaaatcttggtactttcttgaggcagagagaggctgagcgcctggagagactttcacatgggtcgccatgtccgccgtcggtttcgctgttgtgctccccatctgaaggctggtgccgtccagacaggctggacgcccctttccaccagatccttcctcccgcagcagtttctagttacgttgtactgtgaggtctgtgtccttggttgatggcaaaagtcagccgaattgaaattcagagccatgcctggctccctggagcttctctcctgggcagctgtgatcattgcctctgctgtggtgtgggtggtggaaatggattcctttcatcttgcttgctacaggtgactgtcacgtggagtcctttggagagagggacgtgttaattgatggatgtggctcccatgctgagaaagctcctgggcgtacattgccttagagtttcattggagctgcgttcttttatggtgtctgctaggcagaagtgatgaagacttggaagaaaacccagaaggttttccacttaatttggaaaatgtgcttttcccctcctgtgtcttttgctaaggtccagcctcctgcagcctccccgctctgtggactctggctttgattctttattaggagtccccctgctcccccaaaagatggtgtctaaattatcatccaattggccgaggttttgttttctattaattgtttttattttttattgtggtaaatatatataacataaaatttgccattttaattgttttgttattgttgtttttgagacagggtctcaccccagtgcccaggctggagtgcagtggtgcgatcatggctcactgcagcctcagcctccagggctccagtgatcctctcacctcagcctctctagtagccgggactacaggcatacactaccacatctggctgattttttgtattttttttttattgtagagacccgctatgttgcccaggctggtctcaactcctggactcaagccatcctcccacctcaccctcccaaagtgctgggattacaggcatgagccacaacacccagccattttaatttttttttttttttttgagatggagtctcactctatcgcccaggctggagtgcagtggcgtggtatcaactcactgcaacctctgcctcccaggttcaagcgactctcctgcctcagcctcctcccgagtagctgggattacaggtgcccatcactatgcctggctaatttttgtattttttagcagagacggggtttcaccatgttggccaggctggtcttgaactcctaacctggtgatccgcccgcctcggcctcccaaaatgctgagattacaggtgtgagccaccgtgcccggcctttttttgtttttgagacagggtcttgccctgtcacccagactggagtgcaatggtgggctcttggctcactgcagcctccgcctcccaggctcaagttgtgcacctccacacctggctaactgtattttatgtagagacagatttcaccatgttgcccaggctgggcttgaaatggactcaagcagtccacccacctcagcctcccaaagtgctgagattacaggcgcgagccaccgcacccagcccattttacctattctgcagttgacagttcagtggcattcagtcagttcacgaggtaaccatcactgccattcatctccagactacttcaccttctcggcagatgtccgaaactgtccgcattgaacacactcctcatctccctctgacagccaccattctactttgtatctctctctgccttctctaggtacctcatgtaagtggaattataccaatatttgcccttgtgtgactggcttctttcatgtgacatggtgtcctcaaggttcatctgtgttatagcctgtgtcagaatttccttccttaaagcctgaataataacccgttgtaaaggctgggcgcggtggctcacaccctctaatcccagcattttgggagtccgaggtgggcagatcacttgaggtcaggagtttgagaccagcctggccaacatagtgaaaccctggctctactaaaagtacaaaattagctgggtgtggtggcgcgcacctgtaatcccagttactcaggaggctgaggcaggagaatcgcttgtacccgggaggcagaggttgcagtgaaccaagattgtgcctctgcagtccagcctgggtaacagagtgagacttcctgtctcaaaaaaaaaaaaaatcatcggatggatggacggaccacttcttgttatttatccatccacgggtgctaggtttcttccacctttggttgtcgtgaataaggccactatgaacatttccttccgtggtgaaggttttgtactagtgaggaaaaggcgtgtttgtggtgttgcataggattctggtaagaaagtttgcactaaccataagtatttgtactacattaaaatgaaagctcaggggccgggcgcggtggctcacgcctgtaatcccagcactttgggaggccagggcgggcggatcatgaggtcaggagatcaagaccatcctggccaacatggtgaaaccccgtctctactaaaaataccaaaaaactagccaggtgtggtggcgggcacctgtagtcccagctacttgggaggctgaggcaggagaatggcgtgaacccgggaggcggagcttgcggtgagccgagatcgcttcactgcactcgagcctgggcaacagagcaagactccgtctcacgcaaaactctgtctcacgcaagactccgtctcaaaaaaaaaaagagttcagggtttatgaaactggccagccgcgtaaagtttgctgtgttgtttttgtgcccgggaggagtgtggccagggtgtcacgtcacacagtacacgtttctcagatggtggttctccagactgctgtcccaaagtctgtttttgcatctggttcccacagacccaccctccacggtgagcctgattttggccagggtagctggaatcttgcttgtctttcagcccggcagctgtaccagtccagggtccacagctagtggcttttaggaaggaatttgttcagttggctttgacacatggccccctagggtccacagctctgtagtgatgtggatgttgttatctacaaagacacatgatccttcgtgtccagatgaaagtgatgatgtctttgcagctgcccagcaaggctgtgtgtgtgtgtgtgtgtgtgtgtgtgtgtgtgtgtggtgtgtgtgtggtgtgtgtgtgtgtatgggggagggaggcaccctttccatctgggggtgtgtgtgtgtggggtgtgtgtgtgtgtgtgcgcgtgtgtgtggtgtgtggtgtgtgtgtgtgtatgggggaggcaccctttccatctgggtccaagagactgggcctggggaagacgcttctttttatctacttagagactttgttttatttgtatttttttgagacagggtctcactctgtcacccaggctggggtatggtgatatgagcatagctcactgcagcctcggcctcccaggctgaagcgatcctcccacctcagccttctgaatagctgggactgtaggcgtgcgtcaccatactgagctattgttttttttgtttggttggtttaattttttttgatacagatggagtcttgctatgttgcccagactagtctcaaactcctgaactcaagtgattctcccacctcagtttcccgacattctgggatcacaggtgtgagccactgctgtctccctgttttattaactgctgaaagacctagataaagaaagtctgaaaagacttactatcagagcaccatcctaagatgattccctctgactcaatggagagggaggggagcttttccttcaggcctgggtggcaggagcccaggtgctccaggccccatttgccccaggccaaatcactcgggaacttggatgcagctgtctttcagggtaacccaaaggaaccagatccccgcaggcagtaggcttctgggctgtcctctcctcctacgtcagctcagtaagagcccttcgaagggatgctgtgtcggaggccccaaaagcccaggctcatccctgagatgcacagggtgggctgggcttaggcagcgctcgagcatctcctggacggtgaccccagagagtgtggagacggagagtccttgagagtcactgagagacgtggctgccctgccttcccaagaggggctctgagtcattccccacactcacctgcccctacccaccctcacctggcccccagcctcacctacccccacatctgtaccgatccctttacccgcaccttccctacccaccctcacctcccctgtaccttcacctcccccactcacccgcccctgcaccctcacctgtcccccaccttcacctaacccccaccctcacctgccctcccctcacctggcctccttccgttggggaaggggttgtaaggggcggcccccaaactgtctgtcctggtgccctgcagagaaaacagtacgtgagggccgcagtccaaaagcttgagtcctggaaggtggaggagacagggatgtgttgggaagggccccatggtcttggatcccttctcgactgtcaatggggccttcatgggagcgccagtctagtgatgcacagctgggtgcccggcgggtggctgaggaggcctaaagtccgaggcggcaagagctcttccagaggctgttgtcctaatcgctctggcatactcaggcgggcacgtagttaggagctgattggagaggagagacccccacaccaatactgggatttgactttcaggctaaacttgagaagtgtggcctctgctgtcctgccagagctctccagccagtgcccagggctctccagccagtgcccgggggtctccaccagtgcccgggggtctccgccagtgccaggggtctccgccagtgcccaggggtctccgccagtgctcaggagtcttggtttctttgtcttacagccctttgttttgacctctctgagccaaggccaaaacccagacaggcagccccacgacctcagcatcgacatctacagccggacactgttctggacgtgcgaggccaccaataccatcaacgtccacaggctgagcggggaagccatgggggtggtgctgcgtggggaccgcgacaagcccagggccatcgtcgtcaacgcggagcgagggtaggaggccaacgggtgggtgggggtgctgcccgtccaggcgtgcccgccgtgtcttctgccgaatgccagcctctcacaggctggggagactttccaccctggggatccaatgggtggctttccagggtcccaaaagcaaacacaggctctttcacagcccctccaggaaagcagaaagccccaagggctggaagggaagggggagctctgctgagaggttacaaggcagcgctggccgacgggagttgcagttgataggttttgtatcatccttgttaaacttgaaccctgtgcagaaatcccttccacggcatgggggctgcctgttgactcgctcctgttccaccacagggagctcctgggcttcttcctcccagaggcccccgacgctcccacctgttggtcgtcagagcttctggttggtgggaaggcacccaggaccttgaggtctccagagagaaaagccagggaaagagggagaccgaaacccatgtgacatgaaactcaggctccaaactgagcacgggaacgtttggggacaggagcgcgatggccttcctcagatagctggggggctggcatgaagacgggagctacagccagcacaggtcctgggccgggagcccagagattgagccctgactctgtcacttactggccacgtgaccttgggcgggtggcatagcctcttggagactcagtttcctcattggtaggagtgacggccacagtggtgcggcctctgcagcacacggggggctcggtgggcggaagccccgggtctataaggcggctgtgcaggagccagccgagctggtctcccaacagccagggctccggggtccttagcagctgtggggggcctgcacctgtttcccatggctgctgtcagaaattaccagaagccaggtggctgagagtaatggacacttgttctctcacagttcctgagggctgaagcccgagatcgaggtgtgggcagggccctgcgccctctgaaggctctgagggaacctttgggcttctggtggctccaggcaccccttgacttgtggtcctgtcactccagtctctctgtctggctgcacatggcgtggcctcttctgtaccattgaaggacacttcagttggatttagggcctaccctcacccattgtggtcgtatcttgatccttcatgacatttgtaaagaccctgcttccaaataagctcacattctgaggttctggggtgagcgggaatttggagagcattgttcaactagtatagaatgtgacctgtcagcctcgggcagccctgagaggcaggggctttccacagcccagctgggtgccctgggctccgtgctgtccgaggagacgccatccccacacccgtccttcacccgccaccctcccgcaggtacctgtacttcaccaacatgcaggaccgggcagccaagatcgaacgcgcagccctggacggcaccgagcgcgaggtcctcttcaccaccggcctcatccgccctgtggccctggtggtggacaacacactgggcaagctgttctgggtggacgcggacctgaagcgcattgagagctgtgacctgtcaggtacgcgccccggggcctgccctaaccgcagacacccggccttcattgtcagtaatggcagcagctgccacattgtccgagacctgccgtgagcccagtgccgcgccaggggctttgtgtgtagcgtgttttgtcctcacactgacagctgtaggctggggttctgagtgagccccacagggcagaggcagaaaatgagtctcagagagggtgagcgagctgcttggggccccacagcaggagatggagcaggactgcagcctagcctctgcccccagcacctgcgcaagaagctgctctgctctggactgtgttaggctgcgagggctggagagaaatgagagttggtgcttagagagggggcgcaggtccccatggcttttcctcttatgatgaggtagatgggtgaagggaggggccatgcttgcaggggccagtgaccgaggcccgccgttggaactgatggccttcatcccgagcccagcccaggtgggagcagggctttccgagggcttgtcttgggtcggcctgcttccagggactctgctgcagctcccacccctgtccaaagcatggaatcccccaggctccctggcagtcctgtcaacctctgtcctcccaagctgagtgtggggcaagttctggaggtcagcactgctcaggggggcccacgggctgcttgcaggggccaaccgcctgaccctggaggacgccaacatcgtgcagcctctgggcctgaccatccttggcaagcatctctactggatcgaccgccagcagcagatgatcgagcgtgtggagaagaccaccggggacaagcggactcgcatccagggccgtgtcgcccacctcactggcatccatgcagtggaggaagtcagcctggaggagttctgtacgtgggggctggcagtggggtgggcagggtggcctctaaacccgacccctggaggaggctggaggccagtgcaagatcctgtgtggcctcagccaggcggtggtctctgccagatgccaactgttgcccgctggggttcagcgacatgtccgaatgtcccgaggcctctgaggttgttttcttttgccgcagaacaaatcaccacgaacagcgttttaagacaacaccaactctttttttttttttttttttgagtcaggatcttgctctgttgcccaggctggggtgccctggtgcaaacacagttcactgcagcctcgacctctgggcttaattaagtgaacaccttgcctcagcctcccaggtagctgggactacaggtgggcaccaccacacctggctaatttttttttgtagagacggggtttccccatgttgcccaggctggtctgcaactcctgggcacaagctatctgcctgctgtggcctcccaaagtgctaggattataggtgtgagccactggcctgacaacacccacggattgtctctcagttctgtaaggcaaagtccaggcacagcgtggctcacctgggttctctgctcagggtctcacggggccagaatcaaggtgtcaggaacgctgggccctcagcggaggctctgtggagaaattagcttccttgctcactcagcaggtagcagttgtgggatcgaggttctgttttctctctggttattggtcggggaccactctcagctcctagaggccaccacaggtccttgccccgtggccctctctgcctcagcagtgggggctccctgcgtcagtccctcccacaccttgagtctctctgatttgcttctaaagggccctgtgattcggctcagccacctttagattaggttagcctcccctttgatagactccaagtcggctgattaataaccttaatcacatctgcagaatcccttctgccacataaggtcatgacgccgtgctggggactggggtgggaaattacggggtcatttaggattctgcctgccactgccttgctgtgtcccagggcttgggggaggggcctccacagctgggaccacagtccttcctcccctccatggtaaccatctgaggattacttgagaccagcctgggcaacatggtgagaacccatccctacaaaaaatacaaacaaaaagggaccaggctgggcttggtggctcatgcctataatcccagcactttgggagaccaaggtgggctgatcacttgaggttgggagttcgagaccagcctgcccaacatagtgaaatcccgtctctactaaaaatacaaaaattagctgggtgtggtggcaggcgcctgtattcccagctactggggaggctgaggtgggagaattacttgaacctgggaggcggaagttgcagtgagccaaaattacgccactgcactccagcctaggcaatagagtgagactccgtctcaaaaaaaaaaaagggccaggggtggtagtgacaaagagaccctatcccaaaaaaaccgaacactgaatccttgagactgagtaaggacactgtgaaatttttctgggtggggcagggaacagagcgtcttctgtcatttcttccacctgggtgtggtcagctctccctccaagctgcctcctcttcttctcattgtccgggtgttggacacatttggttaactggatagaataacgcgagttcccagggacttggtccatttgctattttattttattttattttattttattttatttatttatttatttatttatttatttattgagatggagtttcgtttttgtcgcccaggctggagtgcagtggcgcgatctcggttcactgcaacctctgcctcccaggttcaagtgattctcctacctcagccttccaagtaactgggattacaggcacccaccaccataccaggctaatttttttgtatttttagtagagacgggttttcgccattttgcccaggctggtcttcaactcctagcctcaggtgatccacgcacctcggcctcccaaagtgctgggattacaggcatgagccaccacgcctggcaccatttgctattttaattcccatgtgtattagtgtcccacggctgctgtaacaaatgaccacaaactggatggcttaaagcaacagaaatggattcccccaatgtgctggagaccagaagcctgcgaccaaactgttgggagggctgtgcttcctctgggggctccagggaggatctatttgttggcccttccagtgctgtgggtgccagcgttccacacttgtggatgcgccgcctcaacctctgcccatcttcatgtgtccatctcctttgtgtctgcgtctttacctcttcttcttgtctgtgttgcctcttataaggacgtttgtcattgggtttagggcccacccaaatcatccgagatgacctcgtcttgagatccttaacctgcaaagaccctttttccaaaaaaaggttatgctcacagattctaggccttaagacatgggtgtatctttctggggggcactatccaaccccttatacaatgaaagacgggaagagggccaggtgtggtagttcacgcctgtaatctcagcactttaggaagctgaagcgggaggatcacttgagcccaggagtttacaagtagctaggcaacatgatgagaccccatttctacaaaaagtgaaaaaaaaaaaaaaaaaaaaaaagccaggtgtggtggctcacacctgtaatcccagcactttgggaggctgaggcaggcagatcacgaggtcaggagattgagaccatcctggctaacacggtgaaaccccgtctctactaaaaatacaaaaaattatggccgggcgcagtggctcccgcctgtaatcccagcactttgggaggccgaggtgggtgaattacaaggtcaagagatcgagaccatcttggctaacacggtgaaaccccatcaagatcacaaggtcaagagatggagaccatcctggctaacacggtgaaaccccgtctctactaaaaatacaaaaaattagccgggcatggtagcgggcgcctgtagtcccagctgctcgggaggctgaggcaggagaatggcgtgaacccgggaggcggagcttgcggtgagccgagatcgctccatgccactgcactccagcctgggtgacagagtgagactccgtctcaaaaaaaaaaaaaaaaaaaaaaaaaaaagaaaattagccaggcacagtggcaggtgcctattgtcccagctacttgggaggctaaggcaggagaatggcatgaacccgggaggtggagtttgcagtgagccgagatcatgccactgcgctccagcctgggcgatagagcaagactctgtctcaaaaaaaaaagccaggcatggtggtgcatgcctgtagtcccagctactcaagaggctgaggcaggagggttgttcgacccacggagatcaaggctacagtgagccatgatcgcaccactgccctccagcctgggtgacagagtgtgaccctgtctcaaagtaagtaaataggaggagagacaagtgggcagttcagactgatggtatgggcacagtagagactggtgcagacaggctggcctgtgatgtcaagcaacttctgtaattgtttccggcatccatttgtgtgtcaatttccgtgtcagtaggaagactctgtaggctgccaagaggaataagtgggaggatcctcccagagaggccgggcctgcaggagggccagttctcatgagttctcatttggcccctaccctccaggctgtggttctgaggtgggagacagagcctgacctctgtttgtcttgttttgtctttgcagcagcccacccatgtgcccgtgacaatggtggctgctcccacatctgtattgccaagggtgatgggacaccacggtgctcatgcccagtccacctcgtgctcctgcagaacctgctgacctgtggaggtaggtgtgacctaggtgctcctttggggtgatggacaggtacctgattctctgcctgctaggctgctgcctggcatccttttaaaatcacagtccctgtggcatccagtttccaaagctgattgtgtcttcctttgccctcctttcttttctactatgtgcattcggtgctatgaattttcctctaagtactgcgtttcctgcatctcacaaattttgttacattttcattttcaggtagtttgaatatttttacacttctcctgagatgacatctttggctcatgtgttatttagaagtgttgcttagtttctaaagagttggggcttttccagctgtctctctgcaactgatttctaatttaattctactgtagtctgagagcttattttatatgatttctgttattttaaatgtgttgggtgtggtgtttttgttgttattgtttttgtgtctttttgttttgttttgcttcgtttgttttgtttttgagacagtgtcttgctctgtcactcaggctggagtgcaatggcgcgatctcagctcaccgcaacctctgcctcccgggttcaagtgatcctcttgcctcagcctcctgagtagctgggattacaggtgcacgccaccatacccagctaatttttgtatttttagtagagacggggtttcaccatgttggtcaggctggtctcgaactcctgacctcgtgatccgcccacctcggcctcccaaagtgctgggattataggcgtgagccactgtgcctggccattaggtgtgttttatcacccagcatcatgcagtttatcttggtgaatgttctgtgtactcttgaaaagaatgtggattctgctgttgttgggtggagtgttccagaaacatcaattagatccagttggttaatagtgctcatcaggttgtctctatccttccttcctgactgcctgcttgagctgtcagttattgacaggggtgtggagtctccaactctaatggtggatttgtttatttctcctagtagttctatctttttctctccttctacccttgatcctcttctccccctagggcttcctggtgttagtggtgggagagtggggtagtgaagaacctggactttagggccaaagaggccagggttcaaatcctggctctgtcacttcccagttgagtgaccctggctggtgcctgaatctctgtgagcctccacttcctcctctgtgaaattgagagcacttacctggcaggctgtcatgggcatcaagtaacagggcactccacctggaccctgacacgtgatgcacaggaatgccagctgctatgccatgggtgtggcagtagtaataaagtgaccatctgtatcctcaccacagtgaagcctgtccagggctttctctcctatgcccccatgcctccaggtggccttggatcctgttggttctgtgctctgctcagcgacctttctcccgtgggagttcctgggggttcagcttcatcctacagacagcagcacacactggctgtgcaccctttttttttttttttttttttttttgagatggagtctcgcttttttcgcgcaggctgaagtgcagtggtgtgatcttggctcactgcaacctctacctcctgggttcaagtgattttcctgcctcaccctcccaagtagctgggattacaggctcccaccaccacgcccggctaatttttgtattttcagtagagatggtgtttcaccatgttggccaggatggtcttgaactcctgacctcaggtgatccgcccacctcagcctcccaaagtgcagggattacaggcgtgagccaccacacccggagtgccggttgtttttagcagtttgtcttgttcctggagagactggctcctgcccaggagctcggggagtagggccgcggggtgctgcctcacacctcgagtttggccgtaagcagaggggacattttgtgactgtccccctcctgagcttcccagcagcttttctccaagttacagcccaaaagctcaggtggatttgcaacccaacggtgtctgtgcacctcccactgatgcccgaactgccctggccaagaaacggggccgtcagaacgctgcactaactgcagccttgggcctccatgccagaggccatgcccttccatccaccaccccctggcctgggccctggccctcctggctcgggaactccaggccccttcctcacggctcgagagacgtgtatttaccgcacaggtgcttgtcattctcttgtggcctcttctccagggagatcacagaaggacagggcctcactgaggtctcggacatggaccctttgatagtggcaggagccaggctgggcaagaggcggccacagtcacctcagcagtgccatcaccaccgccattcagcccttccctgagccgggcgcgcccctggctctggccccagtgtcccagttacagctcacaggagcttgtggtgcccagcggctgcttctgattgagagtcgaggtcggaggctttgggaggctgagaggctgctcggtttcacaactgctgagggagacttgggctccatctcaggtctgccccatgtcgccctcaacctccagccaccggtcctccgtgtcccccatggccaggcacggcttgcagacatctgtcgttggctcctctcagccgtcgtgggctgaccctggcacgtcctcctgtggctgagcccagtggggacagctgcttccttttattaccctagaactctcgtctttgatcaggccccctcccctatgccacacagtccctgtcactcgggtgagcccagtagtcatggggaaggcctgcgggttccaaacatccaaaggcttgcgtgcagcatgacagcttgaaaccgatgttttttaccttgatcagatttcagcttggcgggggctttgctcagctttcagtgaggcctgggccgatttcccagcatcccctcctgaggccagcctctgtttcctgtgattttctgcacaaagtgggagggaggagtcctaggaaatggggggccacctcgaagcctaggcctcctctggcttctctgtgccagtgcccccacgctttgtgtctgtgtccccagcccatgggactctgctattccctgagtgctgccgcatgcccagcccgcactgaggacgtggagccccgaggggcaggatggcctccatggtcacacgtaggaagtggcctccaccctccgatgatcctctccctcctccctttcagcgccctccccgggggtgtcctcagccctcctgcctgtgctttgtcccgtcttctgcaggcgcctgggacgtgctgacaggtcctctgccggctcctgccttgctatgcgcacgctggtcaccacagaggcctggcccttcttctgtagcagtcccacacccgcaacaggtgtggctgctgaccacctgctttctgcccctctggtcctgaggagggcgcagtgggcactcaggcgtggctgagcagatgtgtgttgccgggaggaggaaggactgctccagtcagggctgaatttcccacccggagcatttctgctgtatttggtgtagcgcctgctgcttaaagctctgattcccagttggcaccctttcccttctgcattgaaaaacatacggatgcatgtcttcttgcagtgaatgtgtattctcccagcctctcttctgggttggggctggaggtggagcggcacacaggagccgcagcgatggaggatgtgcgggtgcagcaccccgtacagcagggatgccaaacccgcgctgagtccctctcaacttctgctttgaagcccagtcacgccattgcctgggttttgctgggcggggctgcgtgtgatgttctcctctgtccctcccccagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacggtgaggccctccccgtcaaggctctgccaagaccctggccctgccctccgggatacgagcttggggctgcctccggcctcacaggagtaggggctctgaaaacctttgcttgcagggagattgccaagtctgtcttttaggcccaacaaggaaaactctgcagttccacccatcctgtcccaccaggtagtgtggcttgaaggcagactgtgagggtctatctcaccttcctgcattaggtcaggagtttcacagaaacctgaggcacattcaggggtgggctgcagaggtccatggctcacaccctggaaaatccgcccccaaaagacagtgctgtctccactgaccagtctgtgggatagtgcttaagcctgagtggtttctatcaacatgtagaatcaggaggtataaagagatttgctcaggcatcctgggccctctctgaccagcaggatcttcctttagatcttgacagtgaaacacatctcttctgtgccccctgtgagttttctttcattcattcattcattcattcattcattcattcattcattcgagacagagtcttgctctgtcacccaggctggagtgccctggtgtaatctcggctcactgcaacctctgcctccagggttcaatcgattctcctgcctcagcctcccgagtagctgggatgacaggtgcgcaccaccatgcctggctaatttttgtatttttagtagagacagggtttcaccatgttggccaggctggtctcgaactcctgacctcaggtgatccgcccgcctcagcctcccaaagtgctgggattacaggcatgagccaccgcgcccggcctgagttttccttttatgaaggacctgcttggttggttgcctgccacatgttgtcagcaccatgggcccaggactgctgaggagctgttgatgccctcgctctcccagagccaccggctctgttagataattcacatgcagtctggccactgtcctacgtcctcattcacaaagagcagacatttcgtagaagatgagggcctgggagtaacctccctgcatgtttttctataaaggcatagtggttaagtccttccagctcattgaccattggagaattttatggaggctgtagactaggggctggtaaactaagggcccaggggccaaatccagcctgccacctacttttgtaaataaagttttcttggtgcacagccatgcccattcattcatttgcacaatgtctgtggctgctttcatgccaaaagcaagagaactgagtggttatgctggagacctacggccttcaaagccccagacctcacgtctggcccttgacagacagagcttccccagccctgctgcgcatcctggcccagcatgtgctgtgtgtgtgatttcagcttgcaggagccgtggttaggaattgtccctgtgttggtccattttgcattgctatgaaggagcacctgaggccgggtagattatgaaggaaagaggtctgtctggctcatggttctgtaggcagcaccagtatggcacccgcatctgctcagcttctagtgaggtctcaggaagctttgactcatggtgaaagtcgaagcgggagcaggtgcatcacatggtgagagagggagcaacggagagagagagagagcgcctctccctcttgccctcaccttgagaggagatgccaggctcctttaagtaaccagctcccatgtgaactcacagtgagagcccatttgctactgcggagagggcaccaggcatctgctcccatgacccaaacactgcccaccaggccctacctccaaccttggggtcatattttattctgttctatgctatgctatgctatgccatgccatgccatgccatgctattcctattctattatttgagacagaatctcgctctgttgcccaggctggagtgcagtggcatgatcttggctcactgcaacctccacctcccaggttcaagcgattctcctgtatcagcctcccgagtagctgggattacaggcacacaccaccacacccggctaatttttgtattttcaatagagatggggtttcaccatgttggccaggctggtctcaaactcctggcctcaagtgatccacctacctcggcctcccaaagtgccatgattacagatgtgagtcactgcgcccagtgagggtcacatttccgttgagatttggaggggcagacgttggagccatctgagccccctcgtcccgctctagcttctcctcccgtgtgccccgcggtgctggtggcaggcccttacgccggttctggctgcatgctctgttccagaagctttcttccctgcttggttaccagaaaatcatcccatccattacaaggacagggtccccttatctcccattcccagggcaggacaccgggggcagggcaggtggggaactgagcaagttctctgggggcaggcgtggctatggctccctctgggtgggcgtctggggaggggtggaggcagccgtcagcgccctggcttgctcttcctccctggccagagactgtggccttgtgctgctcccgtgtgggctgcctgcacctccagtgggttgtgctccctcccctcccctcccctcaagctctgctgagcaccactgccttccacagcccccactctcgggaggcgaggctcctcgtggccattcctgtccttggcacccacccccccaccaacctggtagagccttgggcggggtctgttactccttgcatggcgtagacctccccacagtaggcacctgacacatacctcctggggggcaggcaggaggtgcgttgaggtctcagccctggcagtccctcccctgcgtggcataggcctcgccacagggtcatcgagggtgggtggagactgtactagaccactccccgctggtcctagaaagggtcccatctgtctgctctctgtttggagtccagaccttggttgctgtgccctgcatggtgggctggggggcaccctccagcctctctgagtgcatggcctctccttgcagccatctgcctgcccaaccagttccggtgtgcgagcggccagtgtgtcctcatcaaacagcagtgcgactccttccccgactgtatcgacggctccgacgagctcatgtgtggtgagccagcttctggcacggggaaggggcgtccgggctgggttcccccaggaacgtggagtttaggggaggagacgtgcctttccagcggggctgggggctgtgtgggagactcaggcggctgggaggctccttgcgggaggcagggaagcctttcccagggcagcggccaggaggacagactgtgagctgtgggctcggcggctacagagtctgcctcagtgggcggggctgatggtgtccaggtgcctgcagcacgcacccacccacgggaccttgctgagcagcgtctgtcaggcagcaagattacccgagggctgcagtggtcctgttccctggcagcttactgtctggctgaggaggagtgatgttcacatatgcacacatgtcatgtgcacacacatgtacatgacaacatcccacatgctcctcaaatagcatgacctgtacagtcacggatatagggcctaggggataggaggccaagacagtcagggaagactttccagaggcagtggctcctgaaaggctgtctgattcaggcaggaagggagctgagttcagataggaagtagcaatgagtcattgtgtctggggacatggccactccttcgctgcagagggacctgggctgagagctcctctcttatggctgcagtcgggagagaagtctgttggggggagaagggggcttcctcaagggactccctgtgccctttggcaccttcgtgccaggtcaggcttgaggcctgaaggcagtggtgggggccaccaagggtcgcctcctctgctgggcaagttcccagtctgacgggcctgtgccgtgggccccagctgtgggggcgctgttgatgcgcagccaggcctcgccgccagagcccgcacgcttccattccgctgacttcatcgacgccctcaggatcgctgggccggccctgtgggagagtgaatgtggcttttgccaaagttgagtctggagcctggaaacttccctatgggcagccttgatagtggagtggcccaaggagcccacccagccgaccctgcccctcccgtggctggtgggcggcaccaggggctgcctggctttgctcgttcaccaacatcacctgggctggccagggcgcgctcacttctgccaccaccgagggccctgggcgaaggagtgaataccaggctgccttggcagggatgtgttgagggctgtggggagtcggacagcggcgggggtcagaggaggaggagggtgcaccgtgcaggctgaagggccacgttaccctgaggttggccaggctccccaggcctagcctcccagctcccccactttctccccaccctccaccagtggcaaagccagccccttcagggcgcacggtgtctgcccccaaggagggcccattccgttggggttaatgttggccacctctttctgtttgtctctggcagaaatcaccaagccgccctcagacgacagcccggcccacagcagtgccatcgggcccgtcattggcatcatcctctctctcttcgtcatgggtggtgtctattttgtgtgccagcgcgtggtgtgccagcgctatgcgggggccaacgggcccttcccgcacgagtatgtcagcgggaccccgcacgtgcccctcaatttcatagccccgggcggttcccagcatggccccttcacaggtaaggagcctgagatatggaatgatctggaggaggcaggagagtagtctgggcagctttggggagtggagcagggatgtgctaccccaggccctcttgcacatgtggcagacattgctaatcgatcacagcattcagcctttcccactgagcctgtgcttggcatcagaatccttcaacacagaggcctgcatggctgtagcaacccaccctttggcactgtaggtgtggagaaagctccttggacttgaccttcatattctagtaggacatgtgctgtgttgtccacaaatcctcatgtaccctagaaatgaatgtgggggcggctgggctctctccagagctgaaggaatcactctgtaccatacagcagctttgtcttgagtgcagctgggatttgtggctgagcagttacaattcctacgtggcccaggcaccaggaacgcaggctgtgtttgtagatggctgggcagccgcaccgcagagctgcaccatgctggtttgtatcacatgggtgaccatggtatgtctaagaaggtggagtccctgtgaggtctgcaggtgcccccacagctccaggccaccttgaggattgcctctgcctgcccagccctgagttccctctcccctgtcctgtcccactgtcaccccaagccggcctcattgggagcctgttggatggcagggtatagatgtaacctgattctctctggggagcggggttatctggcttctcaagagctcctaggagcccacagtggtggcaccatcacagtcgcagcagcccccagagaacgcggccctgtctgttcctggcgtgctctgtgctgccccgcctgggttccctgccccagtcgcaggccccttggaggaggtaccatgtgtctcccgtttcacagatgagccccggggagctcactctagtagtggccagagaggcctgcggctcagggagcggggcacatttccaacaggacacaccgccctggtctgagtctcgtgggtagtgggagcagaggagagcgccctatgtctgtggggcggcttggctgagcctggaagccacctgacctcccccgtcccttccctgccaggcatcgcatgcggaaagtccatgatgagctccgtgagcctgatggggggccggggcggggtgcccctctacgaccggaaccacgtcacaggggcctcgtccagcagctcgtccagcacgaaggccacgctgtacccgccggtgaggggcggggccggggaggggcggggcgggatggggctgtgggcccctcccaccgtcagtgctggccaccggaggcttcccgggttcctgggggctgtgccaccgcctctgaggcatgcttgctttcttcccttttcaaacccttctgcttccttctttaatgacattgttgattgtggataatctgaaaactacacaaaaatataaagagccaaaatctcacccaaatccacctcctagagtggctgttgggctccgtcagcatccaggcggccgtctgtgttccgcacggcccagcccatcgatagccgcctgcaccaggcctgtctgccctctgtgagcctccccacagggttccctccacaaacaccctgttctcccacccagggctggctgcttcctggaaaacagctggatggttttgtgcatgacagacaaacacagggtgattttcgtggctaaaatactccctggagcttttggcagggtgaggggctggctccagctgagccacgccttgagtgaaatgactgtgaggagaataaactgccgctgccctccaggatcactggggctggctggggagaacccccgtttctgggagcacagtcccaggatgccaaggcgagcttggtgccgagatgtgaactcctgagtgtaaacagcgggggctgacttgacatgctttgtatgcttttcatttgttcctgcagctgtatgcccctaaggtgagtccagcccccttctgcttcctctggggcctcgccagtgagccccaccttgctggggctggttcctcctgcccttctgggtatccctcacatctggggtcttgtcttcttgttttctttttcttttttttttgagacggagtttcacttttgttgcccaggcttcagtgcaatggtgtgatctctaggctcaccgcaacctctgcctcccaggttcaagcagttcccctgcctcagcctccctagtagctgggattacaggcatgtgccaccacgcccagctaattttgtatttttagtagagatggggtttctccatgttggtcaggctgatcttgaactccctacctcaggtgatccgcccaccttggcctcccaaagtgctgggattacaggcgtgagccaccgcacctggcctttttcttttcttttcttttcttttttctgagacagggtctcgctctgtcacccaggctggagtgcaatggtgtcatcatggctaactgcagcctctaccttctaggctcaagcaatcctcccatctcagcccctaagtagctaggactgcacgcatgcatccccatgcccagctaatatttacattttttgtagagatgaagtttcactatattgcccaggctggtctccaactcctggactcgagcgatcctcctgcctcggcctccccaggtgctgggattacaggcgtgagccaccgtgcctggcctggggtattgtcttcttatggcacctgactgtggtgggccctgggaaggaagtagcagaagagggttcttcttggtttcctggacagtaactgagtgttctggaggccccagggcctggctttgtttagggacaaagggaactggtaaccagaagccgagagtttaaacacccactgcccttcttccctgctcctgctgctgcaacccagcttaaccagccaggagtgctaggaacccaagcagggcccccgagcacacagcaggcagctcacgaattctcttttcctgttctcccttgggagctgggaggatcttaatcaggcaataagagatggcactgagcagccagctaattttttaaatcactttattgtttaaccatatgactcacccacttaaaaaagggtacagttcagtgggttttagtgtattcacagatgtgtgcaaccctcaccacagttaattttagaacattttcctgcccctaaaagaaactctgcatgaagccagctgtttttaaattagcaaagttattttgcatcctttaaatatatgttcatggtacaaaattcaaaagatacagaagagtctgcagtccaaagagactccgcccccatgacgccaagcaggcatccctgggaggcatggcctcctgcagtgtgtttcttctatgtccccccaggggtcatctgtacatatgcaagcatacaagagcgtggactttgttttccaagccagaagataattgtagatttatgtgcagttgtgagaaagagcacagacccatttatcctctgcctggtttcccccagtgctgcctgccatcttgcatgacttccattcctatcataagcaagacactgataacgattctttcaccttattcagattgacataagtgttttttgtttgttcttgagacaaacttcctctgtcacccagtgggagtgcagtggcacaatcacagctcactgcagcctcaaactcctgggctcaagcgattctcctgcctcagtcccctcaagtagctcagatggcaggtgtgcaccatcatgccaggctaatttttaaattttttgtggaggtgaggcctcactaaatttcctgggctagtcttgaactcctgagctaaagtgatcctcctgcctcagcctcccaaagtggtaggattacaggcatgagccactgcgcctgggctgacatatgtgttttcgtaagcccgaaagatagcatctgaagagtcaacattgagccttgccttttgctgctaacgatgtataaaagctgctgttctgagcatttcggaggctcccagctgccgtgtgcaccctgcctagagctctaccgtaacccatctccgggaggaggtgctattgttttcctcattttgcaacaaggaggctgaagaactgagcatgaaccactggcctgggtcgttcggttggtaggcagtggggccaggccatccaactcacaaccaccttctactctgcttcccccgcaccctgaagtttgttctgttttgaggacacagccgtcacattcttggtggctgaacagcactccttgtcaggcgtggctgggcccccactggagggcatcatggtcctctctcctgctgcggttgaaccttggctgtttcaaccactcctgccaagtggccctctgaaagggacagtccatcttttctcagcagagggccacactggcaaaacggtccctggcaccctttctctccacctgtctaatatagagtaaaaatggtatcatgttaagatcttcatttatatttattttatcatgaatgatgtaagcatcattttgtgtgtttaagaacctttgggcccagcgtgatggcttgcagctgtaatctcagcactttaggaggctgagatgagcggatcacttgaggccgggagtttgagaccagcctggccaacatggagaaaccccgtctctagtaaaaatttaaaaattagccgggtatggtgatcccagctacttgggagtctgaagcatgagaattgcttgaacatgggaggcggaggttgcagtgagccgagatcgcgccattgcactccagcctgggcgacagagcgagactctgtctcaaaaaaaaaaaaaaaaaagaaaagaaaagaaattatcaatctcctcttttatggcatatatatatatatatatatatatatatatatatatattttttttttggttatgttcagaaaggccttccctgctctgatcataaaaaacaacttattttcacactctctctcttttttttttgagacagagttttgctcctgttgcccaggctggagtgcagtggcgcaatctcagctcactgtaacctccgcctcccgggttggagtgattctcctgccttaccttcccgagtagctgggattataggcatgcaccaccatgcctggctaattttgtacttttagtagagacgggggtttctccatgttggtcaggctggtctcgaactcgcgacctcaggtgatccacccacctcggcctcccaaagtgctgggattacagacgtgagccaccatgcccagcccacactctctttcttaacgtcctcctcctttcgttttacgttcacatctttaattcttctgggatgtaattagatttgatgagcaaggtgggcatccagcttgtttcttggctgatggcttatgggtggcgtgaattagtcggggtctatcaggaggcagaaactctatgagaatttgaacagagaaagttccgtctacaggcttattaccagggactggaatagcagaaattgaacagtgagatgtacagagaactctaagaatgcaggaataggccaggcatggtggctcacacctgtcatcccagcactttgggagaccaaggcgggtggatcacctgaggtcaggagttcgagaccagcctggccaacatagtgaaaccccatctctactaaaaatacaaaaaaattagctgggtgtggtggcgcatgcctgtaatcccagcttctcgggagtctgaggctggagaatcacttgaacctgggaggcagaggttgtagtgagccgagatcatgccattgtactccagcctgggcaacaagagcgagactcagtcaaaacaacaacaacgcaggaatagcagatgagccgaggtggggcctccccagcccccaccccccaccccccaccctgggccgagatccagtcctctttgaatagggcctggccgtggttcacgggacatctgagacattgccgaggcgctgcactggtggatcttgccagaagtctgcccagtgcagatttgggcagaatctcaaactgccttgggatgtaggagagaaaccaggcctggtcaagttcatgggaagaggtggaaacagaccccataggctggggcttgggcagctgtaggaagccctctctgctgcctccctgcctgctctctgctttgaagcatcttccccagtgcccccagtctcatgccctctcaacgttggggtcaaatcctgaggaatacccagactggctctctgggccaaagaggaccctctccagaaagagcagggcccagtgcggcttcctaaagggcaggggaagggcctggccactccccagaggctactcaccagccatcaggatagccccaggaagcaggccttctcgagcccattttattactttattttattattttatttaattttaaatttattttttgagacagagtctcactctgttgcccaggctggagtgcagtggtgcgatctcaacccactgcagcctctgcctccagggttcaagggattctcccacctcagcctcccaagtagctgggattacaggtgcccgccaccacacccggctaattttcatatttttagtagagatgaggtttcaccatgttggccaggctggtctcgaactcctgacctcaagtgatccgcccgcctcggcctcccaaagtgctaggtcaagcccattttaaagttgaagaaactgaggctgaggtaaattccctccccagggatcctgctgcagccagaaggtggtaaaacaggacttcacccgggtctgtctggcgtgaaaggcagtgttcttgtaccaccctagggggcctgagagaactgagtccctcgggcataactgacagttctgttcccattattccgcaggggctcggatctggctgtatgctttccaggatggccttggagacccacataagccctacaccctttgggaagctgcatgttgggttggggtgccgtcagtggcacttgtggaaggtgcagacctgtgtgggtgtgtgggcccagggcccctggtcccttcctccctttgtagggctggttgtgtgctgcctggacctggggggcacgttcacgtggtgaatttgtctatttactatccccgctttggggctggtgccagcacaggcccttgtgaagggggtgcctttgtctggagtgggactgtggcccctccctcagcgtggtgacttctgtgtcagggcttcagcagggacgcagagcccctgagtgttcggaacaagggcgtcattgcaggagttagactgtgtgtgatggagggaggaggggcaggaggaaaggtcagaaggagagttcctgggaaggtccctgaggagcctggtgaggtgctaactggtgtggaggacactcagggcctgtggggacatctcctactgctgggggccagccacaaagggaactggccgaagtcctgtccccgccttcacagcccagcatctggtcacaaggcaggtacttggaagggcgcgggcacctgggccaaaagtgcctgggttccctttgcctttcactgagatgaccttcggggcaggtggctgctgcctcccctcctgtccccaggttttgccaactggccagaggaaggggtcctgggaagcaggggggccagaagccctctctgcaaggaaagcccgaggggtgtgggaggaaggaaggaatgcccaggctggcgaggctctaagtcacctggcttggctctcctcagatcctgaacccgccgccctccccggccacggacccctccctgtacaacatggacatgttctactcttcaaacattccggccactgcgagaccgtacaggtaggacatcccctgcagccctccatggccattgggttcccgccagcccgtggtggaggggcctaatccccatgccactgatgaggggaggtattctgggtgctagtgggcaggtgccgggcccagccctgcctccctctgctctgccaaccacactaggctgcctccccagacaagctcagcgggcactgcatgttgggttcagaaatcagcagaactccacgttctgagctgctcttcaagttgctcctatgggggttacttttaagctgggaaatggctgtggcgtcgaggggccgggggcttgggctccagagtctgactgtgtgtttgagtccggctgtggaaacctagccattgagatgccccctcttggtggctctgtcctcttaggatgggacaagtctgtgaaggctgctgcagcacccaccgtagacccctaatcgtgtgacgtcaccaggatggtccgggctgctcacttgccacagtggcctgtttgagcccgggaagccaacggggctgctcagctggacaccagccccccgagctgcccatgttggggtcacaggccccacctccctggttggggaggggcaactgagagtgtggagaggtgggacccaggtgtgctggtctccgcaggggctggatcagagcctgggatgggcagggtgagcctcctgacctttaacccagtggtgtcaggcaacgtggcccacccgccagccgcaccaggccccacccccgcaggtgaaggggtgggataggctgggcctgggccaggacacctctggaccacgcattcctcattgcttgggtccctggagcagcagggcctcccgagtgtggtgccgcctgccacctagtggccatttccacgaactcccaggcctggctggggagccggaactgcagcctccatttccaccccactccgggtcgggccacctccctgatgcctcagtattatatcaaactgtcacagtctgtcccacagccttacagaccactgtctccagaatggtcacatccacactgggcagcccagtctcgctagttcctcgtcccacctcctgcctttgctcatgcccgtcctgctctgggcccaccgcggacacatcttccccccgcccgccgtctgacctcacagcagctgggccccaagaggagtatcctgtcctgctgcacttttctcaacacccggtgttggctgcaccttcccacccattgcaggcccctctgtgacaggacgggggctcctaaacacaccacagttccgagtctgaactcacacagtgggatgcggcgtttctgggccacagttgggtgcaggtagcctctgggaggatgggaggtcaggagccatcttgcgagtcaggttgcttgaactcaggatggaagtgttccgggcccattggttgctgtattagcctgttctcacgctgctaataaagacatacccaagactgggtaattgtaaaggaaagaggtttaacggactcacagttccacctgcctggggtggcctcacaatcatggtagaagacaaggaggagcaagtcacatcttacatggcttcagggaacagacagcatgagaaccaagcgaaaggggtttccccttgtaaaaccatcaagtctagtgagatttattcactaccacgagaacagtatggggggaaccacccccatgattcaatcatctcccactgggtccctcccacagcacgtgggaattatgggagtacaattcaagatgagatttgggtggggacacagccaaaccctatcggttgccaacatttacagtaacagtgttaggtgaacagttgtccagtctcctgttttgtcggacactgtttctagcaccttccaggcagaatctcatgtatccttcactttcgaaatgggtactatttcatccccacttttatcaatgagaaactaaagctcgaagaggtcaagtaagttcctggccaaggtcagctagcaggctctagaggcctcgttctccttagaggcagccttgccagggcccaggcttggcaggctgcagggcaggtgcgggcatgcccatggtagaggtgggaccattgaggctcagagagggtaagtgatgagccctggcgacacagcggggtgggtccagagtccggcctgcatcttctggagctggccagtggacaggcctttcccgttcacagccccggggctgctgtgcccaccagggcggatgtgcctaccgaatcccactcctctgtgtgtgtccctttcaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatctcttcccgccccctccgtccccctgcacggactcatcctgacctcggccgggccactctggcttctctgtgcccctgtaaatagttttaaatatgaacaaagaaaaaaatatattttatgatttaaaaaataaatataattgggattttaaaaacatgagaaatgtgaactgtgatggggtgggcagggctgggagaactttgtacagtggagaaatatttataaacttaattttgtaaaacagaactgccattctttcgtgccctgtgtgcatttgagttgtgtgtccccgtggagggaatgccgacccccggaccaccatgagagtcctcctgcacccgggcgtccctctgtccggctcctgcagggaagggctggggccttgggcagaggtggatatctcccctgggatgcatccctgagctgcaggccgggccggctttatgtgcgtgtggcctgtgccgtcagaaagggccctgggcttcatcacgctgttgctgttcgtcttcctcagattcttagtctttttttttttttttttttttttgagacggagtctttctctgtcatccaggctggagtgcagtggtacaatctcagctcactgcaagctccgactcccaggttcaagtgagtctcctgcctcagcctcccgagtagctgggactacaggtgcgcgccaccacacccgcccagctaatttttgtatttttagtagagatggggtttcaccatgttggccaggatgatctcgatctcttgacctcgtgatccgcccacctcggcctcccaaagtgctgggattataggcatgagccactgtacccagctgactcttagtcacttttaagaaggggactgtgccttcatttttcactgggccctgcagaatatatgcctgggctctgggctcttctgaacctgtgttggcttccatctgacctctctgtgccagcccaaggctgctgctcttcctgagggcaaggagccccatgactgcgtgttgactcgctggatggggctgctgagcccactctgccacaccacgtgcccctggcagggagggaatccctgggtcctcacaggaacagtcagcaagccacacctgacgcctgctgtgggcccatccctgcggtgctggagaagacagacaaggcctggtcactgcctctgcagggtccccagtccgtggaaggagacagtaatctaggcattttcggtggggaagctgagctgttctcgtgtcctgaaggccaggcgggaacagccgtcttcagagggaagggagaaaatgcacatcgcatcagtggagaagggcctgacttccctcagcatggtggagggaggtcagaaaacagtcaagcttgttgctgggtgacagtgcatttaataatcaaaatataggctgggtacggtggctcatgcctgtaatcccagcactttgggaggctgaggcaggtggatcacttgaggccaggagtttgagaccggcctggccaacatggcaaaacctcaactactaaaatacaaaaactagccgggcgtggtggtgcacgcctgtaatcccagctacttgggaggctgaggcaggagaattgcttgaacctgggaggcggaggctgcagtgagccgagattgtgccactgcactccagcctgggcaacagagcaagactctgtctcaaaaaaaaaaaaaaaaaaagcaatacaaaatacaaatatcactttcactaaaagaagggatggaagacccaaaacaaacagaaaacaacaaaatggcaggagtaagtccccacttatcaataataacattgactgtaaataggctaagctctgcaatcaaaagagtgggccaggagcggtggctcacgcctgtaattccaacgctttgggaggctgaggcggatggatcatttgatgtcacgagttttaagaccagcctggccaacaaggtgaaaccccatctgtactaaaaatacaaaaattagccaggcggtagtggcacgcacctgtaatcccagctacttgtgaggctgaggcaggagaatcactggaggctgggaagcggaggttgctgtgagccaagatggagccactgcactcccacctgggcgacagagtgagatcctgtcttaagaaaaaaaagagtggatgaatggatcaaaaaacaagacccaaccatctcttgcatacaagaaacacactttacctataaaaacacactaggccaggtgtggtggctcaca

SEQ ID NO: 14200 - DNA, 13881 bp, Human
tagcctgaccaacatggagaaaccctatctctactaaaaatacaaaatcagccgggcgtggtggcgcatgcctgtaatcccagctactccggagactcaggcaggtgaatcgcttgaatccaggaggtggagtttgcggtgagccgagatcgcgccattgcactccagcttgggcaataagagcgaaactccgtcaaaaaaaaaaaaaaaaaaaaaaaaagaaaaagaaaagaaaaagaaagataaaatgaaaattcgtggctgggcgcagtggctcactcctgtaatctcagcactttgggaggccgaggtgagtgagtcacctgaggacaggagttcaagaccagcctggccaacatggtgaaaccccttctctactaaaaattcaaaaaaattagcccagtgttgctgcacactcctgtagtcccagctactcgggaggctgaggcaggagaattgcttgaatctgggaggcggaggttgcagtgagccattgccctccagcctgggtgacagagtgagactctgtctcaaaaaaaaaaagaaaaaaaaagaaaatagaaaattatcgaggctatcattttaattttaagtctgctctcaaatgttaccttgtctgggaattccttccctgaactctacatatcccctatcaggcagaattgttttacccttctatgtgttccaacatcctctggcctccaacatattgggtaataatatatcatttatctttgttctattctgcttgattgtggactagaaggacctgggattttggcattcatctgtgcatgcacagtgataagggcagtgcctggcatggaacactaagttctttttggatgaacgtataagtgagaaagttctattccttaattccaatagcaccttgtttaggtccaccaattcctgaagacaccatgggaagatgacacctgagttaataaacttagatacaaaagctataccaatatgtcttttagtatactctgtttatgcaaatatcttagtttcctgcaaaaagattttctttttcaccccccacccccaccaaaaaaaccacacatgattagaggtgtgatttttagtatcttaaatattattgaaagccattcaaggttatgtttataattaaactgaaataaaagagattaaaaccttctctgaattttatctgtactgattttgctatggtctagctagttatggtatttcaatgatcacatggtttagccctaattctaatttaggcatactactcaatccaatgctgtttagatttgctcatgggatttgttataaagttcatgtctctcagtgttctcactatcccattcttgccactgtaaagatctaagcaccatcagtctaataatttagcagacaatggagtcttcttagcttttacacactatcaggtatggttcacagcagttagaatgcagcctgttgtatttccaagaccatctgctgcagcgaatcatgtaaacagtttccaaaagacggaaagagagagaaagatgatagatattaaagtcagagatggatctggagatttagagactaacacatactcactcacatacaacagcacttcagttttgggtctatgtgtgaaaccaagcatgccttaaacaaggaagacaagcttttcaaaggtgcaattggataacttctgccatagaaatggctgaattgggacacaagtggggacaattccagaagaagggcacatctctttcttttctgcagttctttctcaccttctcaactcctactaaaatgtctcattttcaggttctgtaaatcctgctagtctcaggcaaaattatgctccaggagtctcaaattttcttatttcatattagtctttatttagtagacttcttaatttttctattcatcacaagtaaaagcctgttgatcttaatcagccaagaaacttatctgtctggcaaatgacttatgtataaagagaatcatcaatgtcatgaggtaacccatttcaactgcctattcagagcatgcagtaagaggaaatccaccaagtctcaatataataatattctttattcctggacagctcggttaatgaaaaaatggacacagaaagtaataggagagcaaatcttgctctcccacaggagccttccaggtaggtacaaggtattatttttttctaccctcagtcacttagtggcaggggaagtcatagtcacggtgcttaggagatgaaactttattgatttaggcatggatccatctagtttaattaatatattgggtatgaggaagctacttgctgtactttccatgtggttctctctccctggagaggaacatttttactcagcttgcaaactggaaatagattttctcacattagaagctcattttctgggtatgagacaggagagttcatactgtgtatgtagatctctggcttctgggtctgacatgtgctgagggacacatatccttcacacatgcttttataaatacttgataaagtaacctgcttcttgattggtctttataatccataagctgtgggatgcttctctgaagatgaaaatagtaatagagtcccatctagctattcaaagccattccttcattgtattctgtgcacatgaagttggggtttgttactgacaaaatatattcagatacatttctatgttaaaaggattgtgagatgcataggtaaatgtgtttattttcagttttacttgtcaacatagatgaatgagaaagaacttgaaagtaacactggattaagaataggaaaatttggcatggattttgctccattttgtcccatctaatcacttggatagtgttcaggtgttcttggtcagttacttggatgctctgagctttagtttcttggtgattacaatgaagatttgaattacaggatggctttgaaaaaataaacaaaactcccctttctgtctgtcgagaatgttgcacagggagttacagaatgttctcatgactgaattgcttttaaatttcacagtgtgcctgcatttgaagtcttggaaatatctccccaggaagtatcttcaggcagactattgaagtcggcctcatccccaccactgcatacatggctgacagttttgaaaaaagagcaggagttcctgggggtgagtgagcctcctccaactttgactagagtaagggttgggtctagaaaagaatattgagttgcatcaactgttttcccacttggattcatgagaggtgttaggtcctttaaaaaacatggtagataaagagttgacactaactgggtccttttgggaagagagaagcatttcctcataaagactttaaattgctaggacgagaatggccaacaggagtgaaggattcataatctttatctttacttagatgtaaagaacaattactgatgttcaacatgactacgtacataaaggcgcatggagaaaagtattggccttccatgcattaggtagtgcttgtatcaattcttatagtggctagggtatcctggaaaatcttacgtgtggatcatttctcaggacagtctaggacactaacgcagtttctcatgtttggcttctattattaaaaaatgatacaatctcgggaaaatttttttgattttcatgaaattcatgtgtttttctataggtaacacaaattctgactgctatgatatgcctttgttttggaacagttgtctgctctgtacttgatatttcacacattgagggagacattttttcatcatttaaagcaggttatccattctggggagccatatttgtgagtatatatctataattgtttctgaaataacactgaacataggtttttctctttctcagatctaaccagttgtttattcccagtattaacatgatatttataattcttaattataaattatatgtgagcatatataacatagatatgctcattaacaacaacaaaagattctttttacaattaacggtgggttaaacatttagcccacagttttatcccatgagaaacctgaatctaatacaagttaaatgacttgcctaagggccacttgactaatagtaattgaacctaaactttcagaatccaactccaggaacatacttctagcactattcatcaataaagttatatgataaatacatacaactttatctgtcaactaaaaataacaacagaggctgggcatggtggctcacacccgtaatcccagcactttgggaggctgaggcaggtggatcacctgaggtcaggagtttgagaccagcctgaccaacatggtgaaacctcatctctactaaatataaaaaattagctgagtgtgatagtgcatgcctgtaatcccagctacttaagaggctgaggcaggaggcttgtttgaacctggaaggcagaggttgcagtgagctgagattgtgccattgcactccagcctgggcaataagagcgaaactctgtctcaaaataataataataataatagaaaataaagttgtcttcatgaaaaatgaggaaagagattgctggggtgagaaacattaagatcaaagggcatatggtgaccttctatgccctagaaactcttttaggtattttctcctggtatctcttttactcatcgttctatctggaaaaataggtggatgagtgagataataaggtatataactttttaaaggtctaattgacatataataaattgcaagtatttcagatgtacaatttgctaaccttgacacacatagacacacatgaaaacatcaccacattaatacaatgtatgtatccatcatttccaaaagcttccctgtgtatctttgtaactctttcttcctccctccactccttgtcctctcgttcccaagaaaacattgatctgctttctgtgaatataaattaacttacattttttagagctttatataagtatgttctctttactgtttgtcttccttcgctgcacagttattttgagattcttcaagttttttctttatatcgatacttcattcacaagaatatattttaattctagactatgtcacattgactttgtagtctgctaaatccttagtgctcagatgacttgttcaggactctccttgaacctgtacctctgttataattgaaacttgtctctactgtctttttatttcaaacacagcttatgaggtgtctctcaacccatcaaactcacaatctgagtctttaggagattgctttgaatttgtgctattgacttatatttatatcaaatatgtaaatgtttggtaaaaatatcatcatgtacattttcataattactctatattcacatgatatatgtcagactctggaaatatgcatgccacagacacgtgtttcttgcctaaaggggctgatggaagacgcacatacaaatagacgattgcaatagaatgagagtggtggtctaatcgattcatgccctgatgttgctggacgttgctactccaagagtaacccctgcattgtcagggttagcatctcctggaagcctcatgtaaatgaagaatttcatgctccatccaggacctaatgaataagaatctgcattttagcaagaccctcatatgattcatatacactttttttttttttttttagatggagtctcactcttgtcgcccaggctggagtgcaatggcatgatcttggctcactgcaacctctgcctcccgggttcaagtgattctcctgtctcagcctccctagtagctgggactacaggtgcatgccacagtggctggctaatttttgtatttttagtagagacagggtttcaccattttggtcaggctggtcttgaactcatgacctccggtgattcccccgcctcggcttcccaaagtgctgggattacagacatgagccaccacacccagccttattcgtatacacatttaattctgagaagcactctatagaaaataagaataagaaaatattgggctcacaggtgacattaataagtaactttatcgagtaccccaaatgttacctatgtttggaagatggggttaaaaaggacacattgaaaacaagaaactcattgtggcttttttttcctcctttttgaacagttttctatttctggaatgttgtcaattatatctgaaaggagaaatgcaacatatctggtgagttgcccgtttctgtctttgtccatccttgaaaagataagaagaacagagttttaagagtcttaagggaaacacatctttgtctcctatattacttgtgaatgtggatatatgattttgtttcaatctattttgtgtcctaaggctttttgcaacagaagttggatataatcattagaaacataaattgtaccatttaacatacaatgaagtttatgtttaccttgacgtttcttctaaaaaaagtgtcctcacaccggcattgtccttgtaggcatattcacatgatcaaataaataattagttttcaattaaggagaatatttgaggaaagaccgtacgtgttcatgtggttcctgaaggcagtccagtgagaaagtaatatatgctcattaaacaatgcggacattttcagggtttccctttttaaccaaaatttggaagcaatgtggaatttactggatgcatccagccctgaaatgaagataggtttattgaatgtgccagcaagtgcaggcccaggtctgagtgttcttcattattatcaggtgagaggaagcctgggagcaaacactgccagcagcatagctgggggaacgggaattaccatcctgatcatcaacctgaagaagagcttggcctatatccacatccacagttgccagaaattttttgagaccaagtgctttatggcttccttttccactgtatgtatttttttttgtgtgggaagactaagattctgggtcctaatgtaagtaagaagccctcttctcctgttccatgaacaccatccttttctgtaacttctattacacagtatagtggttctgtaagttcacacagcccagggagatgctggctgcccactcccctcaacccaggcaaattcctcggggttaaagttatctactgcaagtgacgatctctgggtttttctgtgcctgtgtttgtgtgtgtgtgtgtgtgtgtgtgtgtgtgtgtgtatgtgtcactttaaaaggactggtcagatggtagggagatgaaaacaggagatgctataagaaaataaacttttggggcgaataccatgtgactctttttgtttgtcatttgttgctgttcaataggaaattgtagtgatgatgctgtttctcaccattctgggacttggtagtgctgtgtcactcacaatctgtggagctggggaagaactcaaaggaaacaaggtagatagaagcccgatataaaatcttgaatgacaggttaacgaattggagctttattccttaaaaatatggcctgggttttctgaaacatttcttccagaaaatagtttctccaagttttattactttggtttacaaatctcacattttaaatcacattttatacccataagtagcacacatttcataatatatccctctgaatgagggttgggataataggatctgtataatgttagaaaatgccttaaagtgtgtggagcatgagagatggatgtgcagaaggcttgtgaggaaaccacccaggtatctggccttgttttctgccccagaagtagccgcctattcctgtttctgttttattcctttgtttcttgacttttcctttccaacttgctctaaaacctcagttttctttcctttctgattcatgactaccaaatgtttccacttgcctcacccgtccattacacctttgataagaaccaccagcaccttgtgctcatgtacttgcccatgtctgatggaagaaacatactctctccatctgtccactttcctgaggcattcaagtctagccaccttttaaaatcactctcctccaggctgggcacggtggctcacgcctgtaatctcagcactttgtgaggctgaggagggcggatcacttgaagtcaggagttcaaaaccagcctggccaaatggcaaaaccaaatcttcaattaaaaccaaatcttaaaccaaatctctactaaaaaatacaacaaaacaaaacaacaacaacaaaaacagaaaaggaaacattagcccagcgtggtggcaggtacctgaggttccagatacttgggaggctgaagcaggagaatcgcttgagcccaagagatggaggttgcagtgagccgagatcatgccactgcaccacagccagggtgacagagccatacttcccagcacattgggaggccaaagctgaagaataatttgaggtgaggatttggagaccagcctggccaacatggtgaaactccgtctgtactaaaaatataaaacttagtggggcatgggggcacacacctgtaatttcagctacttaggaggctgaggcaggagaattgcttgaacccgggaggcggaagttgcagtgagccaagatcgtggccactgcactccagcctgggtgacatagtgagattctgtctcaaaaaaaataaaagaaatttaaaaaatcactctcttccaaagatagataaataagacagcagatatactaaggaataacctcaccaacttgtcattgactgacatgatttcttttgggcccacttggccagctagtctggtttggttttctggaaatgaaagaaataatcagagtttaatgacagagagcgtgagacccagaaagacaaaagtagatgaggtaagtctcttgagcgagacttctagggatgggaaatttgtggtgattgatatgaaatgatttttcccttatcaggttccagaggatcgtgtttatgaagaattaaacatatattcagctacttacagtgagttggaagacccaggggaaatgtctcctcccattgatttataagaatcacgtgtccagaacactctgattcacagccaaggatccagaaggccaaggtcttgttaaggggctactggaaaaatttctattctctccacagcctgctggttttacattagatttattcgcctgataagaatattttgtttctgctgcttctgtccaccttaatattctccttctatttgtagatatgatagactcctatttttcttgttttatattatgaccacacacatctctgctggaaagtcaacatgtagtaagcaagatttaactgtttgattataactgtgcaaatacagaaaaaaagaaggctggctgaaagttgagttaaactttgacagtttgataatatttggttcttagggtttttttttttttttagcattcttaatagttacagttgggcatgatttgtaccatccacccatacccacacagtcacagtcacacacacatatgtattacttacactatatataacttcctatgcaaatattttaccaccagtcaataatacatttttgccaagacatgaagttttataaagatctgtataattgcctgaatcaccagcacattcactgacatgatattatttgcagattgacaagtaggaagtggggaattttattaagttactcgttgtctggggaggtaaataggttaaaaacagggaaattataagtgcagagattaacatttcacaaatgtttagtgaaacatttgtgaaaaaagaagactaaattaagacctgagctgaaataaagtgagtggaaatggaaataatggttatatctaaaacatgtagaaaaagagtaactggtagattttgttaacaaattaaagaataaagttagacaagcaactggttgactaatacattaagcgtttgagtctaagatgaaaggagaacactggttatgttgatagaatgataaaaagggtcgggcgcggaggctcacgcctgtaatcccagccctttgggaggccgaggtgggcagatcacgaagtcagtagtttgagaccagcctggccaacatagtgaaaccccgtctctactaaaaatacaaaaaaaaaattagctgggtgtggtggcagtcacctgtagtcccagctacttgggaggctgaggcaggagaatcgcttcaacctgggaggcggaggttgcagtgagccgagatcgcaccagtgcactccagccttggtgacaatgggagactccatctcaaaaaaaaaaaaaaaaaaaaaaagataaaaagtcagaaatctgaaaagtggaggaagagtacaaatagacctaaattaagctcatttttaggctttgattttggggagacaaagggaaatgcagccatagagggcctgatgacatccaatacagagttctggtaaagataaaatttgatacaggtttggtgtcattataagagaaatcattattaaatgaagcaagttaacactctaagagaattattttgagatagaagtgaagctaagctaaacttcacatgcctataattggagggaaaaactaaggataaaatctagcctagaagatacaataattagtcataaacatgcattgtgaaactgtagagagcaggtagcccaaaatagagaaagattagataaagagaaaataagtatccatcagagacagtatctctaggcttgggcaagagaaaagtccacagtgataagcaactccacctaaggcatgaatatgcggcagagaaaacagcaatagtgaatgaatgcaaaaggtgctgagaaattccacacatgagtattgtgatgagtaaatgaataaaacatttgcaaagacctttagagaaagagaatgggagcatatgtgagaaataagatagttgattatgaatagaaggtagtgaagaaaagcaagctaagaaaaaattctgtttataaaagaaggaaaagatagtttatgtttttagcctaagtataagagtcctacagatggactgaaaaaaatcagtctgagagtattagtcacaattaatgaaataattacattttatgtattgaggatgccaagattaaaaggtgacaggtagatgttaatttccctagattgtgaaagtgatcacgacaatcacacaacaaataattaagtgacttggtatgctttatttaattgtagggcctgaggttttccattctcatttttctaaaatacaattttgtttctccaaatttgacagcagaataaaaaccctaccctttcactgtgtatcatgctaagctgcatctctactcttgatcatctgtaggtattaatcacatcacttccatggcatggatgttcacatacagactcttaaccctggtttaccaggacctctaggagtggatccaatctatatctttacagttgtatagtatatgatatctcttttatttcactcaatttatattttcatcattgactacatatttcttatacacaacacacaatttatgaattttttctcaagatcattctgagagttgccccaccctacctgccttttatagtatgcccacctcaggcagacacagagcacaatgctggggttctcttcacactatcactgccccaaattgtctttctaaatttcaacttcaatgtcatcttctccatgaagaccactgaatgaacaccttttcatccagccttaatttcttgctccataactactctatcccacgatgcagtattgtatcattaattattagtgtgcttgtgacctccttatgtattctcaattacctgtatttgtgcaataaattggaataatgtaacttgatttcttatctgtgtttgtgttggcatgcaagatttaggtacttatcaaagataatggggaattaaggcatcaataaaatgatgccaaagaccaagagcagtttctgaagtcctccttttcatcagctctttatcaaacagaacactctataaacaacccatagccagaaaacaggatgtaggaacaatcaccagcacactctataaacaacccatagccagaaaacagaatgtagggacaatcaccagccatcttttgtcaataattgatggaatagagttgaaaggaaactggagcatgagtcatatttgaccagtcagtcctcactcttatttacttgctatgtaaacttgagaaagttttttctccttgtgaacctcaggttttacatctgaaaatgagaaatttggaacaaaagattcctaactggtctttctgttcccatattctgtgatttttcaatatttaggatttttggtaatcacaattacttagtttgtggttgagatagcaacagcaatcagaactatttggtggacatattttcaaaggagtagctctccactttgggtaaagaagtgatgccggtcgtggtggctcacgcctgtaatcccagcactttgggaggccaaggcgggtggatcacgaggtcaggagatcgagaccatcctggctaacacggtgaaaccccgtctctactaaaaaatacaaaaaattagccaggcgtggtggcgggcgcctgtagtcccagctactcgggaggctgaggcaggagaatggcatgaaccagggaggcggagcttgccgtgagccgagatagcgccactgcagtccctcctgggcaaaagagcaagactgcgtctcaaaaaaaaaaaaaaaaaaaaaaaaaaagaagtgtgtggtgtagcaggacacctgcaacaataatatttttctaaatccctctgaaaaatgctaatcaaagggtttttttcctaaaaattgtcttagaaataaaatttcccctttgggagaccgaggctggcagatcacgaggtcaggagatagagaccacggtgaaaccccgtctctactaaaaatactaaaaattagccgggcgtggtggtgggcacctgtagtcccagctacttgggaggctgaggctggagaatcacgtgaacccgggagcttgcagtgagccgagattgcgccactgcactccatcctgggtgacacagcgagactctgtctcaaaaaaaataaaaaataaaaaaagaaagaaaatttcccaaataattcccattataagtatataataggtaacaattcccgctatagacatgaatctacttatataaacaactaatgagacagggtaccatatttttaattgtaacttgatttagagtgttggggtaaatctatatatcccagagtgtgaggctccctcgttagtatctctctgtgttacatgagtatttccctccactggaaaacctctgttcactctacaaacagttaagtgagctgaacttacatctccaaatagcctctatctgggagttccagcatagggttttgttgaacaatattgggggtcatggattattaagatggtggattttggaatacaatatacgcagaagcaaattgcagtagctatattaggtattggctgtatgatcttggccaatcattttattctatcttagttttcttctgtttcttaaatggatatattaaacataatattgtgcatgttcaaaaatcatttagcccggtttctcgaatgatgaatggaacctgttttttcatttatagacattgatgtgtaatcctgaacttgaaattaggaaaagagacactgtcagcttctcaggaacgtttggcaatattcacctatcccttaactccggttggaaaaagtgggcttaagaccctgggtaagatcagggaatgtaattattagtaaccttcacatagactacttccaaataaattgaactgtaaaaaacatatattacaaaatgatgttatcttagtcccaaaaaggcagagaggtagatggaaagaggctctagggaaaatgctatcagatg

SEQ ID NO: 14201 - DNA, 76848 bp, Human
gaaaattagaatacattcacattatctcaaacgaatgaacatgtgtgactttataaaaacaatacctccctaaaccatgaattcagatggaaaaactcgacatctttatttctgcagtcagtctcatttttcttaaaacagttcaaactagtaagaattttccagaagttacagcttgactcacccaaccttccaaggaaaaaacaaaaaaacttaaacagacattgtttcactctcatcatttcccacccttactaatagtggcaacttaagtgtatcttaaagcactccaacctcttcatagagcctattaaatgagtatcttgtggacacccacacacagtcatagaatcctaagtggtgctcagaccagtcacatgtcagtgcattcttaattgctagagctaacatgctctcagcatggtcttttaattacaccctaataatttattatagtttctctctacaatgtaaagtcttggaaatcacccactaaaaagtgcctgtgtactctggggctttggcaggctagggcagaacttctgagaacacggtgtgttccagagaagacaatcaatctgagaggacttacacagaaacagttcattcaggacctggctgctggcttttatctgagatctgaggatttcacaatcacttggagatacctacaagtgtatagcacaccttggatattactcttaatgattacttcattttgtaaagaggtgactccaccaacagcaaaggagagggcccagccccagccaccaggaatacagttctctgccagtaagtgcctaatgactcattttcctcaacagaattttcataaggctggaattcagggagggatgtctggagaatgtctgaaaggaagttcacaagccactgtcctgctctttgctggagaaagtgtcccgtggtagccagagaagttgactaaggcaaacagcaacatgttttggtaacatttccccattacctttcatgtacaatccaagaaaggttgccatgaagtgttttaatcaggttgggaacattataaacttcgaaaaaagaaaaccattagtggaaaaattaaggacacagtagatttaacaactgtgtttacgtggaaccacaaaatctatccaagtgaattgcattaaaacagacagaacactccaagaaactgttgtatgtgtattttttttaattcagtcaaccattttactaatctgtcaagatgaccaatttctttggaattatgtagatttagccaaaatgaaattatacataagatttacttttcttttcagatgcttttttatttatttttaaatctttataattactagatgttctcctctctcagaagatattctgagaggaaagcaaaaataccactcttgtaaagccatttccattcttccaaaggtctgctggtaaattattcttactgatctttccatctttctagcctgtgcatacacacctaacccatactaaatttcaccagatggcattttatttctttaaagtaaagcagccgtgggtttagacagttgaatttttaaacttctgtatttactgaaagtgcatatggtgctatatggacaaagaaattgtgctgaaagaaaaacatttctgtctgcaatacctcataatcttccagaggaaaaaaaagtgcagttatatggcacatttctcacaaaatcttatgtggcttcaatgttcttcctctgttaaaaagtagatatatgtttaatgtacagacctgcaagtttcattattttaaattcatcttttagtggcaaataaaaatgttatgcaaaacccaatgacttgctaaagtgatccttcagtgaattctagaagaaaatgcaacataaacctgaactggtaaaaaagaaaaaataaaaacctctgtatgtcaacgtaagcagatgttggtgtagttacaaggatgagaaggctataaaacttcccttgagtcactcacagttcatttgagggccaagaacgcccccaaaatctgtttctaattttacagaaatcttttgaaacttggcacggtattcaaaagtccgtggaaagaaaaaaaccttgtcctggcttcagcttccaactacaaagacagacttggtccttttcaacggttttcacagatccagtgacccacgctctgaagacagaattagctaactttcaaaaacatctggaaaaatgaaggttagtataagcaacctcaagtattcttaaaaaattagggttggctggattgaacgtgatcagagttttctattgtttagaaggtgaagatttgtacataagtatttacttcctcaatgggttgggattggaaaattgttctaaatatactgtagaaacatttgtccttgcagagctggaagaattccagcaattatagccggatcagtggaaaacaatcaaaagctttgtggggcgagagaaaaaggatttaggtgtaaacaaaatcttgccatttctactatttagcaggaactgtgtgtatgcctaattctctttattttatgtagacttgggtaaaaatcgtatttggagttgccacctctgctgtgcttgccttattggtgatgtgcattgtcttacgcccttcaagaggtaagaactttctctgatttgctctatctgcctagaatagcttggaaaatgtactaatgcaagatcacaagtggttgaacatttcctaagtgcttatgttccaaagtaagtctgttatttctaagaagacatataagctcacagatatgttgttgtgcaagaccagaaatactgaggaatttaaggcatgggtaggaagagatttacagtgttatttcagcaatagaaaaacctaagaactatgctgcatcacccccacaacccccaaaaatatatgctaaatacaagctttgacaggcctttagaaacaacatttttaactaacattgcttttcattattaggtttgtctcgtggaaagtaaaaatgagtaagaatggaaaagttaaaacagaatctatggactttttttattactaaatagtctttccaaaaatttagggaggaagttgagaatacagatctcaggaatagctgtatagaaaaagcaaagttgttgttttagatgtagtagcactgcacatcaaattagaaaaccaaacattgttaagcaagcattttgatcagtcataaattggatccttttacaaaaaaggcttagattgacactgatctcactttgctaaaaattggaaggtactatgggctgatatcagagctagtttaaatataaagtaggactatgttgatagataatctagtgatattagggaaatagctttttatgaaaatatttatgaagagaaactcaagcttctgaaatggaaaaaaaatccagtaataacaggtcttatgtctttgtgtctaggaaaggggaaaaatttgtactaataaatactaaaagtttatgataacaaatgtgggaaatatcttggttaaaagttaactgatagtaaatgaagatcaataaaataacttcagctaaagaatgtatgagtcctgaatgactggactgttgctattaaaaagaacatagaaaaatgttttcgaaaattaaaaataatcatgagattttcacagaattacaaaatagaataggttaacccataagatgaagtcagctgatatcttcagtgttaatttcagtctttgtttctgctctctgccagcacaagattcttcttaggctgttgagaggtatgtagtgtgtgtacatatctttcataaattttcatgttaaaattgttttcagactcatctctgaactcagtggtcttggggccacatttccctcataccagcaattgtcaggtagtggattaggtcatatagatcctttgaatgttaattcattaaaaattagctcctgatttttaaagaaactcaaccttgaaattgatactctgcaccctcagaaataaatgttcttggaacaaaagtttgttaattttatagggcacttgcctccatgtccatagggaaggatgaatttcactatggaattcaagctataatttctaataagaaatgcattatatttacatatttacaaatgatgtatagagatacacatacacagatatttgtgtgatcacatataatctcaatccctaccctctttccaagtttagttatgtatagcttacatataaatatacgtcgtaaactatatatagtataaaagtcctatgtaatttataatacaattctattttcaactaacaggaaaattctaagaataaagtgatttcttgatagggtgaaataatcaaattaaactcaagtactcagtgaaatttgagtactcattcagaaatagaaaaatcataaataaggtgagaactgttgttttttggttcattatatcattctctttctcttctaaatttgctgaataacttctcagaatgtcagctaaacagcttgtgaatggcactagtcattaccctactttcctgagcaggacccggggaagtcagtgccacaggcagccctgaagttaggcgtggtggcctcctaattttcctcctttcttctcacatctcactggtcaatcaatcatctcccgtctggagtgccaggtccagtcctcactctcacatctgcccagtgcctatgagaataggatctgagatggcaaggcaggaaagggaaggaggaaggggtaaaaagaacagagaattcaaagctaagcgagctcctacttagcctctttctcacattcatcagaaatcccattacttcacatttgccttaggtgccctcatatcctcagcccagaattttatgcaccagtgtatgaactgtcttcttctgagaaacttaaagccacactcaggaaacattcattcattcatttacatattagtgtattagttctactaactccctgctcatcatcatgccagttgctgaggatatggaggtgcagcagtctagaattccctctgcaagttggggagtaagaatccagtgctttctgcacccaaagatgcatggtcagcaccacagataccagagaaggatttgtgttatttcacatcacgtctaaaggaaagaaaaaagagaaaggctcttccatcccaggagaaccagcttcaggattaaaagggtttaggaataattaaactggattataagaacaaatatgaaatgtagtagtgaaatgagaaaatccatttagctcacttacaaaatattaactataaggaaaaacttttttcgaaacttgtaaaatattccctttttagttttgccaaagtgtgaagcacacatgaatttctaccccttactcccaggttgtccttgccttcagcttacaccccttcaactgactcctttcctctctcctacctccattcactttttcttttgaggttcttcttcacaagcatcacccctcttcgtctgtgaatatgcaacaaggctgagagtggaaactaagctccttgacttccccttatttttgttcaccccaaagacaaacataaagaccttcttgcttcaagagatttaacagaggttacaaaagcaaaaaactagaagtgaaaagttacagaggttgcagaattttgcaggtaaattctacacaaacttgattcatgatttatattttctgaatacctggaccattcctccttggcttatagaaagaaatcataggaactatttgacctcgtttcagattcttttgagtatagagtgccccacatggtgatgaacaaatactcaacaaatgttagttattttttttctaaaatttctaacatgtagtaaatacttcataaatgatagcattttgtgtctgtgttcttccattgttgagaatatgtacttctacactcaacaatagcaactattccattctgtgtgatgtatttcaatttcaaaaatgtcttaattccgagagtagagagcctttatcccagaatatcatccctgttcctatccccaactttttttttttaaccaaaaacaacaaatgtttcagaaacttttgtgtctgaagcactcatacagaacactgatggctctagggcaaaagcaaaacaaaaggaaagaagaaagatataagaagctgaagggtggaggaatggagaataaggctgagtgagagtaaaaaaggaaagggtgggtggctgtgttggcttatggctgtaatcccagaacgtcaggaggccaagacaggaggatttcttgagcccaggagtttgagaccaggctgggcaacatggcgaaaccctttctctattaaaaaaaaaatacaaaaattagctgggcatggtggcatgcacctttcgtcccagctatttaggaggctgaatatcagaaaagtgtttgggaagttcaggaaaccaaaaggaaactgacagagctatgagaccaaaatcatttaaacaaaccaacaaagagaatatgtatatacatatgtaattgtgattctacatacatacacatatatatataatatgtagtgattatttagctgagtcttgccttttataatgcattgaagaaaatatgtgaaggccacagataatttgtatagcacagagatcaatattttttaagaagaaatatcatttggaaagtctgaattttagtcagaaatccgttgttgttgttattattagtattactaattagtattctattactactgtaacttcaacaatcacctttggtaaaataagatatacgtgagataaaatcatcttcaaaggagatataaatatgttagtagtaaagttaaaatattttcccaggactaacattcagtctatgaaacagagtccctcaaacatcttaagagttttaagcttattttttcactattcttatggagaaaatatgggaaagtctaaaaggttaaggaaaagtttcagaaagttcatgaatataaaagagctttttagtcaagataaagaaatcaagtttgcagtttatagttctctaatttgcacgtgaattttaaaatcacagatgaatcttggcaaactccctttgagtttcgccaaattctaaataatttaaaaagaaaaccaaatctttgtatgattctcacaatggagaggcgtttacctgtctcagatttccaaagcaaattgagttacaacttcaacgagaacatccagtcatagatataccttgaaaaccagattcaaaagtctgagccagaggtgtgcaatcaggactaaaagtttttaagaaccacagacagtcaaactgagccataaaatatagcaataattgacaaatgggatctaattaaactaaagagcttctgcacagcaaaagaaactagcattagagtgaacaggcaacctacagaatgagagaaaatttttccaatctctccacctgacaaagggctaatatccagaatctacaaagaacttaaacaaatttacaagaaaaaaaaaacaatcccatcaaaaagtgggcaaacgacatgaacagacatttctcaaaaaaaggcatttatgcaaccaacaaacttatgaaaaaaagctcatcatcactggtaattagagaaatgcaaatcaaaaccaaaatgagataccatctcatgccagttagaatggtgatcattaaaaagttaggaaacaacagatgctggagaggatgtggagaaataggaatgcttttacactgttggtgggagtgtaaattagttcaaccattgtggaatccttgtgattcctcaaggatctagaaccagaaataccatttgacccagccatcccattactgggtatatccccaaaggattataaatcattctgctaaaaagacacatgcacatgtatgtttattgcagcactgttcacaatagcaaaaacttggaaccaacccaaatgcccatcaatgatagactggataaagaaaatgtggcacatatacaccatggaatactatgcagccatgggacatgcagggacgtggctgaagctggaaaccatcattctcagcaaactaacacagaaacagaaaaccgaacactgcatgttctcacttataagtgggagttgaacaatgagaacacatggataaagagaggggaacatcacacacagggcctgttggggggtcgggggactaggggagggatagcattagaagaaatacctaatgtagatgacgggttgatgggtgcagcaaaccaccatggcacatataatatctatgtaacaaacctgcacgtcctgcaaatgtatcctagaacttaaagtataatttaaaaaattgcaataattaatacagtagcatgtaataaaacgatctcataagacagtcaaatactaaccagtctctttttatttctcattgtatagagaaccaagaacttatttttcatttccagtatcctttttaattgactaatatgcagtaagaacagaataacttacaatacttattaatatttattcccattaataataaaaacagtattatttagtatcaaaattaaaattttaaatacaggttatgatttatacttggtggaaaaacagatgttaggaccttttaaggaacaggatataacaattgtatgttaaaaaagaaaacagataacaggccaggcgtggtggtaattgcagcactttgggaggctgagatgatggatcacttgaggccaggagttcaagaccagcctagccaacatggagaaactccctccctacaaaaacacaaaaattagcagtggtggctgacacctgtaacctctgctactcaggaggctgaggcagaattgcctgaatctgggagacagaggttgcagtgagccgagattgtgccattgcactccagcctgggcaacagagcaagactctgtctccctgcccccccaccaaaaacaaaacaaaatcagataacaaatgaaataggcacattgaaataggcacacagaaagatactaactaccaatacttaagaagaaacagaaaacatgagtggtgctataacaccaaaaaagattgaattagtcattttaaaacttcccacaaaaaaaaaaaaacaaaaacataaaaacttcctaagctcagatggcttcactgacaaattctaccaaacacttaaagaagaattatcacaaattcttcacaaacgttttcaaaaaatgaaagaaaacacttcccaactcattctataaggtattacccgcattactataatgccaaaaccaaagatgtcacaagaagagaaaattataaatcggtatctcttatgaatatggatgcaaaaatttcccacaaaataccagcatgccaaatccagcaatatataaaaaggattacacaccatgacaaattgggatttagcccaagaatacaaggttggtttatcatttgaaaatcaattaataaactttattaatagaaaaaaggacaaaaacctcatagtcataatagacacagaaaaaggatttgacaaaatgcagcaccctttcatgataaaaacacttaacggattaggagtagaaggaattccccaaccttatcaaagacacctacaaaaaaaaaccatagttaacatcacacttaatgaaagctaatgtcacactgtgtccggaattggtgggttcttggtcttgctggcttcaggagtgaagctgcagaccttcacagtgagtgttacagctcataaaggcagtatggacccaatgagtgagcactagcaagatttattgcaaagagcgaaagaacaagacttccacagtgtggaaggagaccccagcagagtgccactgctggctcaggcagcctgctttattctcttatctggccccacccacatcctgctgattggtccattttacagagaactgattggtctgttttacagagagctgattggtctgttttgatagggtgctgattggtgcgtttacaatccctgagccagacacaaaagttctccacctattgcctagatacagagtgtcaatgggtgtatttacaaaccctgagctagacacagggtgctgattggtgtgttcacaaaccttgagctagacacagagtgctgattggtgcactcacaatcccttagctagacacaaaggttctccaagtccccactaacctcaggagcccagctggcctcacccagtggatctcgcaccggagccgcaggtggagctgcccgccagtcccgcgccatgcgctggcactcctcagcccttgggccatccatgggaccgggcactgtggagcagggggaagtgcttgttggggaggctcaggccgtgcaggagcccatggcggagggggaggggcaggaggtgacagggggcgggcggtgcggagggggtgacgggggactgggggagtggggggagtgggagagactcaggcatggttggctgcaggtcccgagccctgccccgcagggaggcagctaaagcctggcgagaaactgagggcagcctcggtgggccagcactgctaggggacccggttcgccctccgcagctgctggcctgggtgctaagtccctcactgcccgggccgctgggagtgtggggcccaccaagcccacgcccacccagaactctagctggccggcaagcgtggggtgcagcccgggttcccctccctgcctctccctccacacctccccgcaagccaagggagccggctccagcctcggccagcccagagaaaggctcctacggtgcagcggcgggctgaagggctcctgaagtgcggccagaatgggtgccgaggccgaggaggcacccagagcgagtgagggctgagagggctgccagcatgctgtcacctctcaacactgttttcctgctaagatcaataagaggacttgatgtcctctctcatcgcttctgttcaacattttatcagtggttctagccaaggcaattaggcaagaaaaaaatatataaagtatccagatttgaaaggaagaagtaaaactctttctactgacagataacacaatcttgtttgtagaaatcctaaggaattcactaaaaaactattagaactaacaatacagttcagtagggttgcaggatacgagatccatgtataaagatcaatagtatttctatacactctcaatgagcaatccaaaaagatctaaataagtggaaagacatcccatgtttatggatcataaaacaatatttttaagatggcaatactgcctaaatttatcaacagattaaatgtaatctctatccaaatcctggatagctttctttttttgcagaaagtgactagctgatcctaaaattcatacaaaaatgcaagggacccaaaatagctaaaacaatattgaaaaagaataataaacttagaggaatcacacttccttattttaaaacttactacaaagctccgtagtcaagacagtgtgttactggcataaggatagatatatagatcaatggaatagaattgagtgtccagaaataaagtcttttacttagttaattgatttttgatgaggatgccaagacaattcaacgggaaaagtcttttcaacaaatgatggtgaaacaattggatatctatgtgcaaaaaaagatgttggacccaattcctcacaccacacacaaaaattaactcaaaatggatcaaagacttaaatgtaagagctaaaaactataaaactcttaaaacatacagatacatttttatgtttttgagttaggcaaattttctaagatatgaccaaaaatgcaagaaacaaaagaaaacatacataaattggacttcatcaaaatttaacattttagggtggccaagaataccatttaaagagtgaaaagactacctagaaaatgagaaaaaatatttgcaaatatatattcgataaaggccatgcatctagaatatacaaagaattctggcagctcaataataaaaagataaataactccattaaaaaatggacaaaggacagacattttgctaaggaagatatacaaatgactaataagcacatgaatgatgctcaatgctatcagtcactgcaaaatgcaaaacaaaaccacaacaaaataccaggaatgaaattgcagaggagcaattaggcatccgttaaagcctaaagattgtgaaatggcttgtccctgggggtgcagtagaaatagagacaagcagtagacagggttggcaggcctgggtgttggttaaggaagaggaaggtcaaggatcacaccaaaatgtttgtattgagaaactacatgaatggtaggtagtgccatttacttggagaaatttggaagaggagcacagaattttttttcttagcattaaacatattgattttgaagtgcttgtgagatatgtaagtggggattttaaagaggaagtttaatgtacgtgtctggagttcaaaagacaatccagtgaaagtcaggtgtggtagtggggtgagggggtgggtcagcccagggatatgtagtagaaaccttgggagaacgaaatgacctaggaaagttgctcttcctccagccccatgtagaagcagtaacagccatgccaaaatgtcaagtagagattagaggaaaatgagctggcaaaggagactgatgtcttcaaaaataaacaaggcttgctttcatcttcagagtcaccagagggtcatttgccattcatgttcttacacattaggttgattatatcttatgatctttgaaagccttagttatccagaaaaataaatgaaccctaattaaaataatataacataacaataaaataacacacaaatgggctatttttaaaagcccggcaaatcctttgaataactcatgttattcagtattgttcatagagaaaaccatggaaaattgctgttagagctgagacattcttcaagtaggcagtaataatagtagcagtaagtagttttataatagctagcaacctatttgctttgaaaaagctcaaattgcctcactttctcttaacctaggttttgaggtgtaattattctacccctttgtgtgttgcttggttcttgcctatttttgtgtttgttgtatgttgttgttttattatgtgtacacttatactttaattatagtatagtggcaaagtatctaaaaccagatgcagctgaatttaaaccccagcttttctatgtattaggcaagttagctcaccttgctaattttcatttcctaatctgtaaaatggtgtccacaaaagtatttacctcagatggctgctgtgaggatttaacaggactatacatgtagagtacttggtatgtacaagaacttataaattataacactttctattactcatctaaagccacctcatgtactttttttttcagagttgtcagtcttgttccaatttgatcatattagcttgtaaatagtatatttcccatcctaatacttcctgtccttgcccctgtggtgctcactccggaaacaaacaaaacccggtgtgataattggagatgatacctccccacaggtagcacctctgcagagccagcaggaagatggatgtgttttccctgagagccctagaccctttccttggtatgacctcatatgcatcaattacaaatcaagtgcaaaagtgagaacaaaaggacctgccagccatttgtatgccacttaattttctcatttggtttatgctgaaggttagaactaacatccaatgtctctgctctaacacccattcctaatttttcagtactagacaatcaaatggcagaaacagacacagaagcctaattgaagcacaacgttttaagaaagaattaagagaatagtaaatcattacttgcttgtgaatcatttctgtgaattgtaatttcttggattcataattgaaataattttcagctttgctttaataagctgaaaatgcaaataattaaagcatagttaatgagagtgtttaagcaatgtatgagtaactatactaaagatgggccaaaacgaagttaagggcactggcaaaaattaagagctaatcaagtaagtgttaacatatacagaggagagatatgctttcagaattcatgtttacttctgttcaaccattagaatttaaaaattatagatgtcaaagctaatcttccaaaatcatcaagtaattacatttaatattaaaacattatttggaaggggacatgaaaattcatttgttgatccaataattattaatggaatattttctgggtgactagaacatttagtgtatttgatgctgtggagatatattttatactgatttacacacagacacacacatacacacattccaaacactagaaaataatgaccccagtgctttttccataatcttacttaagtctagtctggggtagaatcagtccccttgccttttgtccacttttccaggtctgggaaagggaatatacttaaagaagagtgcatttgaaggcaatgagcaaggtcattgaacagggggacaaacattaaaggaggccatttacattccttggaagccatggtcaacactcagttatgtggaatctcttctccatgacatatggattgctctgcaggccagcctcacccacctaccgtgagtttgtagtcaaggaatgattcctataggcacaggagtgcattgagcaaaatagattcagtgaaatcattaaattgagattctgaacctttgcagaagaatcatcaaggagactgggtaaaaactaaaactaccaggaccccaccccccagagatttggattcagtaagtttgagataagtactaggaatctgttttttatataagcacactccaaggggctccaaggaccaaatttttataaatatttaaatgaaggcaaaagagtctacatatgaaatttacaacatgtaatagagggtagaaagtaagggaagatatattctcgggggaattattcaaaacaagcgaacacaaaatctgtcaagttggttttttttttaattcagcaaatatttattgagctcccatgctatgtcaaggactgtcctagcagctgaacgtataatagtgagaaaaatcaatcactgcttctacttttatgggtggagacctatgtcttatacaattctttgccacataaatatagagatgtgaaaaaattcatgttcaataaatttagataaatgttgagaaaacaaaaacccatatgtacaaagaatcaaagcttggattgaaaattctaagtaatctttatgttttattcttattctaacatgtgacttaatgcaccatctcaaaggagacacattacttcactgtgtttatgaacacgtggtcatgtttagcaggaagagaagaatgcttaatttgaatttctctgagtatattggggatgaacttaatgtacccagcctgacatcaacataattacactttctaagccctggatacatgacatatgatacggtttcaaagctaacgtgaggttaggagtaatcatcccagcccaatctgtgcctgaaatccattcccacatacatgtagctggcttatctggatatgttattcatacatccattcatcacttcttgggtggtggtgaggattattttcattatggcaattagtagtacaattagtacatgcttaaaattgctttacagattttttgagtcatatgctacgttctctatatcgattgttggcatttatagctactatgcactcatataaaattaattgctaactaggaagtaatatgaaatatagtatcaagtccaaccttcctggataaactaaattagaggtttaaaggaataaataattaattcttagaatctttttgagaactctgataagatcaaaatgctttttaatgatacgaaaaggaaaatgagtaggtatttaaaaagtaatttgaaactgttgttttttatgttttatttattcattgtacaatattagtacaaattgcacttatgattttaattgtaacagttcagttatggagctaggcaatagacaaaatgttcaagtataactgatgaacttcattaaactagaataaaagtaaagctcaattgtatatactaatagccttgtctggaactgtgtttctcaaactgtggttttagtagatattcagaagcaaaaattcccagtggacaaatctgcttgggaaacattgatctaaaacatttatttgaaaaatactgatgagttacgataatgctaaaaggtaacatgtattgactgctaccatgtgccacacatagagctagatgttttagttgaattatctcacttgatttagacttctatgaaaatgaagattaattatagctataaatgtcttaattaagcataacacaagtaaggaaaattatatgcaaagatgcttaaataggaaaaactatgtcaccagccataactgaagcattatttatactttttaaaaaataactaaggttatattcatttattgaattaatatcaaaaacattctttaaaaaaattgttatcttggtatttacagtaaatggactttatacatttttaaattttccatctagatattcaggattgtgtaggcacaaactaaatgtgtctcaagtggaaaataagttccactatgaatagtgttataattttccctttattacattagaatcagattgcaacttgctcttaggaaagttaaataaagttgaattaaatacaatacttggcaattattttaatgctattgtagtaaatggtcttttattcactgaatgagaattacaaaatcaatggtatgaattctacataataccatttcattaaacagaagatatttcattacaaataactgtatagtgtacacaaccttgtttaggatgcacagataacacagaaagataattatttaaaaaatagaataacaattctattaagtattcagtgtctagttgcaaaagggctcaccagccactattcttacagccatggaataagttgctgcaaattaaggaaagaaataaactcatggtcctaatcaaaagtgtggagcatacatgcatcaatgtaaatcagttaaaacaacagaagatgttattattccactttattattttgctcttactacatacatagcagaacttaatgtaactataagattaatagagaaggttgagtttcagatttcaaaatctagcatggtatagctggaagagattgccaacaccttctagtccagtacctcataatatgagtgagcaagcctaggcaccagagatctacttaccaaaaaccacacagggaattcagaaaaggcacacatctcatccagccagccacccaaccagccatccagccatccagccagccttcatttcatgcattcatttgttcaacaactatttattagatgcctgtatgtgctagacacttgggatgtgctatgagaaaaacaagacatgattcctggccttatggtaactgttttgattatacagagggaggtgggaaaacagtaatcaaataatcactcaaatatacacacgattacaaaccaagaggagtgttgtaaaagcaaggaacatgctctacggaaatgtataaaaggaaacctgatctaaaccagggggtcagaaagggcttctcagaggaagtatatagcttttggattgagcattaaaggagagagactagaaaaggctgtagacaccctacagaaagagtatttgaggaaaagaaagactggcttgttagtggctagaaagtaatgagagaggagcaagaagagctggcagggtagactgccccacaccagccggtgtctgtagtccaaccagatcatcatctgtggtctttactggaagagtcatggagggctacgagttttatagcaggataaagttaaacagctcccatctttgacagttttgttctcacctgggcaaataccagattcataaatggcattcaaggtataggatcttcctataagttttagtggcctgtggaaggggtaaggtgggagagatggagaatggcaatattgataaaaaagggcattgggctttggttgccttattatctgtctggtgtatctgactgcttcagggctctgtaatgaatgtttgttctgagaataagatcatgtttgaaaaacacaatggttttgaagtattcaaatatagattgaatttgtttgtggtttgtgagctgcattagattagtttttctacagaaaaccctctactcttggaatttctaagatattttgcatagatcaaggggttttcttttcttttggtctactttctttatataaaaatccatagtatgagaaaattacctacattcataatgtctttcttgagatttctgaaggtaagggttctggccaatctcatttgaccaactgggatgctaaaatacatcattgataaatcagttgaaatctgaaccaaacctatatgaggaaatacagtgagctgcataagagactgggattttagccaaacctacatggtctgtaatcccagctctgcaaggactagagttgttggaacctcatctcatcttccttctggaaaaccttgacaactcttcactgcctgaagaatcatgccccagctactctgcatggccttcctctgtaatctttatcttcctctacagtttccagccagttttcccttccaggcagtgaaactacctccctaattcttaattactgtatctacaaaaaaggagatactactattaataataatagttatgatgataggagttcaacaaccacttagcaaacagcagatcttattactatataagaaagaacagatgaaggccaggcttagaatttatttgagttgttaaccttctttttaataaggatgtatttgctcttcccccaaagttcataactctgaagaaaatacaatgagagcactcacactgaaggatattttaaatggaacattttcttataaaacattttttccaaactggatttcaggtaagtgcattatttatctttaggggttttttttatgtattttgtttggtttttattttagtgccaatacatctctatagtaactgaagccgtatcagttgaaatgtacaaaaagaacaattatctgaatgattcaagtgctcaaaaaagcgcttttgacaaaaccattcatactggatttgcgccatagtaatgaggccaatagagttttaaatagagaaggaaaagttgaaaatgcattgttgaaataatttgaacttctgtaatcacttttgagaatggtagatatattcctatttaggagaagtcacaaaaattttaccaaaagagaaattccattattaatctggataatctggaaaacagacaaatctcaatctgacaatgaaccctttaagggtcatgaaatcggtattttcatacagcttttcaaaataggatgttataaagcaaatctaatcaaataaatagtgagatcaactaaatagtctatgacattttagttgagtatcttaagtgtcactgaacaaaatggaatattttaattttttctctttagaaaataaaattaatacaaagtgagttttaagttgaaccaaacacaacttaaatgtaatttatgtttattactgcaaaagaaatatacacttcaaactagtttatcccctttgtaacccagagaaaacaaaattgtgttcctaagcaccctgaatcggctaaaatagggctgctgtttgcaaatgtggcatctttgtgtgaagtagaacaaagcattctaccttcttcctctaccaccaacttactattttacatatcacaaagcaatatgtactggacagagaggaaaaacaaagtaggtctgtgaaatagagaggtttcttttgttaggaatgtatttcatgttaagagagatcatttacattttgttttctttcttgtttaaaggacaagaatatcttcatcaatctgcagataacaatatagtactttataatattgaaacaggacaatcatataccattttgagtaatagaaccatggtatgtatccaacatcatcttccccctcagaaacctttgcccactcttcattgaccaagaaacagagttcaaagtcttagcacctgatctggacacaacttgccttcccagctccatactccactagagtcttcccgttctgtctgctagtcccattagactactgtctttgccttcttgtaaatcaactagcatctttcctcctctttgaatatagtatagcataagataggagttaagaactcagtccttagtgtcagccaattgaggttcaaatcctggctcagtcccttactggtcgtgaaaggttaggtaaggggtttcactacagcaatcttactatgcctcggtattttccttggtaaagtaggaataataatgcctcttttggttaataaaagaattaaatgaaataacatttgcaagtgcttagggcagtgcctaacatagaataagtgcttaataagtggtagctataaagtatgggcacttaactgttctgtcccactgggctcccagtcctccaactttctccaccctgaaaaacctactattcttttgaaaccaagtttagataatactctctttctctttgcaatcaataatcctctcatttgaattcaatcatttctttcttaataattttgcaattgctatattgaatctcttttatagaacatcctaatttgtagtatgttactccttagaaagtttatgtttcttgaaatcacaaagtatatattatctcttgcatccttctcccatagtatctagtaaatttctttgaattatagttaagttccacaaaatatttttttcaattgcattgaaagtctatgcatgtaggagtatgttgataatataatattcttttaaaactacaaatttacatggttctttgttatcttttctgtattctaatcaacctcttcataatttcagaaaagtgtgaatgcttcaaattacggcttatcacctgatcggcaatttgtatatctagaaagtgattattcaaaggtatcaactatttaatttggttatatccaattgtatctcctactaatccacaaggtggtttaaaaaaagtgagagaaagcaagagtctgtctttatctctaaatattcaggccctcgtcaccaataatcttcagcatgatatgtttcaatcttatggagcttgtttgttttaagcgtgaaagtgctttaaggaacagagtccaaaataatacttgcatcatttattaacaacagcacaaacatacttaacaagaaaacaaagagctttaagaagaattataagctaaatattcttatttatttttcaattattatttttaaaactgtactcaaagaaaggcaagcattttgcatcaaaaatacatgttgaatgaaattctctttacccaattttaaagggtataattagaatgaattatccagatgcagggtaatccttataggctgtggaaatcattgtggttttacttcaatacaggtaaaacatgaagggaaaatttctggggtagagtatgcaaagataagctttttatgttaggaaatttctttggatatgctttttatggagtgagggttgaatcactgctgagattagttctggaacttgcacaaacggcacaaaagtccacagtaagactctttaaatgaagactcatttggaattgaaacatattcttcctagtgccttgtgaaagtagtccttttataattctgaactttgaattggatgctatatgattatacattattgatataagctttttaacaactgcaatttgttttttgtctttcttctttctgacagctttggagatactcttacacagcaacatattacatctatgaccttagcaatgggtaaatcacctctgtttattaatactacttaaatctaatacctagaatgttttcattccaaactatgatttggggttaagaagactttatcttcttaatgatctttgtttcttactttttagtaatacagtatgtatgtacccataaagcttacaaaattcaagaaaatacttatatgggatacccacctctttatttgactaatattttatatttttattcacaatatagttttggattttctgtttttgaagatcagattaaacatgtgctatttatggaaaaaacatatataggaaagcacaaaaacattcttggaaatgagacactatttttaggagagtggctatttcactgatgggaggaggaagggcgggagagagatgtagcattagttgtgtctgaacacgtactccattaactgttttaaaattaattattataaaaatgacaaaatgttaacattatttttaaaatagaaaaatatctgacgtgtaaaatactaaatgttcttttgaatttagttggtagataaattgtcagacaagtaccattttccatatatatatatacatataaactgtttgaaacatttaccatttaaaagaaaaaattaaatgaatgtgcagataggcgaagcattgacgaagagaatttctggcagcaagaagaatatgtaaaggcctaaaatggggagggagagcattgtgcgtttgagaaatgcaaagtaggtcaatttgtttgaaattgagggaggggcctgctgactagtaggaggtggtgtaaggttggggaacagccaaggccaggaagcataggccaaataataatgaggaaataattaaaatgagtttagatctttctttctgatgacaataaggattcattcaaaggttttaaatggaaaatgacatgatcagattagcactttagaaaaatcaccctggctaagtgtggacaatgaattgccttagctactcatcttaatatgatatcttgtttgctgttatataaaaggggaaataattatatggcttgaagaggtattgaaaaaaaatcttctggtctatttccccttttgtctagcaagagcacaaaaattttttaaaaaattatctatctacttctttcaaattttcagaaaagaattactctgataaactgtcaaattaagaaacaggaactgctttttaaagtagaatctaaaatccatctaatgcattctgagtccttcttgtctccgaatccatatcatcaccaaatttaagaaatatttattgagccccttctatgtgaaacacatataacaatgagatgcaaatgagcttggggcaccagctctactcttaagaaacgttcgattagtgagtggggaatcttagtctttcagtccagtttctcaaagctctcatcatgtctttgtttttcttttaatcattttgaaattcttttgtgaggctcgccaaattgaacagcattcaaaaagatgataatcctaatattttaatcatgggttatgtaaactttatggcctaaaatcacattaaacatttagattctctgcagtgaatttaatcaaatcactggttttgtttgtttctttgttttctgcacaactatctagtatttcagattttttggtgggggggtggtcaggtaaatacagcataatttaggaagtgaaggatggatggcaaacttgtttgagattctaggcatcgctgaataccaccaatttcaagtcttttatatgcctttgaagactctataaaaatctagcatagagaaaacaaaactactggtttcaagctaggtaggcaaaactgaggagatgaacgcctttgtaaagcatcctccctcgccttttctcatacctttagtgactcagaaaacagaaaatggcagctgtgatggcttgagacatgcgctgagatttttagcttagtgctgcttgtgtgattgcatagataattccactgtatgtagaaaactgagacaatgttacagtatgaaaggtaacatgagcactagcttgagaacaaattgtgaaccaggtgaagaatgtcttcttattttttttttttgagacagggtctcgttctgtcgcccaagctggagtgcagtggtgtgatctcggctcactgcaacctcctcctcccgggtttaagcaattctcccgcctcagcctcctaagtagctaggattacaggcttgtgccaccactgctaatttttgtgtttctgtggggacggggtttctccatattggccaggctggtctcgaactcctggcctcaagaaatccgccgcccaaagtgctgggattactggcgtgagcgagccggccaggcctgggtcaatcttttaactgggctcttgcatccctttcaacatgttcccgatcacccaggggcctggtgctcatgtactgccctctggcggccaggactctcattgcagcaccaatggtcactttccatgggaatcactctccccactcaaaactatgccatgttcccttgctacttgctaggtctcatgcaggcacctaaaaagttacatcaaggcagtgtgtgttacagatcttcacaattgcccaaatattaaaagaatgggaaaggcagaaatgtcaggcacatgttagctccaggttggagagctttttttggaggggttgggcaggagtcttttttgaggctcttcaaattgtgcttgggcggcaggtcttgctctgctttcccacgaaggcagtctcgatgaaactgttaatacaatcttcaagatgacaaaagtcaaaaagtaagcatgacatcctacgactctgcaacacttataaaagtctgaatgcattcttgctgaagaactacaaaagctccacaatgcaagtcacttgagtgcttgcagagtgactctaagcatcaaagtgagagttttggccaatagactatttgaaatttccccatgggtggaggactttacaagcttaaggcatactgcccagtatacaatccgtttttcagtttagcttgagatcagatgttcctttccttttctgatttcaagtcagatccctggggagattgtcaaatggcatcttattttcaaaaatttgaaatgcatatgcattcacagagatgggggttgtgaatgagaatgtagaagagcacatactaaacttcagcacaattatagaatttcagagctggaaggcacttcagtgaccatttcagtctagtgtgtgcaaattttacaatcccaggggttaaaaggacttgagtttaattcaaggtctgccaagaactagcaatgtggtcttaaaaagttctatcagctctctaaacctcatatttactttctataaaatgagaggactgtattagataatttctagagatcttctccactttgacagtctgtaagtatttaatccattcacctcactataaaggtcagaaaactgacacccagtaaagttaagtgacttttaagtaactactggaagaacagcaatcaacacctatgtctccagttcttcattcctgcattcttttcattaggtttgtgggtgcagagggaatgatccttaattttcattgtttgtttattttttctgttcatacagattattatttttttgcattaaacagcaaggtttgttgtttttctttctttctttccttctagagaatttgtaagaggaaatgagcttcctcgtccaattcagtatttatgctggtcgcctgttgggagtaaattagtaagtgtttaaatttttgaagtgtttaatcatgtaaataaaagaggagccatttgattttggcctttgttaaatttccctgcctgaaagaaaaaaaaatacattcatgactattttagtggttaaaaacgggaagagttttgataaattgaaacccatctgagaattccgcaaaatctcaagctcatggatagacttctttaaatatagcagtcaaaaactttatccttatactcagccagaatgcgttgtgccagaaagctcaggaaaaatatggttttcacaagtttcccagactagcttcagacaacatgaaatttggtccaagctcttatttaaggactctaaataaagattagatctggctagctattaatattcagagatttattcgactttctgtcaatatacataattatttatttggggttaatgaaacaactaagaaaataataggctttattttttatttgattcagactttaaaattcataattgatgttaatgtgagttggttggattttttgacctattaaaatggtattttagttgtgaatcttttttgtatctttattaccactctgtttaaaggtattagaggaataattaaaacaaatatacagccttcatttaatttgttgtggaatttccccttaccaccacttttaggcatatgtctatcaaaacaatatctatttgaaacaaagaccaggagatccaccttttcaaataacatttaatggaagagaaaataaaatatttaatggaatcccagactgggtttatgaaggtaagctgtattccttttctactgctaatgctttaggcttttaatttaaaataatttcatatatttagtaagatttagatgagtagtatcttatttccatgaagggtagcattgctgaaaattgtctctaggttacgaatagggcatacgtattttaaaagaacaaattcttgttatcagaaaactggtagaattgattctcaataacatcactatgaagtggtagtaatgatttataatccaaaaaagtatatggtcctcaggtgccgcattagtacattttctcatgtttactttttctttagaaatttttttttttcaaaactaaacaactgactatgttatcttatgggaacatatttttactttctgatactctgttgattttgttctcattctaggtcatgtagaattcaggacttaattggactttaaagagacttctagtctctatctatttatctatctatctatctatctatctatctatctatctatctaaactaactgtgtttttggttttttttaactcttaggagggaaatgtaactttcaatgtttatgtcactctctagtacaattatagttctttctgttttggctatcttaggtgactaaaaaacctgaaactgccctgaaagaaaaaattaattagtgccaacatgtttattatttatttaaaaaattacatttctgattaatgtcattttctaacaaggctaattgatgtttgatatagagtgaaagggtaaactattcctcttaactcagattatgtaattttttaataaccaaagtatgacatatgtcacatccacattaaataaattatttcagttgataaatagctatttagaagtatttacaatgattttaagagtaagatgtaattatagttaatatcctagtacttatttttcagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggtatgttgaatactttcagcgatgctttcattttcctggtatcaaaatgagcaatgatttaccatgagtaaaggtgggatcaacaagtttggagagcttcttatccttgagcattgtaaggcaaacattgtactgtgctctattatttatgtggacatctgttgctttggacatctggttgtgctggatgaagtagtctttgcaaaatctattgcagaatctttgaaaaacatatggtcttgatcatggaggaaaaacaagcttaacttaattttaatttttttcatatttcatgctccaaattcagggtaaagttctgttttgcaattctctcttgaattctcatgtaaatgcaaactagaatatgaaatacaaatgctgaatttgatgttcctgtcaggtagaagcaggcatgggttatggtcctttctggatgtacaagataggttaaatttataagtctcaatttctcccttgaaggaagtagacatggtgtgaacccatagtttttggatatttaacattgtagagttgttatacattctttttattgagtttcacatctggagggaggagacctgagtgtgcagtaggagaatggtcaggtctcagtgaagaagcattatatcctaatttcaatgtaaaaatgatatcagaaaaaatggaatcaaagtacaaatttacctcttgcacaaggaatcggatgcgattttagaattcacttctttgttctttggatgctattgcttttacttgccaaggggaatattgttcgtggctggacacagtgggtccctgggtgacaaagacggttggatgtggtatacacacaagtgaattctaagcaagccaaagtggccatagagaaagaaatagaattgcagacagtgtaatatttatgttaaaagtctaaaagctgtgtaaaaactctaaaagctggagatgtttgggacaggcctcacattttgggggaacccaagatgtaaaagaactcagatctttgggaggacctatgggagcaggaagagacggggaacccagaactgaagagtgactgacactgattgggaagttgggacccacattctcatatttccttgaggcttaaggttgctaaaacatctggcgttaggtggagacgtgagaccatcccaaaaactaagggagtttctgataaacttgggagtgaaacggaggtcctaagagacgttgaacagttctttggatgaattcaaacagcactgagtcattacatactgtgcacctacatttcatgaatttaaattttattacaactccaagattctctctttctacagcaaaataacagaggaactctaagaaactgtctaggtatgagctatactgtcatgtaaattttaagcatacagtagtatagaaagcacaaaacaagaaaagtataaatctcatggatacttcatttggaggtgaaatttccctaaccttttggagatggtggcagtaataatgcaagcaggtaggagactgagcatttggtgattgtcctagaccaaatcatatggcaaaagcaaaaagtgtctttcatttatttttctttccattctcctctcaaattaatcaccctctgaactctccttggtatacagattattataattatcccaataataaaaatgagagagatctgtcttggaaatcagaaaacagaatatggttcacagaactgcattttcatatccaaaatgattttccctataaattttaaagctctctcattaggcagttaaaacacatagttttgctctggttgacacaacatttgtaattgccctgcaggtaaaattgaaatgagattccttgtcgtgttataaatagaatgtattccacagtgatatacataagattgttcgcttagaaaaatatatctaaattcctaaagtttctttaaaatgttggtgataattggaattttatgagcttatatatctcaattttcttggcaggctggagctaagaatcccgttgttcggatatttattatcgataccacttaccctgcgtatgtaggtccccaggaagtgcctgttccagcaatgatagcctcaaggtagttcatctcagatccctcccatctttctatcctatattctagtgcatttatgctgtgcatgctagaagcaaaaacaaataagtagataagagttgcacacaaagctaaagacatacaaaattaaaattgacaaataagtttccttaattggtttttcaaaattagcccttttacacatataaacgtgacctcggtgatcaatctcagtgaaacttgcctcagatgtacagatgtgaacttgggaccaacaagcagacagtaaaattcatgtacgtcctcaccctggcttctttcaagtttggctgactttatctcaagccagggtttgtggatctatgtggatcacatgtgtatgataaataagagaagataagctgaccctctccaaaaattagcatttttcacaatgaagcaggctattctcatttatctggttttagaattgtctagagatgaactgtaggcaggcagggacgtgaaggattctcacttccccagcatgatgccctatgtctgattgtctgactagtccagaatacagtgaccttcagtcagtcctctgtggtctttctggttgaagtggctaaggggaagaggtgcccaggccctgcctgttgggctttcttaacagttccccatgcctagcgggccaatcttgggtcttccccttctgcttcacgaagaagagccaagctcaaatgactgatcactaatagggaaaagaaccccatgagaggcttctactgggccttgctgagtccactcttgtataatcaaacatgactttatatttttgaattatctgctattccccaccctgatcgagtcgatgaaaacttgactcaatacatcatttttttttaaagtgtcattctccacaggtggcagatgaaatgagcataacacaaggagtccagaggcttgtttgaacagctgtaaaatactaacaataaaatagtagtagcaaacgtattctgaacactcatcatgtagcagacatagttcttaagcggtttaagcacgcggccaatctttacagcactctttaaaataggtaatattattattctgattttatataaaaatagaagagttaagtaactggcctaaaggtatataactattaggacataaagccaggatttgagcctgaggtcccttccagctttgtgatttcctttacattaattttccagaagtttgtgattcattttatgttgatgttctctacctactagttcatgctcagagtcatggaatcatcgttgccattcactgacatctagtatgtgccaaacattatttgagttatttcgcatacatcatctgtgatttattccacaagtctgaatttcaatacctgaccacagtcacagctaaaacttagcttccaacatgaatctgctgagagacaaagattatccttttatcacacttgtctctctctcaactaattataaggtgaaaaattgagtttacttgtgcaaaatgcaagtttaatgctttttttcccctctagattgatcagtagctttgacattatgttttaaattcttttctaaaatgttaaaatccagaaacggggagaaaactcacatatgaaatgatttcattagatgaagaaactctcatagatatttttttaagtaagtagagatatttaaactttctctccagagaaaggaatgttttgtcttgcttacctattaaataagtaatgtataataatgacatatatcctttagaaaacaaaaattaagaaattatttgtgtgtgaaactggtttatggttgtgactacctgtttctattttatttgcagtgattattatttcagttggctcacgtgggttactgatgaacgagtatgtttgcagtggctaaaaagagtccagaatgtttcggtcctgtctatatgtgacttcagggaagactggcagacatgggattgtccaaaggtagggtatattaagatcacagatacgtatttctgaagatcaaggcacaatagtggggactcatccatagctaacattttatgttgtaaagccaggattactgcattcaactgccaactgctttgcaaaaacacactcagtattcatgggtccatcattttattaaataaataggataccttttattttcttgaatgacgtaaaccttgaaattgaatagccaaaaagaaaaaatgggacaacatgacattgggaaaatcagatatctggttctcaattataatggtaaaccagccctttgagattataacattggcagtccaataaaaagcaaaataatgcagatgaaaccgaaacatgggtctactagataaatatatatgttttaaacaaaagaaccagagaagaaatgcaaatggggcatgttctattcaatgttaaaaattaaaaattaaaaattctaaaggaaatggatattatcaaaagaaagccagatattctgtttttttttttgtttgttttttgttttttttgtttgtttttttgttttttgttttttttttgagatggcgtctcgctctgtcgccaggctggagtgcagtggcgcaatctggactcactgcaacctccgtctcccaggttcaggcgattctcctgcctcagtctcctgagtagctgggactacaggtgtgcaccactaggcccagctaatttttttatttttagtagacacggggtttcaccatgttggccaggatggtctcaatctcttgacctcatgatccacccgcctcagcctcccaaagtactgggattacaggcatgagccactgcacccagcccaaatatttttattttaaaatcaaatgagaattactgagaatgtgacataagatattagatcaaattattctgttacctggttatcttaggacagtacccgacatgtactaattttgggcagaaaaagcctttaaaactaagcacagatttattgttgagttttaattgtttctattactcaaactcaaacataatctgttgaattaatgagtcagaaaaaccacttaaccaatgtataagctttaaaataagcctgttcttaattactcacattagaatctaagagatacaaaatattttctttaaataggatatttgatgggtacattttgtgagtcttctaattatgaagaaatgtttcattaaaacaaatatagaataatcatattttataaagtaaaaagaaaagcacagaacaaacaaagtaaatcactaaatttcatctagaaattaggacattatgttttgcaagaaaaaagtcatatgagtctgtttggaaatatatcaggactataatagtcaacattactcaggctaaaaatatttctttaaatcactactgtgtctgtgagaggctcgactaattttgatggaatatgctagaagcgtatttttatcttatatatattttgatatacaaagcaggatgattttggctttaatacagtatcataggcaaagaaaggatagactaatcttgattatgctagttaattagaaacaattggtctggttagtcagctttgggtgactatatctttaaacttttcaatgaatctagctattagggactattgctttaattttattagtttgaacataatgagatttataatttagacacaatttttagctcctaaaactaggaattttaaaactgtgattgctttgaaatctgaaattctaatttatcaaaatctgagacaactttaatccaaactgacagaacatttaagatgctcattcaatgaggtgtggaagtccctggaatataaactttagttttacagccagaaaacagtgcttaaatttagaatatcatgtttgaataaccttagaatttctaaacacctctgtttcaaaatagtttgataaatacatgcaacacattttgagatttgagaacaacagtgtcgaatttcccagaaaccatcctcatgactgatgtgtgtgtgtgtgtgcgcacacactttgaaaacaatatttaaggttaagtgacccggcaacattttattcatgctgagagtcatgccccaaacaaagaggcaaaggaaactggcaaaaatgacttgtaataaaattatattagtgagatttattaagaaatttatagttaggggaagaaacatcttttatattatgcttcctcctctgaaaagggaattaaaattaattttacttttatggctaaaaataataaatccaaaaatttcactattttttccgagtcttatcttacttgttctctctgaggcattggtctatccctgtaagagaaaatccagactgtgttcttaaaatttgttattcccctgccttttatgacagtacaccctctcatggttctccttctgcttcattgactgttcttttcctttccagctcttcttctgacttctctagaaatcttattattctccaagttaatgtatttgcaaggtaggctaactgctataacaacaacataaaaacctccaataattcagtgggttaatacagtagaaatttattgcacattcatgtaaccatccaatagtgagtccaggtaagtggggtatggtgggggttggggaatggtgcactctgcttcatatagtcattcgggaacctaggtgatggcatttctgctaactagcttccaacactattccaaagttggtcaaacctgagcatcaacatccagctgagggatggagaaaagaatgaagggtaatgtaagagaggcttttatgggctaggcctaaaagtagcatgagttatttctgttcacacaccattgactagaacttatcaaataaccacggtcaactgaaggaaggctgggaaatacatttcctgcccgtatccctagcaaaaagaggaaatggtctgctgattatcctgctgtctgtctcaactctgtacttactcactttgggtaattttaatctataccagagctttttggtatacttgccaataactctcagacttatttctgaggatttgaacttttcaatatgtgtggcttcattttctctgttctattctcactgccatgagcttgattagagtctttatcattcttttcccaaacattataatagccttccagttggtctctctgcctccttccctcttacccacttctagtatatcctctgcatcatgttcataattatatgttccaaattgtgaattggaagaccttcaaaagacttaccaaacaggagaaattgaaacttcttagggtgccataaagtttctccaaaatcttgctcataaacatgcattctccttcatcttctaactctttcctgtagtcactctccactcagccatactgaaccatctgttgggtgactaagcaggtctggtctctatgctatttattttacctagaatgttcttctttttctaattatttgtctagaaaagtctattcattcttttaggattactaaatgtttgttcagtaaatgatcaattacattatgctaaaatataacccaaaataagattcagtgcaaattttaaaattttagctacttcataggacccagaaaagaaagaatttaactcaaactccactgttttacctacaccacatcaagtggattgtgctgggcctccatagatgttgtgataattccaagtcactgcctcatggaagatttaggcataattattaaggatctgcaataaaattacccatgtatatacaacagtgctgttatatgagatttttaatattgtccttttaaactcaaatttgaagttagttgactagtaatggtatactctgatcaggcagcttaactgtttccaaatgtccagattacatttaggaaaaaaatgttctcctaatactatgttcgatgtgatcttttgtcttttagacccaggagcatatagaagaaagcagaactggatgggctggtggagtatgattttgctatctttttcttatgttttaatgaaacttgacagattctcagctatcaaaggactatttgcaatgtacccaaactggcactacttattttcatagaaaaagtagcaaggtataaaacacataggtagtgatctcttgagtgattttgtgccggacaatttcaatgtcctttttagaattctattgaaaataactcatactcctcatgtcccaattttaagtttgtcaactgaatccttggtatctataactaatattactttttaaacaaatacaatatagatcattgttcaaaaggagacaaaatccctgatctgttaaaatcatcttaataattactagccatttaaatccaaaaaaaaatacattgggtatccttgtaatttaaagacaatctacctcttattaaatttcatataacatgtactaaatttcatgtatgtatactccttccagtatttaagtaatgatttggtatcaaataggaaaatgtgtgtttgttacttgtgatcatttatatttggaagtttaggataggtttattcaataatttatgaggatttttaatgtaaaataacgcttgaggtaaatagcaattgtattttatatcgtatatgaagaataaaaattaatacaagagaataagtgaaggttggtagatgctgccacttaccacaaacacataattcaattcaattagtatttgaagaggaaaggctacttctctaagatttggacgcattatgcaatgaaaaaggaaactcttaggacctggtttaacacattagcccatgatccaaggacaaaaaaaagtcagaaatcgattctaagatgataaattatataaaaatttaaactcaaattggctgggaagaagataaactgtaaagtgataatcttcaaatattaaaaactcttcattgtacacttttctggatccagttgattttggcttacatgctgtttaatttatactctgccgttaattaaagatactgcagttttattcattaactagggaatagttactttatttattatatacaataaatgtaaattacactctgaggtaacaagataataaagataagtatgtaattcagaaaaaaaaaaaaaccctcctatttgaactcacttttcctactgtcctaaatatcacaggaaaaaaagagtagtagtattcagtgaaagaaaagtattctctaaattttatgtattcttaatcaatctgaatctcacctttcagaaaggtaattcttagatcggtatttgaaattttgaggaaaaaaaatctaccaattcactcccattacaaatatttctagtaaagaacgaagggaagaaagaatgcttgaaaatattatttagtcatgttctccaagatgatactataactagatttactatacagttatatgaataatgtacttttatatcaacaatgataccaacaaccctttcaaagacattatcttgagcatctataaacatttattttgacaatgctgcagtgttcaaaacactgaaacactttagaatgcatcttttgaaagctcatatttataagcatcttcagtatcttaataatttaaaaaatctgtattgcactaaacttgcattcccatcaaattgagctgaatgaatgaatgaattgcctgcaaagctttagaccttttttttttttttaagacggaatctcactctgttgccaggctggagtgcagtggcgcgatctcggctcactgcaagctccgcctcccgggttcaagcgattctcctgcctcagcctccttagtagccgggattgcaggcgcccaccatcacgcccagctaatttttgtatttttaatagagacggggtttcaccgtgttagccaagatggtctcaatctcttgacctcgtgatccgcctgcctcggcctcccaaagagttgggattacaggcatgagccaccgcccctggcccagctgtagaacttttttaaaaaacaccctcagtgtcaggagatcgagaccatcctggctaacactgtgaaaccccgtctactaaaaatacaaaaaaattagccgggcatggtggcgggcgcctgtagtcccagctactcaggaggctgaggcaagagaatggcgtgaacctgggaggcggagcttgcagtgagcagagatcgcgccactgcactctggcttgggcgacagagcgagactctgtctcaaaaaaaaaaaaaatgccctcagtggaggcacatatgtctcctttgagagaagatgaggtccttacattaaatcaaaaatcattcccaactaaatggcatgagccaccgcgcccagcccagctgtagaacttttttaaaaaaataccctcagttgaggcacatacctctcctttgggagaagatgaggtccttatattaaatcaaaagtcattcccaactaaatctagagagtaaatgagttacttatctgggacatgtgattttgtgccagatcattttaatattcatagttttataattctattgggaacaacttatttttatgtactaatctcaatctcttaacatgtattcagtagtcagtaaaacttctaaattccagaagagaaattatcaaaaattatttgcaatgattgttttcaagagtcagtttacactctcccaaggcacctgctttaaatggattattaattagcttttgtaagttctgacatgccttttgaaaaagtctggccacaattttatatagccataactcatatttcataatatattgtatatttaatagcttcctttgacctataatgaaactagtgacttaataaaattaaccagaaaaaactagaaatgtgtatgtatttcagacattcattcaagtaacatttatagggtctttagataaagtatacaagctagtcgtattagtataaattttaaaagctatttttgatatatggtttcttttgagtttgtcagagatatttaaaatggaaaaagactctcagaaatcacctatgaattagaaaagggagattaaatgacttgctaaaagtaaatgatctgttagttgcaggcacagaactagaaaataggtttcctgcgaactttacttaccacttttttcctccagcactgacacatccagtcctttaagttaggattaataacctaacttcttttttggtattaatcagaaaaaataacaaaattgcttttaaaacatgtttgttttgttttgctctgtagaggacagaaaagtgaagagttaatcaaaggaaactagtgcttcattccttaaatttggagaacaagcactgaaggcatcatgcttagactgcaaagtcacatcaattattttaaaataatttaagcaacacactacaccgtctttaggcggctggcaaaatcccttggttcaaaaaaaaatgaattttcttcttgatgcttgaaagcttgtgcttttgaccgaatgtgcactcagtttagggcatccgctttaggtcatttaacagctatggcaagatattacatggcggtaaataatgtcaccttccaggtaaaatattttaaatggctttgcacttcatatagagatgagtaatctatcagaaaatctaagcataataaagaaaccagtgtaagggcctcattaaaactgaggacaacttggtgtgggtgcttatctagggtccaggtgtgacttgcaagaagcacttaactcagaacactttatgggcctaactctagcaaaatgaatgtggacatatttcacactctctttacctcacccaagttacctgttcatctaaagcagctgtcttcaatgtgtgcaatgaaaggggagaagataacagtctttgcttatcagaaatattcttcctgtttgcctgattctaatatcttaaaacataacactctgccctgttttttttattttcaataaaaatgagatgctaagttttaatctagaacaaagccctttaaaaagtcccttatctaactgactgcagcttgcagacaatttttctttttactgtggtaccttaaaaatgttgtgattcaggttttattttagtgattaaggcaatgtagaaccaatttttgtgtttcacaatgaggaataagaaggagacataggccgggtacagtggctcacaccttaatcctagcactttgggaggccaaggcgggtggatcacctgaggtcaggagttcgagaccagcctgaccaacatggtgaaacctcatctctactaaaaatataaaactagccgggggtggtggtgcatgcctgtaatcccagctacttgggaggctgaggcaggagaatcacttgtgcccgggcgacagaggttgtgatgagccaagaccacgctatttgcactccagcctgggcaacaagaacgaaactccataaaaaataaaaaaataaaaaaaagggagacattataagaggttactattaagtatgtatattatcatttagctaagagggtgaaacttcattctgaaatgaaagaaggattttgtcaaagacttatagtaataaaattttacccacaaaattgttaatcagagtttcctattcctgggcctcttggttattaatttcacttggaagcattagtctcaatatgcaaaatcctaccaaggttggtcttattattaatgaaactaatgtaggaatcatgtagaggcagctgtttctcattattccattttttcattttaaagaaaactttagacaagttaaaagtagtagagtttatttgaacaaaaacaattcataaatcaggcagcactcagaaccagaagatgttctgagagttctgcccagcaatgtgagcagccaccttttataggccaaacgcagaagcaaggtagataaaccactggttggctacactaggagtcggcctcattgggtcatagagtgatgaggcatctaccttatttggatgtggtgtgatatgatggctgcctatgattggctgaaacccttttgctggactcgtagttaggttttggtttgtatatgtactaaggttgtgtttcattatataggaactcaaattatagagacagcctcaggttaatggccttctgcttatttgatttgactgatttattgattctaggtaaatgtggtgagacttagggcactgtattagtttcctagggctgctataagttatggcaaactttgtggcttaaaacaacagaaatttattctctcgccattctgaaagctggaagtcggaaatcatggtgtcagcagagtcgtgctccctatgaagactcaagagaagaatcctccctgtctcttccagcttctcatggctcctagaaatccctgagcattgtttgtttaacagccgtatcactttaatccctgcttctgtcttcacatagtcttcttccctgtatctctcagtgtctctttgtgtcctccccacctatgaggacagcagtcattagagttagggccctctttaatacacatctttactttctcccttgattacatctgcgaagaccccatttccaaaagggtcacattctgtggctccacgtggacatgaatttttggggaactcagtccactaaagacatcacatcaaattagttgcattttaatgtcacacagttataattatttcatgagaaataatgatcggttgcatcaaaaaggcatcaaatatgaggtcatcattaaaggagcctacagtgacttcctccactcttttcttgctctacaatgggtctcacattaggtctcaccaggataggtctttgtagctaaaagatactagtagctttttgttgttgttgcttgatgcagttctcatgtggagggacaccaactagagagagctggctttaaatctgctctgcatgatgtagagtagctctttcctcatggaattcttttaatgatttgccatcatttcaccaaacaatgaccaatggggaaaaaaagtcagcaaatgtaagacaagtcaattaattttttaatgggaaaaatacgaaactattttctaaaatttggtgtaagaacatttgcagaatttcagttatatctatcatttagaatgttgaggtgtggcttgttctgtttcaaggcacactaaagagcctagcgtaccttaggtagttaattggttcccagcaagttctgcatggggttacctgttagaggtcaaaccagggcattgaggtcagtctgcagtcggcttcctgtgctcaaggagtaaacctcccccaacataggcaacttttttctctcaagtccagaagcccctcctcaccattaaaaactgtggctagcaagccatgatcttttcatcttttaaatgtcttcattgaatcattgatattgcatgcttggcatcagacaaatcaagaattaaaagaggtatagtcaatgagcatcagactttggtcaaatacctcattttaggtttggtttcgttaaatatcaacatgcgtttgtgattcttttaactccgtttcaaaccacataaccttcgacttaggaatttaatcaaattaagcattgtaaatccaggggtatgcagtagcagccaagcagtggtcggaatgttcaagtgcctgtcagaatcactacataagctgtttatctgaaagaatgggatttcagatgtgaatgacagaagacagaggaggcgagacattctgattcctataactatgaccatacgtcgcttttatatattaaaacaaaatctatggttttagtttggtttgtcttttgaacataacctctgctaatttttttcagttctttgtttcaacaccagttttcagctatgatgccatttcgtactacaaaatatttagtgacaaggatggctacaaacatattcactatatcaaagacactgtggtacgttccttccaagatttatctcctcaaagatcattcacttgaggttgctcaaataacgctcagtttcacacaacataatgtttgtctttttataggaaaatgctattcaaattacaagtggcaagtgggaggccataaatatattcagagtaacacaggattcactgtaagtattgcacgaagcacgatgcaccattcaggttttaattggcaccgatggacataaatgatactgtaccaactctcttagttaagaagatttttgttactctataattcagacagttgtgagttcatttacgattgcacatttttaataactagtcaaaatgatttccttttggaaaaaagccttcagtaggtgataatttctcttctgatatttggtaggcaattatataaaaagtatacaaattttaagataataactcgttctaaaggcaaattttacccttcagcacttgaagcaatgaacaagtttcaaaattccctggagggcagcccatagatatggagcatcttttgtagtgattcattgttatataagtttaacattattatttataacaactgtcatttatggagcaattactgtgtaccagatactgtaaagtagaaatgattatcctaagtttgcagatgagaaaagggatactcataaaatttaattaacttggccaaaggccacagttagttagtagcagactaggattcaatcctaaagcattaaatctaaggctgttattatcaacctgaacatgggactgctttcttacagttctttcctcttcagtccattctgcatactatttaaataaaccatcttcaaataatcatttatgataaaactgatctaatcacaaaagtatactttctttctataatttctaatacagtctgcatctagggatcctctcttagtgctgaaaatctgccagctattagctgaaattctaggagcaaaaagatgaggaccattagtccaggctcatggaataaaagcctgtcggaaatctattacgaatctttggaattctttgaatggagggcaaaggtgtttggactttctttggagcagtcattaaaatcactagagtaaaggggagtgacatgttcaaaacaggtgggagattcatttcaggcatgatgtgttgaggaggtggggaaaaactgaaggcggaggtccctagctctggtcataagaggcctgaactagaagagtggcaatgtaatagatgctctgaggacaaaactgcacctccttctttgtttgcgtccttagcacttagcacagcgcctgacacagagtagttcaatacacattctctaaatggaagagagaacagagtagatggtaaaaacagatggaggctaaacaggactggtgaagggagactgtcaggaaaaagagagagaaaagagacaaactggacctggctgcaagggttagagagggagacaatcagggaagcttccacataacaaggaagtggccgggggctgttggggaaagatcctgagtcctttattcacagatagttttagatgatgtggggagggcaaggaaaagggatgatgggagtcatgcaaagttataaagatgcatagaaaggtgttagtttaggaaataaatttcgtgctaaaaacgagttgtattccattgcttttttcttctacttggtgctaataagattttcatgatacctgggacatagtgagaactggactgcctaattgtcctaagaattcaaccaaacttcggttatcccaaacttttcacattcgtgggggaaaaataatgacagtttctgatactcagatgaacatacagcagagtgaaaaccatgtcatgaaactgaatttcccacttcatggctattttaagacaggttggaatcagaacctggatacttaagtaaaagcatgttctcttatgacttcttttgcatctggctaaattgacatgccctgtgtgtggtatccagtgtgatatcctcaatttgtagcaaacccatctattgacagggcttctataaaataaattcaaggtgtgttcagaatcccagataaaattaaataacgtagtacagagaaacaggtaaactgttcttaatcataaaaaagtcaaggtatgatattaataaaatttcctagttgattttgcatgactcataatgaatcagaatataatataataaaaacagtattcagcataatttaatcttcctctgatgatttggaagccaggataaatgtgcaaagttcagttatgaacagcagttatttgtgtacttaagcaccaattaattgtttcattagataaatgcttacctatattgatactatattagtattaatactaacaatcctattatcacttatttatcaatacttaataatttctgaatatattttcaggttttattctagcaatgaatttgaagaataccctggaagaagaaacatctacaggtaatttatgtccattcattctggtatttctatgtgttgatattttaatataaaaagtcatcatccccaggagatgcaaaatatttttaaagtatggcacataataaaaatcatttatgaatttagagaaaacatttggagaatgggtataaaaaacacacactcgcaaaatgttagccaattcaaaatatttgttttcaaaaggaaaaaacaagaaattctaatgtttacatgaatactaaatactattctggtactaaacactttaagtacatatagaggtaattgaggacatttctttatttaacacacatttgttgagtacctagtatgaaccaggcattgtttttattctgataatatgtgatttccttcactctgtctcactttggcaccacccatgtctgttcctatattagtgtttacattcagtccagttgttcccttgaggactgaaatggtgccctcgacagccctttctgggtgtggaaaggaaagcaatagttactacatgctggtagtctattatatgccaggcaccttttaatctgacttacatatgtaatttcatttaattccaacagcactatgaagcaggtaatgttgttggagccaggatttgtacctgggcatgctgatctctgagcccttgctgttaactgcctccctaatgtttccaaagttccacccgaatagggacatatgttaacatactaaccctaacagaggaaataagaaattttccctctgtcatattcccctgttccctcctggatcgtgatcttactttatgtgttaaaaagaatcactctctgggtccagcagtgtctctggcctggccattctctgccatgcccaaggcaaagtcagggacagcagcagaagaaactcacaggttggcacaggagaccctgacaggcaccatggggtcctgacctgtccagaccctggcatgacatcctctaaactcctccacatggaattctgattctgagggtgtcggataaggtccctgagtctgtgtattgaagccaatcaccctgctcaggaaccacacagatgactctgcagggtgagtgtagggccaatgtgggcagtgcagattggcttgtgtagactgtgtggagggggcattcccagcctgagcttccatgagcccaaatttcctgctgaaaggaatgaaggcgcagaaggcacttagaactgtaatttcttatttccaatttgcttattattaatttccccatcctgatatatggtaagaacagggactctttcttggtgatactgccagattttcttgctatgttttgccatggggtggaaacagagagatagaaagacgaagaactatgcattcccaagcactttgtgaagtgtaagagatgaatggttatgggaagtgactacctcactgccatttgaggtgttagatatttctcccactccagggaaaccacatagggcttcttcctcaaggtttgtgcctattaaggcaaagatggatcaaaaatcaagctacatcaaaatactgtgattcccctttactttaaatgatattggcaacagaaaaatagagtgggtttgatgtcaatatgtaaattagtcactttacatggagtagtacattttgataaatacaatctcaaaatttcagcttagttttattttcatttccctctagaattagcattggaagctatcctccaagcaagaagtgtgttacttgccatctaaggaaagaaaggtgccaatattacacagcaagtttcagcgactacgccaagtactatgcacttgtctgctacggtaggtaacggacctcacataagcacagcatccccacaggcatggttgtcatcctcctcacctctatctgatcaattcgtagctacagttaatgagcatttgttatatgtaagaatcttatcttgtgcttatagaaaaaaaattaaaggaggataggaaggtattattatctttacttttttgcaactgaggaaacagagtttggggaaacagggtaacttgccaaaaggtccgcactgcagctaagcatcagccaggactgaagcaagtgctgttgcctctaagtcccatgctcttaaccaccacattccacagcactaagactgcgtgcagaggcaacccgtcagctaggcttcgcaagacctgagcaatcgcagaaaaagaaatgttctctgataaaatggttgctggacttttggccccctttgcccagagaaatatcaaactctcacatccaggggaatgaacaacggcttggaaacccgagatgcccacgtcggaggtcaatcattcctcaaactgtagtttcaatggggatagaagatgaacctttgtcctttctaaatttggaaaacatcgtaagtaatgcatcaaatataacaaaccataagtaataaaatctacaaaacatttcctggttgtttaggacatacgtacatttaatgaataatttctacccatataattttattttatgtgcaaccttttatctatatcttgagcatgtggcaaacaataaaacaggttaggttaagaggccaatatagatcaatgaaatatattggggtctaagtagtcattatggagatttggaaaactgactcgggaatctctaattctccaatctctgtcacctccctccagcttattcctaatttggggctgagagttagagtacttggaaaaaggtattacaaaatgtatgctaccctcctgttttggtatcagctcccctggtaggggtatgtggcttaaagaacaaatggaatctttgactgcttgatatccctattcagttgcagaggccctgaagatctcataaagggaaccagaatgaaggctaccctaacatgccacttccctcagtccagccacctggccccggaacctgagctgcagctcatttgactacgtggacatgaataagcattttaacccaaattctcccttgaagatagcacaaagatgtcagtttgaaataacactttcataaaatgtttggtcaatggcatctttgaaatgtcaagagattgttgttcatgaccatatgtgctgattgtggttactggcatttaaaggtatacattaaatgtccctctcaagttatatgcaacatttttcaacctaagctatatatttatgcaacatagattgaaagcttacatgccaggcacatagtatcattgagctaactatactgagtcatctgtttatctatctttttctcctggaaggcaggggctacattcttttaatctttgtatttctaagaccaagaagaatgtctaatacataatagacattcaatgtttgtggaattaacatagatatgaggtaacattgctgtcccttgcagtctaccaaaaaagctggttttatgctgatgcatttgctgatgaatgcatcagtgacactacatttacatccatgcatttatatatgtatgcattctgcatttgtataatgctttaatgtttttggaaggcactatctcacattttgtattacgttgtcttcctaatatctacttgagcctgtgtgcccactgaagagatgaagaataaaagcctaagctctcatcaaaagttggtggaagagtcctttctagaacttgaatcgcctgacttttccaccactcactcttcctcggcagtatggtaatttcccatttagcaaaaaatatactgtgtgggaagcatcacatcgtctggtgtttttgaagctccagtaaaatgagtcactgcgccatcataggaaaaaccttgaaatctttcccttcaggactaagagtaaagcctcattatgtaacttcaaactctcccgagggatggttagtaagtcccagatgataggatcaaaacaggtaaaattatatcgatgatgctgatggaacaaaagcatgcaaggtaggcttctcaaggtctgatgtttaggccactaggatcacaccttcatccagtgtcaaatacagtcagtcatttatctgtctcattttttaggcaaaaaaaaaaaaaaaaagatatgcaagtttccattattgaaactacacactcatgaaaattccacagggtagatgctggttgattagagtctagaaatttatattcatgtctcatttctttgcatgctggctgaaaatgtaatatgtgtatttgtcctttttcataactttgatgaaaaactggccaaaatgaaaatctctgcaataacattctataaaattctgagattccacacaggaagttttgagtcttgagggagcctaataaatactatcctttttcctcatttccaaattagactaggattcaggcaggaaaccaaaatattatctttacttgtaaaggctagttggaaaatgtggtaaagctgtgtggtttcccaatattgcatcccagaattatacttacacaaatataggtatgacagggcagccaccatcttcctccatggggcttggcactggcacaggtacagcactgaggaacggatcaaaagcatgttctctgcaggcagaaagatgccagaagaaagacagaaggagctactcatacccaagtcttctcagaactctacaaaaaaatcatttctcctctgcttagcatgagccaagcatgctactttaatgggttccctccacatagaaggtagcatcctcaccctatctggggggggtggggtggcaaatgaacatgtacctccaacctccacatttgttgcttttaacctactgactgagcaaatttatgcttaaaaggtatatttccagacattatttgatcctgtatttcaaataaggaataatttgtttttaattatttgtagatcttgctaaaaatggccagtttctgcatagagaagctgaatgcatgttggaatatgtagtggacactggtgtgccagccagatcccttcatccccatcttcaggactgactcagtcatttcttcagctactgagagtgctagtggctgacaacttacagctgagcacgccccccaaccctacctccccccaacccgggagaagagaagagttttctcttctcccgggccacatccaatgctaggggggtaaagctccatgctagggggtaaaagtcagccttgttgccccattggagacaactctacaagctatctaggggtctctatgtgacagcaatgacatccacctttcttccctgccctattcttcctccctttcccccacaagtgtgcatcccaataccacccccacaaacctccttccaagactgcttcccagggacctgccacagcatattttaaaaggaagtatatcccatgtagatttctgcatgtattattccatggaaaaaatactcgattttacccatctaaataagctgaacattgaaccaagaagccagattgaaaatacaatctgggtactggtgaaggttgtttgataataaagacacagccaaaactggcccaatacagcatgacatcttcccagaaggccatttgtcactgcagcttctggggtgcatttgtgtaattcgatattaatgattcaggattagtcttggaaaagtgcacaggcaaggcttctttcacagctgttctttgagtgggctttgatctcatgtattgtttaaatgtgacttaaaagtgatgttttcttctctatggggaaaaaaatagctgcagaattaaaagatgtactggcacttgacactaatcacaaatactaccagcagcccgtcttgaaaaggaattgttattttaacactaagccatgattttgttttcatcctgcccacaggcccaggcatccccatttccacccttcatgatggacgcactgatcaaggtactctctcttgcatgttatctatcttgtctcaagtaatcctgaactctctgtgatgctccgctagagaaagcaggacagtttctccacaccaccaaggggaactgcgatggaatcctgttatcacatcacttattattgcacagatttggatattatttgggtcaaatatgatcctatgaaatttaataattctttgcagtgagaacctggcataacacagatagatgagttatatcagagggtttaattctatcttctccaatcagccttataaaaagcacagattagaattgggaaaaaacttagcacattcagtacgatcttccttccaaaatagaatccctagggtgtttttttttttttttcctcagggattgggggtagggggttgtttgcatgtgtgtgtgtgtgtgtgtgtgtgtgtggtaacatcccaaactggaaacaaattctacatgtaacttcttcagttcagagcagagggtgactgtcacaccagctttttttgttttaacagctacatcacattgttgccacgtatgaacgccctgaaatttggaggctctttccattttcaactgctatcaagacagtcctcctctatcctgtatttgtgatattggttcaaaatagttcacatctcaaagacgaccagttttgctcgcagcagagttgtccaagtatctaattgctctgatactcttcctgctggctctccattatcttttgatttactattaaacaacattatagggttggagttgttggaggccagggacaatgaggcagatgccactttcttcagcactcatgcctgcgattgtccctggacagctttggtgacaagtcaggagactgccttgggattactttggctgtcagctcaatggctcaagtgtaggtgaaaataacaagaaaaaaaaacaaaaacagaatcaatttgggaactctggacaggacaggcattgtgataatgggactgtgaatttagtttcattttaaggttttttttgaaaccttgtgtctaataaggaaatacttttaagaataacagattatatttcttaatttgaccatctcagtcagtgagattgatttcaagtcgacaaggttttgttttaatagaaatcactattagcatataattctcatcttttcaagactgcaaaataatagccagcctttctttttccatagcatgaatttctactttcttgagatccttgttagattcctggcagatctgtgtactgattttgaagctctattacttcactcactatttacaaaataggtacgccctcagatatgtcagatgtaattaaataagtaccaacagaaaaaatcaaattctttcagagcacagttccacaacttacctaatgtgaaattattctcctatgttcattataaatacggattcccaggacttccccaaagattttaatgtggtacgtcttaagttatgcttggaaatttgtatttttaatagtaaatgttcagctgctgttttggagcagatgctgtgtctcttatttacattgcatttggtgtcagcaatctcattcaacaaatatttatggaacttctaccacattaagccaggcactgtgctaggtcctggatctatctataaaataaagagatactgggttagacgatgtccttgtcctcaaggaggttatagatgagtggggaatatgaacatggaaatgggcagttacaatacagtggggtaagttctaagataggggaactgcagaaagcctggaagcacacaggaagagcagctcatctgggtttggggggttaggaaatgtttactaatgataactaccacaaacccgagactcatgaatatgaagtaggtgataatgctatttggatgattggcttgatactaatggttttttactgaaatagaggagtcattgtggagatcaggttttgggaggatgatgaattttgttttaaatgttgagcttgaggcactgatgagatacctaagtggagctgctctgtagtgacatcattttggatctggatgccagaagatcagtttggactgaagataacgatgaaagtcattaatttatggagcatgtggtaactcaggccttggaagtggatgatatgagccgagtggacaaaacaagagtggatagggttagtggggagtgagcctacaacgaaactgtgtggaacatcaacacttgagaaatggaaggagaaaaatgagcctggagaggagaccaagaaggaacagaaggagggggataaacttgagagtatggtattgtggaaagcaggggaggagaagagctcaaggaggaggaaataatcagctgtaccagatgctgcagagagtgagggaaggcttgctctaaattaatggacttagcaagagggagattgacattagcttggtcagagccatttcagtggagcagtggaggtggaagccagattaaagcaaaattaggtctgcataagtaagtttaaaaagacagtatttccagttggtctgagtgtgatgagaagaggggattggtgggacgatggctgtaaaagattgatgtaggtttaattttgtttttgaaagaggataaacatttgagtatgagtggatgtgatagaggaaatcagcagaaaaaatggaaggaaaacatagaggagggaggtccctaagaagttgagagaggatgaagatcagagacaggtaaatggattaatctcttgtgatgtgatgagacagaataaagaaattgttggtagaattgcatgaaagttggaacacagtgaagtggcttcattttccctgcaaagagggggaagtttatttgaaaacagcaggtagtacttgaaccagattccgtgggaatccagaagagctggaattgtcagggagggcccagttaaagcttagttgctttgggcacagaaaatgctcattaaaattaatcaattcatgacatgcccttattaatcagcctttctatggattctccccataatttaatcagcaatatgggattttaaaacgattcaaacagaaatcaagtataagatccatcattgttacaactcaatttcatcacaatgaagagcctacaaatacatgtggaagcagatactacatgccagatactaggtgctgtgtgtgcttggtactgagtatacggtgatgggagaaagaaagtaaaatgtgtggtctgacctgtactccctttgctaggttatgggtttttaatgcacagccttattgagaagcccagctgccacctctcactcttgccactgccccctgtgagattctgtttgtgctccaagaggtggaaaaattgcccagtcactatccataaaaaatgcaactctgaaccataaaagcatttagattaaattttgcatttcattaagtcatgtatcagaaaagttcgatagctaagaatagaatgaagaaggagtcaaagccataaccacgtgacaacacccggatactgtctcccacttccagtgcttgtggtaaaataatacaaatagtaatcagtcaatcaatcagccagtctgtgtgcttgatccacacaggagtctctttatcgatggcagctccacaaacagaatccacgcaagaatgaagggttggctctactgtacttagaattgtgtattcattttacttttttggttttaacttttaaggtgtcacaagtatctcttccctgatggattacccaaagttaatgtgaaattcattatgtatcttatacaaatcatacccaaaacatctatacttgtgctaagattaaatataacatgttggagcaaaatgccatgagtatatgaaaactgagagttacaagagaagtggtttggcaaacttagtatagttacaagcactcctccagctctctctcttcagagaccactctttcaaaaaggcataaaaacaagaagtccatggacatcttttgtagcaatagatatacctcacaagtcatccagcccctcttttaaaatataaagctaaaactccacatattatttgaaaggctaacttttctctagaagatgctgatatcaatcccaggttcaaaataaggtctataaaaagcccgctattgctagaaacctatttgcatgtattaccaatctacagattcaagagatcaatggatttgttccttttcaaatattaaggtgtgaaatataactgagctcaagtataaatagcaggttttagattttttaaagatttaagacagagaaagagcatagtgtgtgtttgtgtgtgtgtgtgtgtgtatacacaatatatattgttgtcttactcagatatatcactaccttgagagaaaggatctgaaagaatagcatacaactaattcaattaccaaaaacaggagaatatcctttattaatcaagtacaacaggaaagcgtaagaaagaaagattttaaaaatcacagaaataatattcaactttacacattaaaaattaaaaagcaaattttggaaatacacaattaattattttaaatttgaggccccagcaatccagattgtatttccactacatttttttaagtatatgataaaagaaatatcacctgcttaggtcatggctttaaacttaaaaacaaaacagctttagatgggaaaacgtgattgaataaacattgttgctcctgtgatttttgctcaaaatgtgttctgatgctattagaattagttaaagacacagtgattaaaatgtgatgtccttcataagcttatatctgctctaaaggctggattataaatacatttgtcaatatgaaacttcacttcttaagcgagcttttcacagtttcagtttcacccatattgaagtcaaaggaattttaaggaaaaaaattgtttatggaaatactattgattaaaaatgaacatttaacatttttcagaaattaaaatcctggaagaaaacaaggaattggaaaatgctttgaaaaatatccagctgcctaaagaggaaattaagaaacttgaagtagatgaaattagtaagatcttttaaaaacttctcatttatagatatgaagctgagcaattttcttgcttttaaaaaagcatagagtgaatgttacagtgcaaattctgcgatctattaatattacaggatttcatttaaaataatcttactgtaacaattcttagttttactaaatatctttaatatgtttgtgaacatggttgatcttataccttttcaatagcttcctttccacactgacgtttttttaaaaagagcttatctaattttaattttaaaatgtatccttctagaacaaatagtaattcaaggtttctagtcatttatacatttaacacaaaaatttaataaaagttacttttaaatatatcctaaattcttaacaatttagtagttgaaaattgattttattgcatatattgttattaaagacaataaatgatgctactagtgctgtggaatgaagatttttctcctttttttttcctcaaagctttatggtacaagatgattcttcctcctcaatttgacagatcaaagaagtatcccttgctaattcaagtgtatgtaatattttctttggtgtaaaaactatttactgaaaatatgttagatgaaatacacatttatgaaatagaatgaaccattctccttggtaacagtgcctattgatgctgtttttatatattcttcaactaatcagagtaaataaaatatggctatttaaaatagattgaggaagttttgagattttagctggacttgcttgcatttgctgtgttaaatttcctttgtatggcaatttgccgaatgtgtcagaatacctttgagatagagaaattgcagccaaaaaaaatattgtaaatcatcttcacatcttatgtaattgagttagaaatgaaataaaggaatagaatacatttagtggaatcacacccaaaatcagtgctgacctacacacaatttgcttaaaacaccatgcattttttttagtatatcttatgtctgcttttagcaagtggcaggtggcagaaatgacgaaaaacccacacatattccttgaaatgccaaccctagatgtatccgttttggggaataggagaggctgtgtcccaaaacaacttccttgtagcaaacctctgggaaaagcctggactcctcttgattttgagccagttctaacgccattgttattttatcacataattgtactggaattactagaagcaatgcttggccaggatgggaaattgagttttacaaagcaatcaaagattcttgttttttttgtttttcctttaggtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcaggtgagcaccttctcattcaagcagatgtcaacatgcaacaaaagtcatgcaatcactattgtgtttctccattcttcatgacttaattcttttgtttttctttttctaacttggtctaaaactatcactaatcttaaagaggtatttctgccaaatatgaaaaaaaagtatttatggaagagagctaacgaatgtgtagaaaaatgatttcaagtgctaaatgacaaataccctcttttgatgtgttgtcattcattccaatatcttttaatttagttccatttcttacaattgatagaaaaactttgaactctaatgatgatcttcaggaaaacaaatatctgaatttgctcaagcattgtggattctgcctcttaagtttagaaatggctcaagattttatcagcactacatacttttagatgttaggccttcatttgtggttaaactagctatcagtcggccatggtagcatgaaagtgtttgcctattttcgtttgacaaaaacatagtcattttacacaacagaaattatattatgaaaacatttagggaaaacacagattcataatctgatttcttcttctcaactatatatattttcaaccatgatttatggttcaatcatcttttcctgaaacaggactatataggcaccaaaattgtggcttttttagaaacactgtgcaaataattcttgccatgtctctatagttgttgggtttcattattatgttatgaataggtgaagctaagaataatagttcgtaaatttaaaaggtagcaggctaattgcactctcagtcgtgaatatatgtgcatgtgaggagctaaaggtcaaacactgtttcacaggcaaagagaaatttagaaatttctttagtacattttttatccccttaatgttattaatacttaatgatttcactgcaacatgcagaataaagattgtatttaacagcctggagccaggcctagacaacacttttctatatttttgtctctaatcaaagcagaagagtttagactcacaagtaattatttttaaaaatagaaaggtgtccataacccatacattttcaagtgcttctttcattctgggaacaaacaaaatgttcaattaaaaaaaaagtctatctgagtacaatacgacaaattagtaagtaggttactaacactaaaatctgtagctatcactcaatttctggaagctccctctttcttatggactcagacttttggcctttcaactattcacttgtttggaggagatagttcaaagaaaaaccccactgagacatcagtttctcctataaagactgtagtgtgccttaatgagaatattaacgccatcctcagaattatagcttaattccatgggggactttttttagcaccatggctcacatctatttgcatttaaaccatgcaataaacatcaaggacatgtaatcctgggactacatgaaaacagagatgaaaattatgcctcatttataatttatttagatcttttccaaagctgaaagagctaaaaagttgtttattttggcattggttaaaaaatcattgtcttcatcatcgtcatcatcgcaacccaccagtaacaacaaaatatgtcattatacttttatgggtttatttaccaccacagatgcaccatttgaacctaagaagaaatagcttcttaatattttccttggatgaaatgaaaatttaaacctgagccatgatattcaacatacaggacacaaagccataaattctaccttctactgattttcgcagtaataccaatttgtctttggcatttagaattgaagatggactagaggtggtaattggatacctctactttctctgagccatttttaggatggaatctgaagaaagtcttcctgctatagggaaaacatatgttcacccatatactcagccattcaacaacatagcaaatattaatattaatacatgccattgcagtacactctgtataaaattgtgcaatttgcaatttctgttttcagtgtgcttgcaatctggtaaaagtaaataagccacctacactctgaagggacaaaattgttgttagatcaaacttttagtaaacaccccagagaatatgggcagctgcgtggccccatgcaaagtctataaacaacagtggagatgacagccagagctggccttggtttttgcttgaaattgttcttatgcaactgtgaaaaggaagccttataatccaatgctttgagaaaacaaaagctaaataggatagactcagaataataatcctagggatgattcaatatacctcctaaggaagtgttttaggaatcagacactaaatgcctgacctggggaattgagattataatacttctactgtagcccttaaattgcctctcagagaataaaatttctcccctgaatcttttacaaaatgcaatctggctaagcttttgacataccaaaagaaaatcgtacgtacatatttggaaacaacagtaaatactactcaaggccaacaaatagatttaaacaaagcaaagtaggggaaaaaaagaagtcatatcgtcttataacttctatctatgtgaaagaaaatgcgtcagaagagatgtttgtgaagctacagacataagggagactggaacccgctttctttaggtgtctcttcaaatggtacatatgtgagacccttaaaactttggtggttataagggcaactttgctcatttggagtatatttggcacttttgatattcccacaactttaaaatttgatataacttgagggttagtggtggggaagaattacatgagatgaaattttctatcatgcttttatagatggcatgaataagaatatttctaaaataggataataattgatcgctatgattccaagtttaccttggccttgggccaactttatgagagaaaagttataaagttcaatccagactccaagattagaaaaacatccttttcatttgttactgacattttgttgatataaccacattatcaacagtatttacaaccctctgggaaactcttcagaatttgaaggtgaattttatagtgcctcgttggtctggaagtgctaagattatctagctaacctttaacctagtcctgcaacattcagtgttaatgtttcatttccatgttaactattgcactatcatttcctgtaaatgtcatcctttcagaataaacctaggaagagagctgttaagagtttcctgttcccatgtatcacctgttatttgctctttaccccagatgtaaggtagtatgattgttggcttctgggagatcataaaatcacaattgattttatggctcagaactgtcttcaagcaccagtagcaaggttattttttttttaacaagaaagtgaaccttctcttctttcatttgatttttgaagtttgtgcaagaattgctcaagtgtcacaatttgctgcacattttctcctctataccatgagcagcatccacacaggtagcaactttccatttgctactgcatttcttctctgtagactcctcagtgtccttcagaatcagtgtcgggtaagctgtgactaacggggcctcttcccatctgtttgtcccgggcatttgcccaacttctctatgcatcggaaacgtgcatgttgaatcaatgcaagagcgaaatggttgctgtgaaatccctttaagaaactacattattcaagtaatgaaaatcactcagttctacttccagagaagaactgatgagaaaggtctttaacagtaattgaatggaacaagaagatagtatttttctgggactgtgtgtctcctttggtcttctcccctccttcctgtcactgttgcatacggtggtttctgcaatggctgatccagtttgccacattccactccggctgctgtttctctgagattttcttgagtttttatcaaaccaatccccagataaatcacaattgctctagaacaccagccctcagggtaacatgttagaaattagcttgaaaccctcaattttgagggtttcccatgactttttaaacgttgtccttcagtgtagccccttgctcctaaggaaagatttattttcaaaatagttttcaaatggatgctcttctgtgatggagctaaaaaggaattatttccatattaattaatgatgaattgaggatgcctaagtatgaaatggaagacggttgtatatttctctcaaatgtctctgaaaatgaagtgatgattatcattaacaacaatgtgataagaaattaatataatttaaagcagcaagaacaaaatccttctttccgatagctggggatttggaaacttggtcctgctcaatgctgctgctacttcttgtgtcactatgaacccatcttttggcctctctgagtctcaggtacacccccacgattagactacaaggccttataccgctctgacattaccagtcaataactgtacaacagagtctaagggaatccttttatctctttgcagaaaacatgataatattattttaattatttgtaaatgcaggcttattatgcatgtgtttaaacaaagaaaatgtagcgtttctattaaatctttggattaaatatggttgtgtaatgaagtaaatgtcatgtgtatacacttaacattctaaaaatttgtttcttttactttagaaaattcatagaaatgggtttcattgatgaaaaaagaatagccatatggggctgggtgagttgttttatattttttatgcctgttattcagttcagcaatcatcattttctgaagtgttcgtttagaaggtttctcatgaaatgttaatgttgcaacataatttaatctgtcaatggaaacagtcagtttggataatctgggcttcaaaatggtggttttaagtgtttgttcctttttttcaatcttttcttccctgtacagtaagttaactcataattgacatatttttacttaagtctttgttactagattatagcatactgaactgaaccatatccgtcagagggtgaattgcctttgttattttaaagttaaatatataccttttattttatatttctattttataaaaattggagctacaatttgaaatcacagggactttcagaatataaattccttagtacctagcctagcagtcatatcttagctgtttaattttgtttctttttatttggcaatcaaattattttagtagaccgaatgttcgtttgtgctaactggagaaaagtactatttagtttcctaattataggtcatggagataacttctcacacttgaggagctattttgaaaatacacatttaaagaaagtggcaaaacttatcgtttatgggcaatgaagtcactggaaagtttagagaaatattggaaagagttgagatttgcccattataaattatgataattacccttcaaagaagatttcctgtttcactttttggtctgaatttgtacatttgcaagtcaatttgcagccatttgtgcctgggttgtttttcttggctgttttctctgagagcggcctgcacgagaagaagggaatgaaacccaatattgaagggaatctgcaagattcagctccactcagctcagtgaccagatgaagagctgttaggaatttgaagaaagttgttacttcaagccatttggtccttcttaaaactatcaaatgttaaatatctaaacagaatgaaattcaaatgagtagaaataaatgaaatatttctatagtgaaatattccagataataccttccctatcatccatttttataaagtttcctaaagcaaatccttgaaagattctaattttaagttgaacatgtacatgtaatcattaacatttctcttagagttggactttgcttttgctgcaggctttgaaataaccataaagtagaactttttattttatttatagaacattctaggtattagtttggtagaaaaccatctacgtgggatgattttctaaaaacccactcatcacccaaaaatacatccctatcagcctgaaattcttcaataatagattctcaccacatctagttgggcaaatgccactgaaatagtacattagaacccccacccgtcaattgcttactttccaacatggtaatgactgtgaggtcgactcagagcaaatttgagcaaagaaagtaagaaatgggctgccacgtgatataacatctgagcagaaggaactagtatgtggataaagacattaatactatactgggttttaaaatcagctcttcaggtttaagatgcttattaatccatctgtctaatcactgacttgttcattctttcatctacatagtacattttctacaaggtcttgtactaggttccttaggggatgaaaagatgagtaagtcgtagtcctggccctcttgtgggggaaacagacaacaaaataagcaatggctcagcaatcttccaagtgttaagagagatgcaactcgctgtggagtacagggggacaagagtggataattatggctgtgggagctaagggaggattccaaaataagttagcatttgagattggtgaagatagctgaggaacggagcattccaggcagagtgaaaaccacattgcccaggacctgagttaaagagcatggtgcacacagggagactgagctggccagggatgcctgaaacttcaaaagtctaaagtatcttgaggaaagtatagaaaatgagtctgaataagcaagtatacagataatagtctttaggccacctaaaggagagggatttgtgcatgcctgtgacacctttctcttcattcttctgtgcctctatgattgttacaccttttttattttttttcttttttgagacagaattgctctctgttgcccaggctggagtgcagtggtacgatctcggctcactgcaacctctgcctcccaggttcaagcgattctcccgcctcagcctcctgagtagctgggattacaggcacatcccaccacgcctggctaatattccttttttcgtttttgagacaagattttgtcatgttgcccaggctggtctcaaacccctaggctcaagcaattcacttacctcagcctcccaaaatgctgggattacaggcatgagctaccgcatccggcctccatttattatttaagtattggtgtttttctgggtctggatctcgccttgaccctcattagtcttcctttccttcggcaaacccttgtggtgtcaaagatgatgatgacttccagatccctggcaccagcacacacctctcttctgtgctccatgtttcaaatgcctgctgatcatctctcccacatgtctcacatggacctcaaacttaacttacgcctaaggtaaacttgttaaagcctattttaaaacaagtcttaatcttcattaaggcttctccacacacttattcacccaaattcgaaatctgagagctgttttcaacctccccctgttcctgttcctgacttcaacattccattgattagtaagttctgtcaattctacctttaaacatcaaagtctgttctcatcatccctactgacactgccttagtttgagtttctccatttgtaatttaagccagaaattctcaaactttagcttgcacaaacatcacctggagagcttgttaagacaccagagattctgagtctgtgcttctggggtggggcctgagagtgcatttccaacaagaccccaggtaatgctgatgtttgggtccatggaccacaggtttcgcacttcaatttattctaattgcttcttacctgtcctcctgctttggcttcacaagctccaatgtggttaatgaagttatcgttccaaaacaatttttactgtgtggcttttctgcttatgtattttataggactctgcattgcctgcaacacaaagcccagatacctttcctggcatgcaaggcctttggcagtctgactccagcttagttttccaatctcatctcttgccacttctccctgtaccttaagtaatttaaattatggccaggagtggtgcctcatgcctgtaatcccagtactttgtgagaccgaggcaggcagatcacgaggtcaggagttcgagaccagcctgaccaacatgacgaaaccccgtctctactaaaaatacaaaacttagccaggcatggtggcatgtgcctgtaatcccagctactcaggaagctgaggcaggagaattgcttgaacccgggaggtagaggttgcagtaagctgagattgcaccattgtactccagcctgggcaacagagcgagactccatctcaaaaaaaaaaaaaatatatatatatatatatatatagatagatagatagatagatagatagatagatctgtgcttccttgttcccatgttttgtacatgctatttctcgcatctgcaatgtccattctcttcttccattccccaccttttcctcactcccaaatggataactcacacttgctctttaagattcaacttacatattattttctttgtgctccagtagctctttgcatttctcttataggaattaccatgttgtgtcttgtctgtctgttagtttctctcataagaatgtaagttcatcaaaggaatggactgtgtctcattttagctttgtttctgagcccaaagctagaattgtgtttgtttagcacaatgcttggccacagcaagcatctatgatgttgtttaaactgactttaatcctataaatcaatgtctcccctcaaatgtgtcccactagtaccaggagatttttcaggaaaatgtcctatagtctaataatttggcaaatcacaaattctatgtaatagtgtatataggctctagaaagactagcaaaaaaaaaaaaaaaaaacctgtcaagttttgtttaacacagtattaccaaaaagtatttgattccacaattccttattcctccaccatcccagaacacatattgacaatgttttctatggacatcaatttttaaagtgctcttgaagtcaatagggcaaggtattggtgtcttagaaagataatcttggctgcaaagtggaggataatctgagatttggggagaggatgggccaaggggctaggagagtagtaataccagggacagatatcaaaggcctgaattagtcagtgaagtagcagttggaagaggtcatatctgtgtgtgctcttatacaatataataagcagggacctgtgggaaattggagatggaaaagagaaagacattgaaaattaccatgaggtttacttagctcttattgcgttttgtattagggaagaatatatgtgtttccatgaagtattagacagtataggagtttgggaaatacatcgcacccaacaaaattttttggagtcaattggtcaataagctccaaatcccacattactctccattatcgagttcaagaaatggggaataaacccttttatcttcccctttcattttctggctcacataaaacaaagcccactagccctggttttagtcccttgataaatattcactatgtgcccaccacagtgcctaagaagtatcagtttatggcagtggttgttaaccgggcgattttgctccttgggacatttgacaacgtctggaggcatttttaattgtcacgctgggggagtgctactggcatctagtgggtagaggccagggatgctgttaaacatcctgtgatacataggacagccccctataacaaagaattatccatcccaaactgtcaatagtgtcagagttgcaaaaccctgatatgcaatgaaaactcaacacaattattctgacaattgaagagcagcgagggttttgcttaaattattagaataacagcctcatttctgggcttcgctttgttaatataggcctagccaggtggtgttgaataagcattagttcatgatttaatcttagttcctttctctcccagtgactaattataagtaatttgaattgctatgtgtgatcaacgatgtaaaagtaggacaaatgcacctctaatgagactatattagactctgaacttacagtttccccgaaagaggttgccctaagtatagggatacagaggaaggggcatgggttgctgagacaagtgtcctgagtttgagtcccagctctgctgcttactgactccatagccactataagtttactctgagcctcagtttcctcattgtgaaatgcagcaataatttcctcaccaagacaccgtgaggattgcacaaagtaatagcaaagtcatatactcaacaaatatttattctattcctattgtgtgtcaggccatattttcagtgctgggctacattcattgacaggacagacaaaaatatctacccttatggagttgggaatggttggagagaaagacaataaacaagataaataagtaaaatatagagagtgttaaatgacgttaagcgctatggaaaaagacaaaacaagaaagaggaatggtgcaagttggtacaattttaaatcagaatggcaaagaaggctcatttgagatgacatttgactttgaagaggagaggaagtgaggcatgccagtgtctgtggaaagagcattccaggcagaaggtcacagcatttgcaaacgtcctgaggccagatcatgcttggagagttcaaagaacgtcaagagagccagtgagcaaggggaagagaaaggaaggggagaagtgaggtgggagaatggagacagattgtgtgagaccataaaggccattgcaataaccctgaccacataaatgttagctagttattattattgcctataggtaaaatgttccagtgtgcattatgcctcaaataagagtgtttcgtaaaccctccttcaaaatcctgtgcccttctaagaatgtttttaaagatatccctcatttaaacaaaatggcaaggcgtctaagtgcaaaggacaaaattccagaattctcatggccaatctgctctgtgggttcttttcttgcaacagccacccactctgcctgggagccccactcatggagggggggcaggaaaaagtcaactcgggttttcttttttccccctcttcatttctacaataggaatagcttttccaagctgcccgagaatttaaagtacaccttcttttgttgtgctgctgatacagtcgcttttgctcttacaaattcccagagaaaatttatattcattctgaaaacaggaaagctttatttaaatacaacactatcacccaatgactgaatagatacagattaataattcctaagatttttagcagaaatattcaaaaaccttttcatgatatacaaaggcttttattttaatgtcaagtctcactttatttccttctctggggcataggaaaggagaagcaggacccagtatttttacttgcagtaaacacactttgccaataaaaccataaatgataataatttttttctaaaggtctctggcttactctgctctcatttgaacttgaaattcagaaggaaggaaagccttcccatttcagcaggagttgctgcaaacctgctaatcaaaataagtcatttttttaaattataagtgaaagtttaaaccagacagagaattttcacttgcaataaggattttcaaacccaaatgtatcttctgtttttaaaatatactttttccctattaaaacatggttcagttctcctccaagtataataaaaagaggccatggtacaatctgagccccctcttttattctgtgttttgtagctaaaggtcttcaataaaataccccagagctaaaaacaaagaactgtaaattagtttgagaattcttcatttaactgttagattcagcaagattatttagctgattctcccattccatgcatttcatgaattaaaaatagacctctgccactgacctattaccagcaccatgtctgtctacctctctctctctctctttctcacactgtcactcattctccctgtctaaagaatgactttctctggtaaagatgatatgatctatcctgatctgagggaagtgattcccagaaatctgtggtcataaggtcctaaaaacatggtatggctttagctggagagtcacactgtccccttatgatttttagggacgttcttgcatcagggcaagaataaacacagagagtcacttcctaatctagtgcacacatttttttttggtccatgtcccagacaactgcttagtccacgttcccaggagaagcacctctctcacagcatgtttgtacagaccaaacttgcttctcacgaggcagtgcaaccttatttggatgccctgttcatttcttcatatttaagaaaaggttcaaatttccatgtgacatgggcagagatctctttctcttaacaggatcccatttctgaatcacctcttgattccttggagaagaaaatctatgagagctaaacttactcctgactctgcaaattgcatcctgttttgtatttatttccttttccttaaatttgcaggaagaaatataaggtttttaaagacaccaatgacttttcctcctttgagctgctatgtcagaaatccttagaacatgtaccactacatcatacacaaactatggccatgtcttaaattatccaaaaagttcttatggccttcctttggtattctgttgtgaaaataaataagtaaatacaaagatacatgttctgcctcacagaacttttgcaaactgcgaggatgtatcttacatttaaattttggtaattttttttctgtgcatctctttcaagtaaaatcttgtttttgttccagcatggtcctagttggaaagatatagagaaaaaaatgagaattttttttttgcaaaagaaaattgaaattctgtctatctcttaaactgctcctaccatgttttaagagggtctgttctgatcagcacaccaagtatttctaatgaattagggaagaaattaccattatgtctggtcatttatctgaagcttgctgccgaggatgcaagatagacatgtaatccacccttagccatattctccagctcccttcagtccggattgtgagtagagttgctataaacatatggaggaaagcttatgaaagtaaatctgagtctgactcataacaatgtctctacagtcctatggaggatacgtttcatcactggcccttgcatctggaactggtcttttcaaatgtggtatagcagtggctccagtctccagctgggaatattacggtatggaaacattcattaatgttactgtgaaagcatttaacacgtaattactctatatctgatgttgctagaaaaatggattatgcagtaaaattcaccccagcatcactggggaaaatataatttataaacaaagttgtttatatcatttattataaacatgttgtaacaatcaatgaaatctcaagagtgaggaaaggctcatccataatccactatatcttattttctcccagaaaccttgagcccctgccgaaccaaatctttaaaatcagagctaactctgtttttgcaggcacacagctacagcataattggcttttaagcacatcttcagcacggtcaggccagaggccaagcagttcacctccacgccacagttagcaattgccagttccattgctccagaaatcaaagaaacaaaaactttgttggagaaatactcctgtttgtgcctatttttatcattacatcaatgcaggatgattatttggaaggaattctaataattatacaaaataactctaataattttacaaaaattagcttcatcagattctctcctctatattggggcagaaataaaacaattgtgacttgtaggggatcttgattaagaaaaaaagtgtgtgcatctatgtacgtgtgtagggggaatagatttgagggacatattttcatcccagatgaaataagacaccagtaaaagtcctaaagatggctggatttgtgattttctttaaaatatattgagaccattctacaggtcattcctacttcaacattcttccctaggagggtagaagtgaaaaatattaagaatagtcatagaaagaaaatgtttagatgctcctgtttccataatctcttccttcatacttctctagctctattgaggctaattgcagagatgacacatattctttgaggccaaccattatagcaaagtaaagcaagaatttacctcaagagctcaagatgggaaaattgagaaacagttattaaactagaaggtcttgttggttaatgaaatgacattcatcacatgcaaacaatgcatattctcatatattttatagcgtctgtctacacagagagattcatgggtctcccaacaaaggatgataatcttgagcactataaggtaagtgtttccattttatttaggttaataattaatttctaatatgctaaataacttaaaagcagtagttcagaatttacagttttaattctgggcccccaagcaaatatcatcttttgttaattgcaaaacacatcactagaaagggttttactccttttggattctgttctttcttttcccatcctcccttccctaacctctcttttcccaatcttcctccccacccccaacccctacacagcttgagcgggcatcatttatgcctaaggtctcactcatatgtaacatatgacacataaactttcagtttttcaaactaagaatcagatggaagtaatgcaaatgatgatgaaaatgtgttgctctgactcttaaatatttatcaagcaaagcaatacataatttcagtattggtgctaagtccattgcacaatgatttagctagttttctattagaacttgcagcaactaaaatgttaatttttttctcttttccagaattcaactgtgatggcaagagcagaatatttcagaaatgtagactatcttctcatccacggaacagcagatggtgaggtttaagcaagactcttacacataaaaatactgagccagcatcactttgtttaagaaacattaagcatcctcctatgcctatgctcagggtcagtacctaagagtcagggacatttccatatctgagtgtgattactcactgctgacaatgtcaaatgcatgactagataattgttggtgttcatttccaggcagtacattgtcactctatgctttctggtatttagcagcactttaactctctctctctttgttgcagataatgtgcactttcaaaactcagcacagattgctaaagctctggttaatgcacaagtggatttccaggcaatggtacataattttgttttactcatgttcatggccttagaccctcaagctaaaaggaggggttcatatttttattttttttaacttttaaagtaaaatctgacaaagaggctgcaggatagagtaggcagaacattagcaaatgaatcttggatctttctttaactactgaaggacccgaggcaaaccagatcacctctcgtgttcccagttgagtcatgtaaaataaaggagttcacaagattaaatgatcttctagttcaaacatccagtagttctgaaatcctatgtgaataagtgcaattatatgcttagagtccctgcaaaacctgagcatccttaaacagctagaagattctgtttgttcagtaagaagcagttgcagaatgtcatcacaaacctccaaggctccctgaaatcatatggctccatttgtggttagagaacttttcacctatgtattctcatcccctggcatacacctggcttatcacagatgctcagcttcttactgagtgaatgaatgaattagctaaatgtaaaatccaggttgcttgaggaatgagaaattgaaccagaaaagaaaataaagtgaaagccaaagttgggggcggggcagcattcttggtagctaccttttcctctcacaaatgctccctcaattgcttaagttgaacaagaaccccgaaaaggagacccccatcttttcaacatttgtttttaaaaaatgtactgactgggaaagaaatgggggagggggtataagaagaagttggttaaggggtacaaaagacagaaaaaaataagttctagtatttgaaagtacagtagggaaattatggtcaatgataattgattgtataattcaaaatagctggaagagaataattataattttcccaacataaaaggaaatttgtttgaggtgatgggtatttcagttatcttgatttgatcattacacattgtattcagctatcaaaatatcactgtacccccaaaaagatacacaactattatatatcaaatttttaaaaatatacaaagagggaggtgagctttttctgaccttttttattgtgatccccaaagtaaattcaacttagtaaatatatattattacatcgtgaccactgatacctttattcagtgaaagcaataatcttagtggtatctctccaagagtgaagtttaaagttaaaatactatctttcactttttaaaaatgctatttttaactcctataaagggtgtttatggctatatatgaatacattatattgtggattttctgcaacagagaggaattagattcacaggctgaaagcctcatggaatttttgagctacaaggaatcttagggaaaatcaactccaacccctttgtttttcaaatgaagaaaccagactccaaagaagcaaaattaacagacccagtgcatcacttctggcaactctgatgcctgatcctgatcttccaggatgctggatgatgcgagatctcagccactgagatctaaaatatgtttaaagcatgtgaaacagtagtggaggttaacgaaagctcttcctgctgtaaatatttacatgtaagctattttacttatttgagtgttcttaggtacagtttccccataatagaaagattatcaggtcctgagagcacaaaaaagtccaagctaaatgcatttgatgactgcaggaataaaacaagcttttttctttgtgtttcagtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaagtgctattgtgttgtctgtattcattgatttcaggttccaggttttatcacagaaagaggtgtttgtgcaaagcaagtgcatgaataacattagggtggtcatggaggagaagaatctagaagtggttttggatttctgtcatgagaactccaaatactggaaccaacagctcagagtaggcaaaagcattgttcagaaaatgcaagtgaatcacgtttgagatgtttgcactctatgctgtccctccaagaaatgtttattacatttctcccagaagatttcttcaacattgccaaaagcatttgataaagataaagtcagacttttgaattcagactccttttaaaaaaatgcttctaatttggaagtgttcctattttgaatccatttttagaattagtaatggtaactgctttcagattgctaacccataaccaaatcaaaccaaacaaaaataaataagtaaataaaatgacatcaatagctagagaggaaaattttatatctatgaggtttttctggggtcttagttctacattataaagttcatattgaaaaaaatagctgtaatgcctacagtcctaaagcaatgcattgccagttactaccaccttcagttagaaactactggtgacctgccatctctgtgattgcctcagaattaaaagatccataccaggtcaccagaagatatttactgaatgaatgttggtggaagtatccaccacactgctgtctaagggacttttcattgtgtaatccccagcactggattgccctgggtaatttctccccatccctagcttgataccttctttccaggtgcaggttgaatcccctcatgacttatacccagaagaaccaatcctggcctggaacattacagcaggaagaccacagagagcacaaatgcagtcttctctagagttttctgactttttccaatccagcattgtttccacttcagctttctgaaaccattgcccctaactcaggccacatagctccacctcacacatcaggaagggatgttctgtggtggtcaggaattctggacaacaccttcccagattcaggactggccacagcccctcttttcttcctccatgcaatggctgttgccctgaggaccagagtaagctaccaccttctctctctgttctgcacacagcagcctctgaagcaagcccaagagattttctcatagttttctcatcattcactctctccacctagggagagaaaaataaccagtcattttctaatactttatctagggataccacagggtcattacaaatagaaagaacaaaaatcttatttctccaacttattttctgcctttgtgacatttgcaaaactggattctaatattgatctgcagtaagttgtctccagcctcaggcctttgctcccactgccacagagggaactgctgagacaaaactaatagtgtcattttcccacttagaacccttcgatgattctccgttgcctaaaaaataatattcaaaatcagcatgacagagagagcccttgacgatccgtccccatgcatattttccaaacccttttcctgacaccagcttctatagacccttagattaaaattagataaaattacaattcagctcttcagtcctacttgccacatttctctgctcagtagccacatggttagtcagcaccatattggacaatgtcgatgtagaacattttcatcatcacagaaagtgctgctgaacacactagtgctaccttagagaaaatcttcctaatgctaccctagagaaatcttcaccacccttgtcttggaatgtggcatatcacagaaattcaccaattgttgaattaatgaatacctttgtgttcatggaagattcaggttttctacattactgttgatgaagccttccctgaccccctcaggtagaatttcccaggtcttcctcaaaactgtaaatatgttttcagttatttattcattcattcattcaaca

SEQ ID NO: 14202 - DNA, 123863 bp, Human
gtaagattcactcatcttgttgagtgtaaatgagttcatgcattcttattactatgttgtatgttacacagtttatctctcttctgctgatggacatttgggttgttttctttttggccgtcataaagagatacattataaacatttttcaacatcttttggtgaatatgtgtatacatctctgttgggtgcacacttaggggtggaattgctgggtcataggatacatgttaatttagcttttctagataatgccaagcaggtttttaaagtggttgtaaaaagttcattttgacgagcagtatggtcaggccctttaattttagtcattctgggtggtatgaagttagatcacattgaaatatcaatttgcatttttgggatggttaataaattgagatattttccatatgtttattggcttttttgagaaatgcctgtttgtcctctcttgaggacagttgaaatattctgcctgtttttaattggattttctgccttattctggctgatccgtaggtgttctttatatatctgtaaacaaaccttttttggatgtatgtgttgcaattatgttttctcactctgcggtttgccttttcactcgtggtgtcttttcatgaacagaagctcttaattttaatcttgtccaatgatgagttttttttctttatattagtactacatgtgtttaagacatcgtctttgtctaccccaaggtaatgaagatttttttggacattttctttggatcgtgttattggtttactttttacctttaaaatccatctggaggccgggcgcggtggctcacacctgtaatcccagcactttgggaggccgaggtgggtggatcacctgaggtcaggagttcgagaccagcctgaccaaaatggtgaacccgtctctactaaaaatacaaaaattagccgggcatagtggcgtgcgcctgtaatcccagctacttgggaagctgaggcaagataattgcttgaacccgggaggcggaggttgcagtgagccaagatcatgccgttgcacaacagcttgggcaacaagaccgaaactctgtctcgaaaagaaaaattccatctggaattgactggggatggggggattcagttgatccagcatcatttactggaaagagagagataatctgacccccaatacagcacagcagcacctgacataaatcaagtgaccacatattgtaaatctgtttttggactttattccattggtcagtttgtctatccttctactatttctatgactttataatggatcttgatataagatagtgttaagtcttttccagtgggctccaatttttcaccccaccaaatcatctagtgctgaagtgccaccgccaactcgcactttgctttcaatacgtccatacgagtgcaattgatttgcctgttcccgtggatggttcatttgtggttacctggggctttgtctcatcaaagcccttcacattgaaagccagccaggtgtctgcagacgagcaaagcagatctgttgggtaattaaataacgcggggaaggggaaggagtggattcgacgaggctgtctctggagagagcttcagaaaggaagtgatcgagctatacttgaggactggctccttggggagatacgaagagagccaaactctaaaatccgggcagaggagggcctggctaggtcaccgaatgtaaatgtctcggggggttccgcaaggcagcgcgaatcggctcgccggggtggggccgcggagccgcaaatcaccagttgagggccggagtgcgcgccgccggctcagagctgcgcctgctgctggccgggcgggggacggggccgggaccggagccggagctgcggggcgcaccggctagacgcgcgcgggattctcggcgggcacgccccgcggaccatgagcgtccccagctccgggagcagccgcggcgcgggcggtgcgaggccggccgcgcggcgcctttgagccccagccggaggtccagagatcctgagagcccgagcgcccagcgccgcgccgggaggtgagtctccgccgcgcgcccagcgtcctcggggtgctgttcctcccggggcgcctgggcctcccccaccccggtgaggacacgctaggaagtttgttggacaaagttaggctctggggaaagtagagccggcgtttgttggtccctacccacccccgccagcggatttggcgttgggggcgggggtgactgaagtggggctggggcttgcgctctccaggccctccgagcgcgctgggactccccgagacgtggcccacggcggggagcgctcagcgattggcggccaggcatcttgctcggtggcactcgagcggcatcttcccgggcgctggcctcgcccgaccccctgcccgtcggagctgctctgccggccaccccgccctgtcccgcccgtcccctcttcgcagaagccggccggggtcgggcagatgcgagggcccagagcgctctggtggaagcccaaggctccgaggaggcgagtttctccggtaatctcttgggaagtttgcaaagaaagcgaaggagcctgccctgtaactgttgacaacatctccctccctctctccctttgttgagaaagaatgaatagttggttgtgttgctccctctgcgtcgcggtggggagaggcgagggaaggcaaaggaagggagggacggtgggaaggaggttccgatagatcgtacagcccaactgtccttacccacttaggccgctgagggcgccgccgctttaaaacggtgtaatcaggtgtagacactcgtcgaggaggaggttgagcggactccgaagcatctggcaaggcggcgtgttccgtggggcggcgggtcgggtcatggttggggttaactcgcttgaagcaaggtgcaaaggagaaaaaccattttcctaacctcatatctgttttcgcttaaagctgttagctgagatggaaagtagagccgtgcattcagattgttttaaaccttgactttatctcccaaggctacacagacctccccaaggaaagtacgctggccgagggaaggtcattttgggagctgatagcctcccttgtgttgcctgggactgagttgagatcctggaggctgggagaggcctcagtgctgggggtggggcccagctcaacacaggtccaagtgggaaggggctacccgggtaacaatgggaagcccacaggcaaagcgcttgtctgcgggcgtgccagggggtattgaggataacgtaaagaccttgccaagccaggggatcccacaccactccaactccaactttctctaaagtgctgctgagaaggctggcatttccaggatgactaaccaaggtctaaatctcctgttcatataggcagaactgcttgtcaaatggatgctaatcttaagaaccttatcgggtaaatcctgtactgtgttgcttgaaatacaatccatggaggaattattcatacttgaatcatttggctagacttcataagtttacttcaaaaataaagagatactcttaattcctaaacccaagcaaaacttcattttaagtggataagccaattgaatatgtgtggttgtttcatctcctctctccatctgactctccagagaagttataaaactacagatccaagttgtaaattctctgtcatggggcagccgagacggttacatttccagagtttaaaatataatgaaaagttcttaaagctcacatcagataaccattatgagttaaacttgaaaatatcccgtttcagaaataaaagagtaaaatccaaacaagtgggctgcttatctctgcctcagcttgcaagatcatcagtttctttgagacatcattgtaaagcaagtgagttgggcctcagttcacaaacatttcaaagcccagcgactgaccaggcccaggaaggcagcacatgtggtaaagtttgtcagcctcgctcttgttcctgatgttcacatgagtctcagattttcatatcaagatgcagagtctttgacttttgtataatatttcaaaatctggcattagactgagtcaggacattgtgtttgttttcctgcacagtagagagaagtcagatggccagagtctcacctgggcttttttctaaagactgcatgtaggctcacttggtttgcctgtacgtgtgtctgtgtctgtgtccgtgtccatgtcctacttggcttggtgtctttgcatctattgttctaggttaaaacgtttccctccccatccttcccagttgcagtcttcatttgtgaactctcagagttacttcctttgtgaaccctcagtataacagagatacagtgactcttatctgacaagatagataagagcagcccctgtcctgcttagaggggacctgctatttactaagtgtttgcagtatttcaagaactttgtatacacaatcacttttaatctttacaacaatcttatgaaatagctgttaagtcattttttaaaatgagaaaccgtcaggttgagtaacttgtcccaggccatacagctggtaagtcagtggcagagtagagatttgaacctgtagatatctgcctccaaagcctaggttctgagtcataccattttatttttaaaaaatcaaatggtacataagaagtatataatgactagggacattgagacagaaatatttccaagtggagaaaacatgggagccagaggctggagacttgggtttagtctccatcagctgtcattccaaccgcttgttcctatggcaagacctttgcatttgccagatcccttgcctggaacccccttcagacctttttttgactggctccttcccttgccttttttcaggtctcatgtcattgttaccttttcagagaggccttcccagtccaccctaatgtaaagtagctctccacccgcaacagtcatcctttgtcagttcatcctgtttatattccttagcgtgcttacaacttggatgttaactcattttcttgtttgtataggttggattcctccatgagagcaggagcttgtctaatttattatatccttagccttggtacaccataagccctcagagaatatatatcaaatgaacatttatttcccttatctagaaaaatggactgggaattaccagtacttatggtcataatttattgtctgcttcctccagagtattattagcttcatgaggacagaccacttctgtcttgtttaatgctgtccccaacacctagcatagtgccagccataaaggagaccctccatgaatgtatgcattgaagaatcaatgtttctattgattgaatgatactccttcatcatcattgaattctgttttgcaggtaaacaattatgactcaattgctgtgtaccaaaaagactcactaatccagtggttctcaatcctggcttcacattggtcaatactggagactgatgctaatgtcccgcccacagagattctcattttattgttctgggctgaggcttgggcatcaggattttaaaagcttcccagaggattcttatgtgtagccaggttgagaaccaatggtttacgtttttatagtagaactcattccttgctttggtccttataggcttgaagaagccatggtgagagagagcaggggtataattcatgggtattgtatgattcctgacagtttaagaggtacttcacagctgttatcacatctgataataacaagttaagggatctactctctggtttaaatattgcctttatgttgatgattcctaaaaatctccatctgccctcacttctaattgtgcataccagtatctaacctcctcttagaccaaattgtttgctgatacctcacatgcagcagctccagtgctgtgcttggttcctgcaggggtgggtccccttctgaaactagttggcatgttacagcatcgcaccaccttctgtggctgtaggctccttccttccagccagatgcctcaagctctgatgtctcatcactctctcctttctctccctttacccagctgctgccccaggtcagaattcttcattgttcctccatgggtttcaccatcagcctcagtaacctccctgcctcctttttctctcccctccagaacaaccagagtcacctacttgggtacagactgggttcggtccttcccttccagatcttccctagcacttccagtcaagtccagacaccttggcagggccttcaagactccatggtctgatgctaacctaagttgcttctgggaaatgcttctcggcttcactcgagccacagcacacaactgggaatgtcctgagcctgtggggtcacttccatgcctttatgcatctgccatcctcccgggaggcttttccccacatgttaacttttcaaaatgctttgtctctattgttgccctctctgagccttctcaagtccttttgtcaaaattaattgttcctttcagcataagggcctctatgaattattctctcttagagttcatagtcaggtattgggccttaggcatctttgtttctccaggtgtcttgtatgaaataggcacttaaatgtttgttgaattgaaggtaagaaggggaagtattaacatcccttgttattggagaataaattgaggtgttggtaacttgaaggacattttagaacactttaggacaatcttgaagtctaagtagatcttggggaagcagagaggaaacaggctgccaaaggcagtggtgctagggtgacttttgcccatcatgctattggaaatagatttgatcaacagtgtggccctatgcacatgaagaagttctgtagggtgctgcaggcctccccacgaggttctttgaaatgacccagtcctgtctgtgagaagtcacaactgtggtgtgtatgtgtgtgtgtagggtggaagaatcctagtcggtttacgtcacttgtgttcaggcggtggggctagggagtttggtttcctttctaataaggatggttagcattgagcaagtgctgacagtgtgccaggtactggccagagctgggaggggctgcacaggactctgtcctattgttctgcacccactgtgagcagaccttctgtgtggtcccagttggacgtggagcaggcagcccccagaattactggatttgacaatgaaccgaggacagagttaagattgtacaccttcagtaaagatgctccttccatctcacccccaggacttctgtactttcccctatctcatgtggaagcagtggaacgtgtgtgttttgttgtacacacacatacaaacacatgcgttttctttacacactctaatgtcattgtctcggctccacttctatcagcttgtggagggttgcattcttcttggttgtcttcaaaccacgtcccaagtccgcagttcctttgtagaactgactctgcagtagtgctattaagtgaggattttcatgcaaagctcttccctgagtaatgcagtggaaagggtggtttgtgaggaaagagggctgctgggttggagaacagactaaggggcagctctcctcaccagcccgtgggaagggctgtatgttgggcttggccaccctgcagtgctgtccagaccagagtctgatatcatgactagtataagacagatcctggagcctctatctccaggggccagcctttttttttttttttttttttttttgtctcctatttcttttcctctgtgtgttggccttaaaaatgtattatataatttgtcttaggccaaaaccatagtttgctttggagctggaggcactgactctgctcagggtaaatgcttctactcatggtcctagataggagagagtgtcggggctacttgctgcacacagcctgacgtgccattctcctttccctttccatgcttcctttgccccccaccattttttttcttttcttcttcccttctcctgtctcttcttccccgactgtacaggcacccatgggcattacctaaccctgctggtggcaggcagatcctgacccctctgtgggggccatgtacatgcagcccccaccccagtggctttcctctgcagctgagcctgctggtgtatggcagaatggcccacctcctgaccctgaccctagcccgtgttcactaattagagtgcattgatttatttataaacactgggtctttgccagaaaaattctgtcccatcctgtgtagcacaactgaggactggtctggcactgaagacaattctagcagctaaagaatttcaataatccctgcctgttcttatcatttacagggcagtgaaaataatgtgagctaattatctaacagtttataatattttctttcgtacatttattactgcaactatgagtcctctcttaatcatctttttttgctggttgtgcatggcttatatgcctctaacaactctgaaagtgtttgccctcttggttttgctgccaacccaggacaattcctatgtaggatcatttcaggaggaagataagtaaacttcccattcttattagactccactagtgatgccattaaatgttgatctgttaatggtctgtgaatatttcattttatgtggcatatttccatttccttttgtaagtaggaagtcagttcttgtgactctcatagatttataccttcactcttttctttcccccttagagttgagaattatggctgcaggaaaatttgcaagccttcccagaaacatgccggtgaatcaccagttccccctggcctcatccatggaccttctgagcagcaggtcccctctcgctgagcatcgcccagatgcctatcaagatgtgtctatacatggcacccttccacggaagaaaaaaggtcctcctcccataaggtcctgtgatgacttcagtcacatgggcaccctcccccactccaaatccccacggcagaactcgcctgtgacccaggatggcatccaggagagcccatggcaggaccggcacggcgaaaccttcaccttcaggtaacttctgtaatttcactagtgaagatgatttgtcttaaacagctttttaaaaggtttttatggccgggcgtggtggctcacacctgtaatcccagcactttgggaggctgagatgggtggatcatgaggttaggagtttgagaccagaccaacatggtgaaaccctgtctatactaaaaatacaaaaattagctgggcatggtggcatgtgcctgtaatcccagctactcaggaggctaaggcaggagaatcacttgaatccgggaggcagaggttgcagtaagccaagatcgctccactgcactccagcctgggcaacagagtgagactccgaagtttttattaggaaaaacatcaaacatacacaaagttgagcgaataattaactcccatgcacctgtcagccggctccaacagttaccagctcaaggccagtcccgttttgtctgtactcccacctacttccctcctttggtattattttgaagcaaatctcagatttcatattatttcatctggaaatattttggtatgttcctttcaaagataaggactcttattttaaaaactgtataaccacaatgtaaaaaaaactataacacctaaataaaaaccacttcttaacattatgtaacatttgaggatattttaaaatccagcttcctctcttaagtcccttaaaagaaagcccaagtattttctttttatcatagcatcagattctgaactatgtccatccacttctatagagatgccaggatgtctataaattagaccccatatctccttatatttagttgtcagcatgctgaaataaaattttatgtggatgcaccagcaggtcagcttcagaatactttaggacaagaattgatttttccctctctgtgacagagatctgggtaaatgagccttatggttgtaaatgctttttctctgggtttgtaatgggcctggctgtgattggtttctgcctgttagagctagtttggaaactgcactccttttcctgttggggaagatcagcagcctgtgatgctatctggtaaagaatgggactgtttcttttgttatctctctttttgtccaagcttgtcgcaaagccacttggatcctagctcatttatttgttcaatatttatatatggagcacctatattagagtatgttgatttcataagccccagggcttaccaggaaaattctgctcagtcctgattatcttaaatgaagggctggtccagcattgaaaacattctagcagccaaattattgagcaatctgttcttgcccttttatagggtggtggaaatatgtggactaacagggtagcagtggagcatctgaagcaatatcttcccagagtttacattctagtgagcgcattaggtagtatatacaaataaataagacaactgcagattataccaaatgctatagaggaaatggagtgatatgctggagatttattggaggtggtacgtttttggtaggatgaacaggtttctgagatgatatttaagctcatatttgtataatgagggaaagcaaccatgggccttccaggctgttgcaggcatggggaagtcaagtgcagagaactggagatgggagcaagtttggcatgtttgaaaaccccaaaaggaactggaatggcctgtggctggagtgtagcacattgagaggagaacagtgttggtgttggtgcaaagctaggcgaacaagagttcagaattattctcagttccataattgcagtagtacaagaagaaaataagtggaggcccagataatctccatagaaaccactagagagccctgaactgcttctgtcaccagattaggacattccttggggtatcctgggggttagaaggccctggaccggctccacaaaatctaggtgggtgacctcccagctcagaaagttggcaggcagccactgctggaatgggtgaacatggaggtgcatacctgtgcacaggattgttaacatcgcataattggcacttaaggggcaagaatgcaggaggtgagcagcaaagacaggtaacttctggcctgctaaagatgagcacagatgccaggctgtgtgatacggagtcagaaccaactgttagctggcttatggtggaccgcttttcatttattaacttaaactgtcctgagctagatgtctaccatgtactagacacagacagtttatagacttactccttgaagttctgaggccctggctaggtgccagctcttacaaagggaaactccacactaggggggtgggtggggaggcagtagtgatggagtcacccttcctatcttggggaagttcttggtaaacacccaaggtccaagctgtcaagctgccaagagtgtaaagctttttgatttgaaaactgacttggacagaggtcatatttctgtaaaagatcttatcggagggtgggtgcaggtcctgagtttgaagtccaggctgtggaagacttaacaagcactcctggtttagggtttgtttatgattgagagctatattaatccaaattcacatctttttttcttaactgaaaatatcttattgttaaagatgaatacaggaagtaacaaatgcatatccctcaaaaattgtgctgagtgagaaggcacatggttctctgttaaagggtcgtaaagtcctaccctgctctgtactactattaatatatttatttctctaacacattaaaaaaaaaatctcctgaggtgttcccaattttgaggagtacaaaataccttatattctttttttgttaagtattcttaataagattataagctgcctgaattcctttttgaaaccagcaatgatataaacaaagtttttgcatatgcagagctaggaccaagcagcctgaatgagaacccaaggctctagagaaggaggttttgccaaaggtgccacagcaaaaatacagtgagagaaatggaacttctcattcaactcttccagttgaaaggagctgcgaaacaccaaccattcactccagctcagtcacctctttttttcttttcgtagtgaattcaggggttaatttcagttgacagtgacttgcccagatgtcagctctgaaaacattgcatctcatcatgttgggtattggcctgacgggtattggcatgaagatagtgggccgccttggatgtctcctgcctcctctatcttgctcagagggaggccctccagataagcacctctttgtcttgtgaagtactctgttgcaagtttgctcttttccaaaaaaatatgtttagcttgttaatcattaaaaagtcacctttataggccgggcttggtggctcacgcctgtaatcccagcactttgggcagccgaggtggacagatcacgaggtcaggagttcgagaccatcctggccaacatgacgaaaccccatctctactaaaaatacaaaaaaattagctgggcatattggcgtgtgcttgtaatcccagctacttaggagactgaggcaagagaatcgcttgaacctgggaggtggaggttgcagtgagctgagatcacgccactgcactctgccttgggtgacagagtgagactccatttcaaaaaataataataataacctttattataattgaacattcattgaaaatacatcctctcggaggcccaagacaaagcagaggaagtctcctctttgaccttaaaacttgcatgattaagctttcatatctacatgtgtcatttcctccattattaattcctccattattaattatcccaataattataacatgaataattatcctaatattattaattgttatctcctacattttatagttttcagatagcttaaaggatatgttcataaactaccttgtttgaacattgtaaccctgtgtgagagacatagcagatttcattatgaacattgttatcaccatcatcagtgtcatcatttagagttgaggaaatgggttcagggatgttgaggcacctaagatcataccttaatggataactgagctaggattagaacctagaaagtattatagggccttccccagacagtgtgttccatagcctccgaagaatgttggcaccagctgtgggcatcctctgagctatcttcttgcacaggggtcagtaccctgcttgtattcagtgctttggacacctactttggggagaatggagccttgcctgctgagagccaggcagaaggcaggcctggaagggggagttggtcttctcttttggtgactgtatctcttggctttgttgttgtcttggctgcccttggatgtacttgtggttttgaaagagggccaaagccagaagccagggagctcttaaacctgctgcttgatgtcacagaaggagcctttgttctgcaagcagacccaggtttctctgagaggtctgcagacaggatttcctcttgacattcacattgttcagctgatatccccttgattcatttatcttcaaggatgaatttttattattatttatttttatatttttccataagttattggaatacaggtggtatttggttacatgagtgagttcttcagtggtgatttgtgagattttggtgcacccatcacccaagcagtatacactgcaccctatttgtagtcttttatccctcgctcccctcccactcttccctccaagtccccaaagtccattgtatcattcttatgcctttgcatctcatagcttagctcctacatatcagtgagaacatatgatgtttggttttccattcctgagtcacttcacttagaataatagtctccaatctcatccaggtcactgcaaatgctgttaattcattctcaaggatgaatttgtattcaaatctggaatcttccttgggctgagaggggactggttcctgttgtcgggatgtctgtgttgctaggatagctgagggatcagtgcttggataccattcaggtctttttcctgcctgtgggtacgtggaggcacacattcctgggaacagctgtgagtgcctaattccttcggcctcttgtgctgtgggagcatgtggtaggacaatgtggtgtttcattagtttgcatgagtggaactgactgactcgtcacaagtgttttaactgacagtggccagaaagtctgcagaattatccctagttaaaatgagcagtacattttcccaggcagtaagtaacctaccctgtcacaatgtcagatcttcaaggttgaagcaaagatgtaaggtccagaatctatgcagcttttttcctctaaaacattgatttaaagccctaactctgggctgtatcaatgccctcatctgaaaaatggttttagttattcctcttcagaaccattggtttctgtaactactgccttctctttaacaaagcaagatgttccctcagacacgcaaatacaccagcctttagctcagggttaatcagaaggatgtacgatgcgaaggtccacacgcaaacatctgcagtttatttatacccaggcatgtctgctgtctgcaaattggaagctttttgtgtactttttggagaaaaaaattggattttgagttaaaaaaaaaaatcttgggccgggtgcggtggctcattgcctgtattcccagcactttgggaggctgaggcaggtggatcacctgaggtcaggagttcgagaccagcctggccaacatggtgaaaccctgtctctactaataatacaaaaattagttgggcgtagtggcacatgcctataatcccagctactggggaggctgaggcaggagaatcacttgaactcaggaggcggaggttttagtgagtcaagatcacaccactactctccagcctggatgacgagagtagaactccgtcttagaaaaaaaaaaagaaaaaaaaaaaagcttttattagattaatagattctatttaatagaaggtatacttagcatagtgacaatggcttaacagcccaagttcaagaatgtttctgaaaagtaatagtccatgggttgaattgatgtttttataagtttaaagttgagttttagtaacattttgaaatacccctcggtgtttgaacgcagctgttgcgaatggtttagtgcattccgaggaatggtgaatgtcccggtccctggtggcctctggtgtgctgaggacaggagcagctgggtcagaggtgagctcagcccctgcatcttgcgctgctcctgggttgaagaagcccagagggtgggaagtgcctgcagatctaccagctgtctgatggttgtcctaaatcctctactgacaaggatgatttgaacctaaatgccaggatctacgcattctcagctgttctggggcaaaaaaaaattgttaacagattgcaaaccacaaccaagaaaatgatcagagaattacacaatgcagtccttgttgagtggagctgtgtaacatctcctctggactgccccctcctcactcccaccccaggacagacctgttttaaatcatgttttttttcaggccaccagcatgctatttgggaaaggtgaggtattttagtcttctgggtttttcacgcccctcaatatatgttgaaacaccttgtaaacagaggtgctatgcagttataaattactactcatattcttatcacatgtggatttgcgagccagcctagcctggctagaatacacaagctggagaagtcttagttgtaagctaaaggagtagttgctgtggttgattggaaggagactgtcctcagggggattggtctaggtggccagaccggcctgagccacatggctgatatgccctcaggtcatgcttcggaatggtgtcactatccagtctgtcaccaagaggctagctgtgggattggatgtagaatttcaagctctcttcttagaggccccaaagacaagcatatagggccttgtttgaaggactgtgctgttatttacaagttagagaggtctgagaaaccttccctagttgccccagcttttatgcagtgtgatctgtctgtaggtccagtttgcctgtgagtataatcactgaagataaaataactccttttgtgaagaggagaaaaaacacaagacagataatccagaggtttcagttcatatccttgtttttgccacttattagatgtgtgaactctatagcaagttctaaaccataaagtgggagcgtaaataacccatccgagaagtgctatgaaggttaactgctcactaaatatgaaggctccacagaatctcagagctctgactttcacacttgaccctggtacaccctactgggaatctgcgttgagcaggtcccatgcctgctcctagctcccacctggtcaccagcagtttcttcttctcctgcttagctctgctgggacgcctggctcaaagccactgaggcccttgctgggatgtcgacgtagccgtggctatcaaagaaagccactagtgaccttgacgctgattccagcagcctgacttggtagctttgtgaccttgggtaagttattttacctttctgagtctccatgtcctcaaagggtgactctaaggatcagatacaatctcatgtgagggtgcctaacacagaacctggcatagaggaggctcagactgatggatttccttccttccttcctcctggaaggctagagctgggaggtgcctaatcctttggtgtaacctgagatcacgttcaatgacggcagcttctgtgggagaaagtttctcacatgttgatggagtctggctggaatccctctatctgagcctgccctacagcaatgagccttggccaacactcaacagtttataggtataacaactacgcagtgcactaaaatatcagcataccatcgtactaatacacaaaacagagcctgtcttcagtgaacgggccccgagcctttgcctgattgttcttgtgcttaatatcagtgtctttgctgtttattcttcgatgcgtatttattagcttgttttatgccaggcattgtgctagatgccaggtacctagtgaagcacgaaatagatgtatcccctgtccttagggagttctcagtttagggggcattcaggcaaatgcatcattaagtacgtaactacaaaatgaggaggtacaaggaagatacaacatcagaggaccccaagttacttagactggtggagagaaggcctctctggcatgggaatttgaagatttgatataaaaagagaatatatttcagtaataatttttatgtaaccgtgttgaaataatgtctttgaaatagtaggttaaataaaggattaaaattaacttcagctattttttaaattgactatcagaaaatttaaaattacccatgtggctcacgttgtgtttttattggctagcactggtctagatttgggtaaggacttcagattttctctgtagggcaaaaggaaatctacctttaaaggattttaagcaagggaatggcacgatcagtttttagaagattgctttgtctccctgtggaggaggattgatggagaagaggatgaggagggaaggcaggaggtggttgtaaaagtacagggagcaggtggggttctgcactagcgtggtggtagaggagagaagtctgtggattcgagatatagtttgcaggtacagtctgccatatctgctgaggtttggatatggtggggtgggggagaggtatagtcaagcatggctcaggcagctgggtatatgggatagggcatttgctgagatagggaagcttgggagaggaccaaggctttatttgtttggttgattgcattttcttagggaagggggttatggtagattgctgagaatcaggacttctgtttggggtttgctaagtttgagatgcatgcatgtctaagtggaggtgttaaacagacaggcggttggaattatgagcctggagctctgcaaaaaaggtctggcctgaaaggtataaagttaggagtctgcacagaagtgaaattaaagccatggaaatggatgccatcgtcaaaggagagatctagagctctatgtaaagagtaaagggaaggaaccctaagaacgacctcagaggaatcccagcacagtttgttccagggagtcagcagaggaggccgagtgcagagaaataagataggatatggatagataggatctggatagggttggtgttcaaaagaagatttttttttttttgatgatagaattcaataggagactatcttgccatttaaactaaagcatattttatccactacttgatttttttaaataaggcagacatgttttcagggccaccctccctggggtctgtgtcagcagcatggtgattatactcctgtggtttcttcccagcggtcctggacattccccaaggaccctgtagacagaggaggtacatggacactgcagtgtctgcctttgcctaaagggtgatggctgctttttcaaggtttaggtaggtggccacgttgaggatgggtgtctgcccgggaagacaggtcaaggggatatgttcctttatctggtaggcagaagcccttcctcttagaggcttgaggacattatctcaaaaccatagcatttttattctgcctctcgattagttagaaaaagcctttacaaacacactctttcagaagccggtagggaatgggtgggggtggggtagatgggactggtgggattggaggaagggcagatagatagcagccaaacaaagcatctgcttttatcagaagtgctgtgtttgagcttagacagcctgaagcctgatgattcactgatgccagatcctctctgcctgccaagagacatactggccttgatacggtttttcttgttcttaccctattcaatttgactgactgctgccaagttaaaatttcaacagtggcttttagcttcatgctgtcactagaattctgctgagcccaggttaacccatgactgggtcaagtttttatcaaccagtaccactgtgtattagtcttggattcctatatagactcaccatagtgtaatatgcaggatatttaaatgatgctgttttaacatgattagggaaactgcctgaaaaaggagttgaattgccattcttttcatgaacacagtcatcaggcattgcaatgttttcagataagatagacactgactcatagaaaagtaggaactgggccaggcgcggtggctcacgcctgtaatcccagcactttgggaggccgaggtgggcggatcacctgaggtcaggagttcgagacaagcctgaccaacatggagaaaccttgtctctactaaaaatacaaaattagctgggcgtggtggtgcatgtctgtaagtccagctatttgagaggctgaggcaggagaatcgcctgaacccaggaggcagaggttgcagtgagccgagatcctgccattgcactccagcctggggcaacaagagcaaaactccgtctcaaagtaaaaagaaaagtaggaactcgctgttgaaatgaaagaaccaggcattttagaagtaatcaggccttagaatctctgacagccagggagggaaatgtgttcttgtctatagtctaccctagactgtaagaaaaaggattcccaaggtcgaggtacatgataaacacaatcccatggcctcaagtttaaaaagagaaacacagttcaggacaattaaaaacaatgctgtgaccccagttccaaaggaggaagaggtatgtggccatccagatagctcttctgtttaaggatgtgaatgaaagactgactccagtctgaacctgctcctttaaaggattcccccagtgtggtaatgaggagccagggccactttgatgtattcattcacaagtatgttgaactttggtgtgccaggctttatgctaggtgctggagattcaaagacagaaaggccaggtctttgtgcatgtaaggagccctcagaggaaggatgcccatttgaactacctctccttagcagcacctgttctccatcttctttgcaactgacctaatttctcatccacggtatagccctttgtattgctccactggattgataagcaatcctgcctttcctgacctctgaccttaacatctttccaggtatcatgttactttttctccttgacttgctgactgcaggtggcactttctagataaccctttcctttggacctgccttctctgtgctgccacttcctctgtgctttcctgaccttggaccctgagccagacccagggaaggtcgggtcatgcaaccaaggtccatatcagagggtggctctgggctgtaaagaaacagagtgcagagtgaaaagaggattgtgaaaaatgtgaagggtaacaaaagggctttcagaagttatgtttggaacaataagaccaaagagaggggcttgtgagagaaaccaaactgctaagcttctgttcagcttgcatttttttccatcaagaaatgacttctctgactggaaagggtaggataaatgtgaagcaagaatcgctggcctggagtagatgaggccatgacaagagactctaatgccacccgataaggtgaagccccaaagtccaagaagactgagggagtgtgagactgagatcatcaaatcatgtgatgttggaggaataatggagtaacaaagaactacaggaaggatgcaggtggatacatagtttaatttttaaaaaaggatttagagagagaaaagctacaaaatgataagcttgacatcgatctcaggaaatattctattataaagtggattatcaagacaacgatttttgaatacttgataaaggaagcagtcatcgttagtagctatcagggctttgctaaaagccagtcataccagattaactttagttcctggggttacttggttggaagcttagaagaatgttgagaaggcatgcatgcaaatcagtcactggtgctatccgtggggtgaggaaaattcaggctagatgataatacaggaagcacgctggaggctgtgtcccctgttttcatcagttaaaaaaatcttctagacaataatattggcatacagatcacatacatgaatgacaaatctaggggaattgttaataggtcagagcaacagaaatgagattttttttttaaaaaaaagagatcttggtattttgaaacagcaaaccaaacctagttgaatacaacttgagagggagaaagaaagactagcaccagagtccaaaaccattcattacaaatgaaagtatggggtttggctaaacagccacacacgaaaaatatttcaagatctggagaactgcagcctcagaatgagtcagcagcatgctatggctgttaaagaagctcccgtgattttcaggagcattaactaaagttaatattctgaccatcggagttggtcacacatggctgcccaaatcatacctggtgaattgtttttaactctagacatcagaaatggaaggtgaatctgcccctgactgcagagcagtgagcttctgtttagacctctcctgctttgaagcacttctattgctttaatcatgaagtatccctaacattcttctgtattcgtgaaaaggaatttctcgcatcacgtgttaaccctgggtgcagaatataaaatgagtgtcagccttaatcctgctaactgctagtaaaacatactttaacaaataagatcaatgggtatgttttaagatgtggaagactgaatctcttctcatttattttgcaaggggatgaaacaaaaatatttaagcgcacatctagaagttttatagttctctgtttaaagctacattggggctgggcgcagtggctaacacctgtaatcccaacactttgggaggccaaggtgggtggatcacctgaggtcaggagttcgagaccagcctgaccaacagggtgaaaccccgtctctattaaatacaaaaaaatttagccgggtgtggtgatacatgcctgtaatcccagctacttgggaggcagaggcaggagaatctctggagctcgggaggcagaggttgcagtgagcggagattgcaccattgtaatccagcctggggcaacagagcgaaacttcgtctcaaaaaaaaaaaaaagctacactgggccaggtatggtggctcacccctgtaatgccagcattttgagaggccaaggctggcagatcacttgaggtcaggagttcgagaccagcctggtcaacatggtgaaacccataccgtctctactaaaaatacaaaaatttgtaggccgggtgcagtggcttacacctgtaatcccagcactttgggaggctgaggtgggtggatcacctgaggttgggagttcaagaccaacctgaccaacatgaagaaaccccgtctctactaaaactataaaattagcagggcgtggtggcgcatccctgtaatcccacctactcgggaggctgaggcaggagaatcacttgaacccgggaggcggaggttgtggtgagcggagatcatgccattgcactccagcctgggcaacaagagcaaaactccatctcaaaaaaaaagaaattagccaggcatggtggcgggtgcctgtaatcccagctatttgggaggctgaggcaggagaatcacttgaacccgggaggtggaggttgtagtgagccaagatcgtgcaattgcactccagcctgggcaacaagagtgaaactccgtctaaaaaaaaagaaattatccaggcatggtggcgggcgcctgtaatcccagctacttgggaggctgaggcaggagaatcgcttgaacctgggtggcagaggttgcagtaagtcaagatcgtgccattgcactctgggctgggcaacattgcgagactctgtatcaaacaaacaaacaaataaataagcaagctagctacattgcttttaaatttagcaaaggctatatgcacaatattcccctgcctgcagtaagaaagtaactctttattgggaccttaatatgattcccaacatcagtaaataacctgctaatctaagcacacactagctgatatttttccaaaaatgtcatttctgcactcaccaggcgtgtcccattttaagcctgtttgttttctctttttcctggtaaacagatagaaatggccctatggtaaactctgtctgttctcttggttatctccctgattaagtttctccctggtattttaaacatgttcagagagattcattttcaacaagatcagccagcctctcacagtatcactttgaaaacatctggtctcattggggctggggagccaggcgctgctctggcagcagtgctgttctgttgctgagggagttctgtctgaggccatcacagttcggtcgctggcctgtggctaaattatctccttaatgagggggcctgtcaatccaagaacaacatttctctcttgttccctctctccttccaatgttttattcccttagtgaactcatagagtgtagtgggaggaaggtctaggtcttccgcgtattagagaaaacacacacacacacacacacacacacacacgttcatttattcaaaccaacatacatggagcaactgcacgggaggtacaaaggtgaatacagtgtggtccctgttcttagtgagctcatagtccagtaagggagatagacgggaatacacatggtatatcgaattgtaattgtttgtcatcacaaagttttataattcataggaaaggagcactgaggagatgtcactgattgtatgagttgtgtgtgtgggtgggggtgggaacgtgtggtcagagaagccagggatgaatgagaagaggatggggaccccaggcctattgatacaggtaattccaagtagttaaatttgctggagtgtaaggagcaaggtgaggagattaggctggtgagttgggcaagaccttagaaccgtgattgtcatctaaaaaatataaaatgagaatgctagactgtcccatgtaataaccttatctaatagaacattattatacttatatatgtaaccatatatataatatatatttctattatagtagaaggaatattgtccagtagatgcaaaatcttcatagacttaaagccggttgctggccaggcatggtgtctcatgcctataatctcagcattttgggaggctgagcagggaggattgcttgagcccaggggtttgagaacagcctggacaacatagcaagaccccatctctacaaaaaaataaaaaataaaaaaattagccaggcatggtggcatgcgattgtagtctcagctactcaggaggctgagtcaggaggattgatttatttaaccccattaggtcgaggctgcagtgaaccaatgttgcaccactgcactccagcctgggcaacagcaaggccctgtctcaacaacaacaaaaaacctgttgctatctctgtttcccctatcccttcattccctcttatccccagctaagattttgagatgttgctgaagcttcatgctggagaacaaggggtgaagcctctggattctaaggccatatacacatgcaaatgagcggaagcccccagtttgcctgtggagggcacactgtctcccagttgtgtagttcacctttcctgattgtgtgacataccctggtgcatgggttggttaaatggtagactagtggactccaaggctgaggtgtttgttcctcatgggccccactgcttctggtaaacagagaggttcagcctactggctacactcatcttaaatcttgttgtgttacattgtaattaagtgttctaggaatgagttcattcaggatgaataaacaccagcaaagcaagaactccatccaagacatgtaagccttctagtccctgccctcagtaagttctaaatctaaggtttttgcatagcgcttttatatccaagaaacttgctcaactttcttttttgtttttgagacagggtctcactctgtcgcccaggctggagtgcagtggtgccatctcggctcactgcaacctccacctccagggttcaaacaattctctcatctcagcctccagagtagctgagactataggagtgtgccaccatgcccagctaatttttgtatttttttttttgtagagacggggtctcaccatgttgcccagactggtcttgaactctgctcaactctcttagtagctctgcatagattctttgtgtgttctatgcagacagtcatcatttgtgactcattactgttttgaatcattacaaccagttttgttctttcttttccagtcctgataccttttatttcttttactttatttaactgtactggctaagacctccaggacaatgttgaaaagaagcagtaacggactgggcgcggtggctcaagcctgtaatcctagcactttgggaggccgaggcgggcggatcacgaggtcaggagattgagaccatcctggccaacatggtgaaaccccatctgtactaaaaatacaaaaattagctgggcgtggtggtgggcacctgtaatcccagctactcgggaggctgagccaggagaatggctcgaacccaggaggcggaggttacagtgagccaggatcatgccactgcactcctggtgacagaggaagactgtctaaaaaaaaaaaaaaaagaagcagtaacaagcgacatgctgtcttgtttctgactgattgattttagtgatgcttctaatacttcaccatctagaatgacacttgctgaggtttttggcagatacccttttcaggttgaagcaattctcttgcatgtccagttcattaagcttttttaattccagacattatgaaaaggtgaggattattttttctttttcttttcattttttttttttgtgggccatacatcagacttaaaggattcttttaatgcttttttcatcaattcaatgttcaaaattatttttctcttttaatctgtgaatgtggtaaattgtattaacaggttttctcatgttaaactgtatatgcctggaataaactttatttgattatgatatatattttatacattcttggatttggtttgtcaatacttttttaggatttgttcatacctactcatgtgatattagcctatgcttttcttttactgactttgtctgtttttggtatcaaagttataatgccctctttttcgtctctggaagagttcatataattttcaagtaataaataattccaaagtttggaagaatttgctatatagtaaaactatataggcctgatattttctttgtgggaagatattgaactacttcttcaggtttttttaaatgtttataggattattttgattttctgtttcagggaaccaaaaaagaaacctattgtctctacacaaatgctgatgggaaaaaataatggcaataatttttctcctaagaatccataaccacgggtcaagtctttatgttggttgggaattcaaattcctattacctgctttcagataaatccaaaatagagaaatcaaagtgtctgggttggcagtgcccactagtaacgaaacaatgcaaatcttttttggatgaaaacttgctcaacagaatgctactcaggttatccacaaatttggctgaatgtaaattccctttcagaaacaaccatacacactggaaaagaagccccaaagagtgaaagtcagcagaaataacaatagcctgagacccacaaagactttagatattagaggccgggtgcagtggctcatatctgtaatcctaccactttgagaggctgaggcaagaggctcaacatagcgagaccctgtctctgcaaaagattaaaaaattagctgggtgtggtggtacatgcctgtagtcctagctattcaggaggctgcagcaggaagatcgtttaagcccaggaggtcgagactgcagtgagctatgactgtgcactgtactttagcctgggtgacaagtgagatagtctcaaaaaaaaaaaaaaagacttcagatattggaatatcagatacaggctataaaataacgatgtatggtacatttttttttaaaaagataaaatcataagtggtctcagaataaacaggaaaatataaaaagaacctactataatttctagaaataaaaaactataatcaataaaaatataaaacccaatggctaggttaaataataaattagatatgactggagaaaatacttatgaattaaagacagaaagtaatcacacagaacatagcacagagagaaaaggcaatggaaagtatgaaagagacactgaaggagaaggaaaagccccaagtacatttaaccagagctctagaaggagaaaattgagagaaaggaaaaagcaatggtcaaattttaaataataatgagaaatggtaaatcttcacctagacacattgcaataaaactagaccaccaaagacaatgaaaagatctcaaaagcagtcaaagggcaaagaaagcacagtaacaattagactgatagcagattttcatcggccaaaagggaagatgaggcacttaaaattttgtgcctatcaaaactattaagaacaagggtgaatacagagactcctagacaaatgaaaacagagaatgtcctgcacgaagaaggaaaaggatgccaaaaggaaagcctaagatctaaaaatgcattcttaactagtgtctgcacagctcccttgttttgttgttctctgcttttccttcatgggttgactatttttgttggtctgaagggatcccttaaatgtttgtcatgtttcattgtactttttgggaaagatttatgtgtccataatttgaaggatgtgaaagactctcctaaaagagctgatttaccagttgagagggaaggagagcttatttgctattcagtagttgtgtggcagcagtcatatgtgcactgatagccacagaagtaagtagtaatgaagagaattcttatttattcagatcccagtggtcttgaaagttagtatagtatagtgcttggaggcaaaggtatttgctaattcattgttaacaaatggattgagtgcctgccatgtgccaggcatgatctacttagtttccttggaaagaattctgtgggtgtccttacctctctcttccctttcactcaccaaagccagtcatttatcaagagctatctattcttggaaaaatttcttaaatctgtacaccatccccccacctcccacactctagttcaagtctcatcatcatctctcatccagatgatgccaacatcctcttctttgggctttctgagtctatcttgccctccagctaatctgatttccatgctgctgcagggggacttttcaaaaacacaaatctctggttattttccagcttaagatccttcaataaatcccattgctatcatgataaagtctaagcatgtttgtgtggcatccaagccccttgtgacctggccctgcctcctctccagcctcagctcccagccccttactgttcctgctgctgccccgaacactgcgcttaggtttattgttctcttactcaagaatccagcaaatgctcactgggcaactgccatgtgcaaagcactgagggtaccaaggtgagtaaactggacaaagcctcacccttggagggttgtattccaggggaaagatagaccctgagcaaacagacatttactataatatcaggtatgatggaaaaaaataaagccagattagcagatagaggggagtggtggggcaaatctaaataggctaggtaaggaaggtctctcggaggaggtggtgtgtgaacagagacctgaatggtgggagggagcaagcccctgagtatctggggatgaatattctgggcaaaagagtagtcagtaccaaggcactgaagcagaggcaggcttggcatgtctgagcaacaggaagaaaaagtcagtatgtgactgagatggaagagtggaatagacaatgagcatgttcatttttctttgctgtgtaacaaaaacttggcgacttcatacccattcattacctcacggtttctgtaggtcagaagtctggcttagctcagctgaggtctcagttcagggtgtcccacttaggatgtcagctctggggaagaatctgctcccacactcattcaggttattggcagaattcagttccttgcggttgtaggactgaagtctctgtttcctggctgtcggtggtgagggcagctcccatctcctggagaccacttgcagttctgtgccataggccttctcataacactgcaccagcggcagggtccctcacatcagatccccgtcatacttcatgtcaggcccacctgggtgatcactgtctcgtaacatcaactgacttcagcccttaattccatctacaaaatccctgtgcagcagcactaatctaaacaccagactaatttttgactgagtagctaggggataggaattttggggggctgtcttaggaattctgcctgccaccatgaagttggactggtggctggggtcacgccaaccaggctcatagggcatggtgaggacttgagggttttgttctgatgaggtgggagcagcctgagtaaggaccatcgtggctctgggtagagagcaaattgtggagctggcgagatgcagaaggtattgcaggtgtccagcgggagatgatggtggcctgcgctcaggtggcattgactcctgaacagcttgcagtcccccaaatgtaccatgttgccttgtgtccctatatctttgcacatgcttctcctgttgcctggagcatttcgcatcaccacctaccccatgtggggcttcttcactgaaacaagtccccactgagtgctccaaacctagctcagatgctgcctggaggcctctccacagtgtttcccacccactggcaccttctcgccaacctgagctttgttgggtctgttaagctgtcttccgccctgtgctgtaacctctctggagtcaggggctttgtgtttggttcctgtgtttccattgtctagcctagtgcatggcatattatagatgcttgatgatgtttgtgggctgaatacaagaactatgggagatgactgggcgtaaagtagacatgttacgactgttggaaagctcaccctgtagagggaaagagcatatataaaaaaatatacaatacagtgaactggaatacagacaccatgccaagtgcacacaggaggtgtgccacctctacagattgctagtgtgcgtggagcttaaagggagcctttatcctactcagtctgcagtagttggcgctagcttttcacattcctccattgcatgaaatattgatagtattgcaaacaattccattttgttatatctaaaaacatttgtttggcaatactcttagccattaatttattcaataattaaagaagtaaacagtcattcatttaaaacattctataacttaagactgacaagtaaccttccttccctatctgtatttcaactacttggaaaagaaggtctgtactagtgaaattttgctgaagagtaggacctcttaattcaaaataacaaacacttacagatcaagtgtccttttaagagggaggaaattgtcaatctggttactaatgagaaacaaactaaaatagtaagaatatcatttctgcgactcaactaaacatttctaaagtttgaactttaaaaagtgggatgctggaaagaatgatttaaccagagtagacacagtgatgttatttaaaacttcataagcttaaaagcaaaataatgagggagtccagtttcaccctgctggcttccctgttggccattcacagtggggcagcgtgcctgccaggaggggccgaggtgcctgccagaccctccgttgcaagtagagatgcacccaccatggaatcacagggtgaggactcataattggcataagccaaaaaaaattataaaaaaaaaaaaccttttcatttatatcgccaagtttctctgtttgttttctagtgatctgtcttagagaatagaaatctgtggtgcaagaactgtttgctgtacagtcttgtgtaaataattggatattctatttccaattagaggctcggtctatagggccaactgtgatgttttctagctccctggaaagggtgtctgggtgtggagaatgtcttctttttggttagcagcgattgggtggctggctgggaaagaagtagacacagcatttctgcatttaaatataattttaatttggttcagattttttaaagcttttggatttgtaatgcattaacttggttttatgatactgtccttgtattctttcccatgcttctctaaaaagggtgaggagaataagcagatccaggaccccttggagccctgtaactagaatctgagaacacttgaactcctgtttgctttcagaacagaatgaacaaggctcccgtagcaggccttgctgggttcacctgggagcagcactaagagggaactttagtcttatccttttctcggctctcaaggcgttttagatgaagaaaagcagaataatttcatgggaagtgccaaataccccctcagaagttctctgggtagtttgcctaactttttttggcctcactgccagagagcaccgctggtttgtctgtgtgtggccgcatgggctaacatgttgacatggggaacccggtgtggatgcttccacaggcctgatgagatcagtgctgacacgggcttgggaggcatcctaaatgtgatgccgcttctcttggcttcccttttataaaagggggaggggaagggagtgtagggtaggggtaaggccagagtgggagagttacctggcaacttctctgtgcctttttgtagcctcagtgttgaatggtcaactgtacatctaatcgacttctttaaccattactcctgagagcctctaacttgctggccattgtaccaggacatacagtctaatgtagtccacatctggttcaaacctcagactcctcttcctagctgagtctcctctgttttgtggtctgtaagttgaggatagtacccctttcttcacaggattataaaaattaaatcttctaatttatgtaaatcactagcacaaagtaaatgctcaataaatgttttcttgtttcctaagatagatacagtctctgctctcacatgctagctttttccaacagtctggacagaggaccatccagcttcccatctgccagatgaccatggaccttcacacccatcttggaaggcagttcatcccattttcagatggtgtagtttttggaaagtacttccttaagtgaggtgaaaatcttcctccccgtaggtccctctggctgtgcctaaacggaatatttgctccttcttccatacagaagtcctaagctgttactgacaagcagcctgtgtctaccttctccccaagcccactctcacccaagctaaatgttcctcttccttttggttcttcccatgttatgtggcttcagtaccttctctctctacctggttgctggttttctggacctgtcctggggagccagtgttctatttattcctgttttatttacttttagggtataagtgaatattccagatgtgctctgacaaatggctcctacctcctttcattcatggtttttaatcttctgtcaatgtagcctaacatcccactggcatctatgataactgtatcctgctatttcacaattaaacttggtcaatcagatttcacatctttcccatcttctacttgcacaagtggaatttttaaattagaagttcaaattttattcctgttctgtttcatcgggttaggttttgcccatcaccgaattttttggggagaggggaagaccttattaatgtgatttaatacacaggtcacacttataacacttaatatatgcccacatattacttactaatgccaggtgctgttttaagtattttgataaatttcacctttgctctgtctccacaactatcctatgatacaagtactattattcccattttatagatgacacaactgaggcatagagaggttgtggtcacatggtgaactgtgttgagattcacacagtagtaagtgatagaggcagtatttgaaaccaggtagtctggctttatagcctgtgttcattatcactcagctggagtgactgttacatgaactagcccttctggttttcttttttgagacagagtcttgctctgttgcccaggttggtgtgcaatggcataatttcggctcactgcaacctctgcctcctgggctcaagtcattctcctgcctcaggcttccaaatagctgggattacaggcgcttgccaccacgcccagctaatttttgtatttttagtagagactaggtttcaccatgttggccaggctggtctcgaactcgtgacctcaagtgatctgcctgcctcggcctcccaaagtgttgagccaggtgtgagccatcacacccttactcgcacacattacaggtgtgagccatcgcaccctcctaggcttcttttttttttttcttgattaatgaatttgatcactgtgccatcagagttctcgtttaagggatcataatagtatgaatggaatggaggcttggatggaacacttctgtccacttataaggacctttctagataatcagtggtttgttgttgggcttttttttggttgcgggtagagtgggtagagtgctggctgttgagttcaaacaaatctaccttacggaatactagataacttggggtcttataaattgtttggtcatagcaatgtcatgacttcctcaacttccttgttgaaatccagatatgatttaattatagcattcgttagatctgctggtctattcgtcatatcacaaaaggcaatatagtcagatttgtgactgtaactcttttttttaggtgctgaacaagtcattctggttaaattttgcctaggacctgctgtttttaccagatttatttgtaaaacccttttccttttgccttttttttttcccagctacatgattttttttttcctttcaccttttgaaagctgaaacaatctttttttccctttctctagagaggcatgtgaacactcaccacacttcctaagctagttctctttggctaaacctcaagctcttgggaaagaggtggataaccagagttggccaagccaggtgctgtgtgtgggtggtttctggggcagcactggctgcagttagcagtgtccccacacaaagatggaaccacctcaagacaaggtgtcctgtgctgtccccatagccttgcttgtctgtgcagacccagcactcaagatgtcccccaacccacccctgggtgaactcccctgtgctcctgtttggccctccaccataacacacttctcttggcagaagagaaggaaactaggagttgctgagcaatctgtgtcttcccttagcccagggccctttgcttccagcagttggctctccttgttctcagtcttcttatcctagttactagagctttcttatgcatcttaatttttcttctctggttccttgaagctggagctggtattcaagaagagttccctgccctctaaagcagggaacagtcagtgagagcagtcagtctcactgtggaagttaggtccaagcagggggaatgacagctaatgacacagggcagcctgcaggagtggtgcagaccagggaagctgcagccaggagccaggctgagggaaggtacctcagggagggcttcctggaggaggttggaccaagacccactggctgggagaggccgtcttggctggagtgatggcgggcctcagacagaagaggaaaatgaggctcctcaggtaacttggggtttccaaatagctggtcctcagttttgctgtcaggacactggagtactgttatgaattaggaaggtttaatcacaagtaggaggaaatataagcaagcactgactgatgatagttaatgttagagattttaggagagaagctgggaagacaaacctcaaacctctttagccagttaacgaaaaattctctattttattctttctttttcttaattatcctaatgtcattcatttaagaccttaatttttaacgagtctccttttgggtctctatttcagtcaaacctcgttaaagaccatcccttttcatttttaatgtgtaatttccatttaccaagagtagcttttggtacttttaccatttaccaagatcaaaccatttacctctacacatagcacctctctcctccatcccattatgcctctcactaaagcagaactacaaccctcacctcataagccctgcttttattgcagacatttcaagggaatggctttggatggctttaataaaattttccctaatttgagtcattcatccaatgctatgtcgtgtttgattgacccatgttactttcctcatgtagagatagtccactggcacccagatatttcagaattttaagtgaaaaagaaaagatggacccaggcgcggtggctcacatctgtaatcccagcactttgggaggccgaggtgggcggatcagttgaggtcaggagttcaagaccagcctggccaacatggtgaaatccccatctctactaaaaatacaaaaattagccaggtgtggtggtgcatgcctgcgatcccagctactcaggaggctaagtcaggagaatcgcttgaacccgggaggcagaggttgcagtgagccaagatcacaccattgcactctagcctgggcgacaagagcaagactcgaaaaaaaaaaacatatttcaagaaaacaatacataggaactttatcgtacagctggtctcagatgccattgtttggggctaccttatacgtgagagcgcttcaaatctcctttggtactttagttactaagtcataaccaagagcagcaaagtgagggtctctttggaagcagagtgtccttctatttagaagaagtgttttctctagaatatcactgtcccgtagaactttttgcagtgttggaaatattctataattgggtcatgctagctgctagccactagtgtaactgaggagctgatttgtaaattttatttggctttaatttaaataaagcttgtttaaacatcttaaattttatacttctgttaacctgtatgtttttatgttctggtctcaggaactcttttttacccctagaacattttaccttttctggtgaaaaggatttgggttcccagcaaggaggtgcatctctaagacagcaaatttgattaggcttcttaaacagtcctatgattctgtgggaggggcattcatgtttagagcaaaaattcaccacacaagaatcattcttataaaattactttcctttttaccttctttaccaaaaatacctctttaaatctttaactttcttttcatctcttatttcctgattcctttaccttgttttagacataactctatgaggtttgagttagacaaagatattttacctttaataagaacattaaaaagaaaatgttttcctgtaattcttaaatcagaaattacccagatacttaatatcaaataataaccttagattctaaattatgacaagtttgtttgtaagcatttattccattacatttatctgattaatgtaatagtttacctagactattaacaaaaactgtgatagctaatatttaaagttattttccttttaactatttttatagctgtgaatttcaggtatttacttaagtaataaaacttatgcttaattttaaggttatttattccaataactcagcatttagttattttcattaagccaacaatatttcataggtatacacaagcaaagattattctgtcttgggctgggttttatagttgataaccctcatggcaaatgttatagtattctgcagggataaacattgctagtattttaccaataatttttttttttttttttttgagacggagttttgctcttgttgcccaggctggagtgcagtggcgccatctcagctcgccgcaacctctgcctcccagattcaagtgattctcctgcctcaccctcccaagtagctgggattacaggcacgtgccaccatgccaggctaattttgtatttttagtagagacagggtttctccatgttggtcaggctggtcttgaactcccgacctcaggtgatccacatgccccggcctcccaaagtgctgggattacaggcgtgagtcaccgtgaccagcctaccaataattttaaagccaccttatttattaaagattttacttaagtcatgggtatctgggtaatttccaatttaagaattacaggaaaacattttatttttaatgttctcattaaaggtaaaatatctttgtctaattcaaactttatagggttatgtctaaaagcatttgactagtcttttaagtatctgattaagtgcttttatatattttttaagccaattaattagagctctttatatatttttagtagtgaaacactgtttacacaatgtataaatacatagaggtatttaggcatgctgatagaaatacattttatagattcataaagacttcctttttccttttttctagttaaaaattcttaataacatgttgcatcactctaggcagttctcagctaaatagtcctaaattttcatatgaaaggaaagaacttaggtgaagatccgatagcaaaatttacattataagctacagggagaaaaagtttggtgtgctagagggaaattaaaataaatttagctgccaattaaacataaatattataaaattatatatttatatatcatgtatatataatgtataatatatgcatatcataaaatgcatatatagtctataatggccttttaaatatacatggatacatatatatacacacacacacacacacacaaagatcctgtagctttactttagtactttagccatgaaataagtataaattcactggcttgcaagaaaaaaaaaactgttagatccaaacagtggtttttatctcagtggaaaagtaacagcagatttaaagtaggcagaaaggaagacagaaaaagagaatttaggaactctatagtttgcaggtcgaccctagggttctttttccttaatgtaaatgtgcacaaagaccatattacttctattttacataaactctgggaagtagaggtgccataaaacctacagagtactcaaaaggggatcattctccttattttctccttatttttagagtatttctttctcacatttttttttttcccccttgaaaggaggaactgagctctggcctaggatttttgtgtggtggatggatatgtgtcctggatgagccattttaaaaattaatttgcactgaggatttccctgcagggttgctgcacattgtggggggccaaccccctagacactcccacgaggcccccagtcacccatgggcgctttttggctgggaggagcaaatgccctttctcttcagagctgaaaaaactcagtctctcatttacctatgaaaacaacagttcagtttctcacgcaaatatgcacagtcaagccaaattgagattaattctgagagaaaaagcaatagaggagaccctttagaatgcaccttcgaactggaattaggattcttaaacaacaacttcctaggagaaaaatcagctcaagaataaattaaggaccatcaaccaaaacaggaggtccagagctcaggaggacttaccagttccaccagaggagaagctcaaactgggtgaggcttcaatgggccctggctggtaccttagctccagttttgggcaactccttcagggtcctgagtcttctctgaggccccacatgtttgggcatcaaattattgtcaatgaaaagagtcaaactctgtaaaatatttgaagagatttattctgagccaaatatgagtgaccgtggcctgtgacacagccctcaggaggtcttgaaagaatgtgcccctggtggttggggcgcagcttggttttatacattttagggaggcatgagccatccgtcaatcaaatacttttaagaaatacattgatttggtccagaaaggtgggacaactcaaagcaggggcttccaggctgtaggtgaatttaaacattttctggttgacaattggttgagtttgtctaaagactggggattgatagaaaggaaatgttcaggttaagataaaagattgtggagaccaaggttcctttgaagtcttatagtggctgtccttagagacaacagatgacaaatgtttcctgttccagtctttaaaaggtgctagacttttagttaatttctttaggattgggagggcctggaagaaaaagatttagctatgttactagagattctttacagatgcaaattttcccccacaaaggacagttttgcagggccattccaaaatatggcaaagaaacatgttttggggtaaaatattttgactttcttgtcacatgttatgccagagtcagattggaaagtaagtcacgatatatagggttaaataaaacccatctgatgagaatttatggtttgtagggcatgactctccagaccccttagataggaatttggacaagattaaaaaatctgagcttagtcctcagtatgtatccaagatatacaacatgatgctatggaatacatgcaatatttaaaaggttactaaagttgaagcaaattaacatattcatcatctcacatagttatccacttttttgtttttgtggcaagatcagttgaaatctactcagcatgaatcccatatacagtacaattgtattacctatagtcctcatgttgtccattagagctctatgcttgttcatcctacgtatctgctgctttttatcctttgacctacatctccccatttcctctgccttctgcccccatccccataactactgttttattctctctctgtatttttaaaaaaatttcttttttttttttttttttttttttttttttgagaaagagtcttgttctgtcacccagactggagtgcgatggcgtgatcttggctcattgcaacctccgcctcctgggttcaagcaattctcctgcctcagcctcccaagtagctgggactacaagcactcaccactacgcccagctattttttgtttttggttttttttgtgtttttagtatagtagagacggggtttcaccatgttggtcatgcttgtctccaactcctgacctcaaatgatccgcctgcctcggcccccccaaaatgctgggattgcaagcatgagccaccacgcctggcctccttttttttttttgagatggagtttcactcttgttgcccaggctggagtgcaatggtgtgatcttggctcgccgcaacctctgcctcctgggttcaagcgattctcctgcctcaccgtccctagtagctgggattacagacatgcgccaccacacccagctaattttgtatttttagtagagacggggtttctccatgctggtcgggctggtctcgaactccccacctgccttgatcctcccgccttggcctcccaaagtgctgggattacaggcatgagccaccacacctggcccatatgggggaataaaaacactgggcacacagaacagtaggatgaattgctgagattttcaccaggagtgggtgggtaacagccagcgatgagaagagaaggctccgttccctccatcacccaggcactgggcaacctggggcagcccctccacccacctaagcctctctcttcttactgtcaatgtgggcacaacacagttactggtggggacgttctggggattaacccagacaccaccagtgaccgaaagtgccacacgttcccgtacccagtcctgcctgtctcccacctctgccctcccctgagctctatgcttcagactttcactttctatgctcaagtaaatctagaattaccacatgtaaatactctaacattctggggcctgaatttgacaggaaagcatgtgggagcttctagactgaggtcatggtggtatctcccaccccaccacacacaccctgttgtgaatactgcctgggagatggggcccagcttagtaacttagtgaatagggtgaaataatgttggacacattatactcaatgtaagaatgcatcgttcccaaccattctcatatttatattttctcttttcagggatccacatcttctggacccaactgtggaatatgtgaaggtaggaaatgagaattaaacatgtagccgtgaccctgggtagtagatttcccatttggaacacagagttgctaaataatgctgcagcctggtttgtgtaaaaagctgattagactctccaaaacaacagggaggaaatttgactcccttaggcctttggtaaattttgtaggggtctcacgtcatcctattacaggtacccttatctggccttagagccaggtgtgttttaaaattcagagtttgtttgtttgttttccagaaaggtaatatggtacgtatagtaatactcccagagaggtttggggtcagcactccataatcacactcattattttcacagtgacaagtaagaatattcacactaagagggataaatagatgacaaatgattttgtgtagttcaggtcacattttgccaccaaatgagtttgctgccaagtaaggtttttttaatgttagtgttcagagttttttggattttggaatgtagatgaggaattgtggacccatatttaccttcagtggaggaccgaaggctccctgagattttatgagtcatcttttccattccaacagccaccctcttgttcagggctaatctggggccaagtagtaatattaggtacttagttactttccagccggactggcggtcaatgcttctaagtattcaacccttctaaataatgtatttcttcggagcaggaagaaaagatgcttttcacttcttccctctgcctccgcattttccagtgttgctgtttgctttattttcttttatttttgaaactgtattctgtcacctcctacagaagaaagaagtctgattctcacatttggtttcttggatttatgacaacatacttattttttgggagaaatcgtagcaagagttagagtttagaatcaggagtctcattccaccttcgctatcccaaaggcagcagcatcctagtttcagagtatgtaggcatgtcgcttttgtgtgtacccatgcctttccccagagttctgccatttcctccctctttaaaagaccagaggatggacggaagaggaggaagctccagtagaaccacttggccacttggggcggtcgtagtgaggtttgttggaatggaggtggatattcttttttcccatctcttatacctgaatgacaactgagctgtgttttcatgggagaaaatgtataatcctaaacctgcagggctaccacaccagaatctggccagagctttataaatatgtatctgtgtccctcccggatgcatcacatgttttgtgcaggttgtgcattgcaaagtattagaggatgctatttgcatagactgtgatatgacttaacaaaaaatgcactctagaattctgcagtgtgtaacaacagctctttaaaaatcactccatgccttgtttcagaaattggctatctcctaccacgggccagtctggctgtgctcagcaagtgtactgccttcttcttactccaataccagttttttcttttacaaaagtctaaacccttttaagataatttggtagtgcattctcaagctaaatatagaggattttggaatggcctgtttaggtattatgcaagctattgcatctcatttatgaatatcaatcattgtgagttgagtggtattgacaaagaagagatattggagttgtcagtggcttctgtttatctgggctctctttgccttctcctgacagtgagatgtgatggaactgctctttgaggttcagagggttctccttttcaagaacttgttgaggtattccgaagggtaccctttcctcctaacttgatctgaatctagtcagagccttataaatcatgtgtctgtatccttcctgaatgcaccacttttttttttctttctcacttcacccttggtttagagggatggtttgggaatgtgttgagccaatgtagggtatgtattttcatttgcctctatggacactaaggctctgaaagcacattcatagaggtctctgacgtaaaggtccaaggggacccagggacccatcttcttgggttgggtctgttgtagcacttctcacacttagttgccctgtggagccgggctgaccagtgccaggaaggcctcataagttgatgccagctggtgcctcatggctggagataaatcaagggaggtgagagagttgcagctaaactgaggtgcagtttgacccccttaacttcttatctacaatccgcttgtgcacttaatgcctcttgagcttggagaaaagtagttctatgtgaattatgttgtgtcataaaggccccttccagtaggttcagattcattggccgaaaaaaacaagcatcaagaagccaaattttaggatccattttgactccagaatagggggagtcttatcctatcctgagtctcatccaggcaggggaagcacccagttgtggccaacagacagcagtccaaatactggcaggagctccagccccaggtctccctccctccctgtgtctttaaatgctgctcccctgctgggtgcggtggctcacacctgtaatcccagcactttgggaggccgaggtgggcagatcacccgaggtcaggagttcgagaccagcctggccaacatggtgaaaccctgtctctactaaaaatacaaaaattagccgggtgtggtggcgggcatctgtaatcctagctactcgggaggctgaggcaggagaattgcttgaacctgggaggcggaggttgcagtgagctgaagtcgcacgattgcactgcagcctgggtgacaagagtgagactccatctcaaaaaaaaaaaaaaaaaatgctgctcccctccccatcggagactttccaaccatcttcccttggttttttcagtgcccagatagaagagagaggtctgggactgcctcctgcctccttgggtctgggagagacaaggttctgaggctgaccctcatagctcatggggcgaggggactgcagtgtcatggcaggagagagctgggtggaggaagaatccaacattcagctctggcagtttgtatgtgtgtcctcctagcaccgtgcaccgtttgtgttgcagtacattcatgccaggtgaaaggggaccggtttctcggttgcttagctaccggtcgttcatcccaagtggaatggaggaaaatatgcatggctgggaagccccagggctgttgggcagctcttttaccttgtccagcaggctggcctcctgctgggactcctgacagcaccaagaccccaaaggctcaatttgatatttggatgtgagaggaaaataaattgcagatccaaagtagtccagggatttggggaatctcattcctcactgtttccgtctctttaattctggcacttacaggagagaattttgttttttttcacatttttcctaaccttctctcctcacaattttttccccccacagtagctcagaacatgatcatcttgatagtttggttttaacttttgtctaatcatgaggtccttttctgtggtcaaacgtaattgattctgtttccctgcattgaaaggaaagatttcttccaggttggaaagctgaaccctccagagtggctccaccttcctcctgctgtttaccatgtagctagtgacttcggttcctggcgtacagctctggaattttcctctgcgtacctagcataccttaccctagataaaaccaaacatttttttttaataggaggaaatatcttttagagccaataaccctaggcaaaattatgaagtagaattttatctctatactgctcaacctactcactgccccattgcacttgcccagatttttacttcgttaaaacacaattacactgtgtccagtttcttagatcactatcaagtagttgcttagaaaatttgataaaatagtagtgctaaaatgttaataaatgataacagctccatgtgttccccttcccagatagctgtccaacagagattcacatcccctgagaccccccaccccagggagggagctgggtccacactctggttctttttgttttgagacagagtcttgctctgttgcccaggctggagtacagtggcgcaatcttggctcactgcaacctccgcctctcaggttcaagcgattatcctgcctcagcctcccgagtagctggaactacaggcgtctgccaccacagctggctaattttttgtatttttagtagagatggggtttcaccgtattagccaggatggtctcgatctcctgaccttgtgatccactcacctcggcctcccaaagtgctgggattacaggcgtgagccaccgcgccccagcccacacttttgttctaattagcaatgtgaccctggatttgccacctgctctctgtgggttccattgtccccacgatagaaaccttggagtgggctattgttccttctagcttacgtttataggattctccatgcctagaataggctggagaggaaaatcttgtagccagtggtaaggagttcttaattgtgcgatatccctgttgatcctaagattgccgtattgattggaacaggataccatttcatgttgtatcttggatatgaagaccaaggtcatgatggatcataactgccaccaccatgttcccagaagagtggaagttaccccagcactcctgcattgctctgtgatccattatggttcacttctgtaaccccctttcaacctatgaagcctaggctcacttccactctttatcactctcttccttttattttcccctggaactgcatctttaagcttcagaagttgcccccacaaccagcactaaatataaatgtatattatctcctctgggtgcgatggctcatgtctgtaatcccagcactttgggagcccgaggtgggtggatcgcctgaggtcaggagttcgagaccagcctgaccaacatggtgaagccccgactctactaaaaatacaaaaattagctgggcatggtggcaggcacctcaggaggctggagcaggagaatcgcttgaacctggggggcggaggttgcagtgagccgagattgggccattgcactccagcctgggcaacagagcaagactcgtctcaaaaaaaaaaaaattttacattttctccttcccctttatacctatattccttttagcctcaagactagtgctgctttgtttgttttgttttttgagacaggggcttactctgttgcccaggctggagtgcagtagcaggatcatagctcactgaagctttgaactcctcggctcaagcaatcctcccacctcagccccctcaggtaactgggaccacagatgaccaccaccatgcctaatttttttttattttttgtagaaacagggtctcactatgttgcccaggcttgcctcgaactcttggcctcaagtgatactcctgcctcagcctcccgaagtgctgggatcacagatatgagccaccatgctgggccaagactaattctttttggcctcttcacacaccagccctacagttattttagtaaagagttcttttctaggggtggtttaagctgtagttttttaagggaggaagtgattggctagggcagggctgggtgatttttcttttagaagaagtgtttattatacattttccattttaaaataaattgtcctcaaaaaagttacattagaaaatatggtgaagtagaaaaaaatattggaatgcctgttttttttgtttttttttttcaaattagccatgaataggcaagtgtttttttgtggccaggctgtaaacagcacgcttgcccgcctgtggacaaaggcctgctctccaggctaccgcagtgaggaagtgtcaggacggaatgcaaccttttgttcctggctagattcctagtgaacgcatgtcctctttcttttgtagtcagccttggtgggttcttgttagacccactgtgagctgtaatagaatgacctacagtctctgagcttgttgcgcaggttaggagaagaaaggacaaggctgcagctgttatcctgagtggggacagagccctgcagcttctcccttcacagtgcagatgaccccagagaaactcaggaagctgtcctttctggggtcaatgctctgaaaattctccttccccaagggtcttctaggtctatagacgttacaggccatccaaggctcagatctcagcaaggccatttcctgcagccggctggggatatattaggtcacccagcatatttaaaaaggagtaattatgcaaattccaatgccaagaataagtgccctggctgccggagacctcagtggagaaggggtgatgtgacttcagctccctttttgtgctcaagatggctgcagccatggtcacaattaaatagctgtctttgagagaagccttttcttccagcaggaaagcaggccagtctgctctgaattagccagctcacaaagccatgaaagggacttacaaaaacaatggcacgctgtacattccatgagattttaacaagttatatgaaccaaataatgggccgattggctggctctgcaggtttttgcctgagtgtgcacattggcagagccagcgccatcccctgtgggaccagagatcaaacaccgccagcagtgaatgtaaaacagccctggcccgctctggggcccacatgcagagggacgaaagggagctcccatccaacttcttccactccaccccaaaaacattctctgcaaatattcttgggaggttcggtgttactacagttattaaaaatgctgaggtaggatgttcccacatcctaggtatggatgacagtctccctcattcagtggaatcttatccttcaggtctatgaaaatgtggccatttataaagagtaaaaccttatgaaaacacatgtccgtataaaagtctatatgcatgtttatagtgacattattcgtaattgacaaaaacaaaaactggagacaaccccaaagtccttcaactggaaaaaagtagtacacccatataatggcatattatttaaccttaaagaggaatggacttttatttacttatttttttaagaaacagggtctcattctgttgcccaggctggagttcagtggtgcaatcatagctcactgtaacctcaaacttctggtctcgggtgatcctcccacctcactgagtagctaggactccaggcactcactaccacacccagctaacttgtttattttttgtagagatggggtctccctgtgtgcttgggctggtctcgaactctggccttcctcctgccttggcctcccaaagtgctgggattacatgtgtgagccactgcttccagcctaggagtggactgttgatatacgcagaaacacacattgtgttagtctgttttcgtgctgctgataaagacatacccgagactgggcaatttacaaaagaaaaaggtttattgaacttacagttccatatggctggggaggcctcacaatcatggtggaaggtgaaaggcacatctcacatggcagcagacaagagaagagagcttgtgcagggaaactccgttttttttttttgttgttgttgttgttgttgttttgagacagagtctcactgtgttgccctggctggagtgcagtggcatgatcttggctcattgcaacctccacttcctcggttcaagcaattctcctccctcagcttcccaagtagctgggattataggcctgggccaccatgcccagctaattttttttgtatttttagtagaggtggggttttgccacgttggccagcctggtctcgcactcctgacctcaaatgatccacccacctcgacctcccaaagtgctgggattataggcatgagccactgcgcccagccaaaactccccattttaaacatcagatctcatgagacttattcactatcatgagaacagcatgggaaagacctgcccccatgattcaattacctcccaccaggtccctcccacaacacatgggaattcaagatgagatttgggtggggacacagccaaaccatatcatgggtgaatcttgaatacattacgttgagtgaaagtagacagtctcaaaggctacgtactctaaaattacatttgtatgatattctggaaaaggcaaaacttatagtgacagaaaacaaataaatggttgaaaagaggttggagaagagatgaagtacaccaaggagcttccagggatgatagaaatagaaatatcgtgattgtagtggtagttacccaactggggttggctgtcagtgctcatggaattgtactgaaaagggtgacttttgctgaatgcaaattatacccaataagcctgaccttaaaaagcaagctaggctgggtgtggtggctcacgccctttgggaggccgaggcaggcggatcacaaggtcaggagttcgagaccagcttggccaacatggtgaagcccctgactactaactaaaaaaatacaaaaattacccgggcatggtggcatgcgcctgtaatcccagctactcgggaggcggaggcaggagaattgcttgaacctgagaggtggaggttgcagtgagcaaagattgcgccactgcactccagactgggcgatagagccagagtgtatcaaaacagacaaaaaaaggcaagttaaagccttgtatttcagtccttaagtgctgccacctcagtaggagaaattttccattttgagatgggccacaccagggaggccagacccttgatgagatggaaaaagtgccgagcttgaagatttttgactgcagtggctcattcaacagatattttttagtatataccatgtgtttgtaattgttcagtcaggtcagaccaggtgggaagaaagtgttaccaggagcctaacctgagatagtcgcagtgggaatggaaagttaggccacatggtgaagggcttttagagatagaattaagacccagttattagggaagctgagagattctaacaggatgtaaatggtgcaggtgagggagagaagctaggggcagttcctgggaccacaccagtacctagcattgtgccagaagccagtaaatagggaggaaaggagatgtccatttggaaaccttgttaccacagtgacgttaatcttcgagcatttgtggatatctttagaccaaggggtcagcaaactatagcctaagaccaaatctagcccaccacctatttttatatgaccactaagctaaaagtggattttatattttaatatggctttttttttatgtggagtttcgctcttgttgcccaggctggagtgcaaccatgcaatctcggctcactgcaacctctgcctcccaggttcaagcaattctcctgcctcagcctcccaagtagctgggattataggcacccgccaccacgcctggctaattttttatatttttattagagacggggtttcatcatgttggtcaggctggtcttgaactcctgacctcaggtgatccactgcctcggcctcctgaagtgctaaaatggcttcttaaaaatcaaaagaagagtggcaaaattacataaagttccagtttttatgtgcatccatagttttattggaacacagcaatgcccattcatttatgtattgtctgtggctgcttttcctataatggtgggattgagtacagattctactccacttacgatggggctacatcccaataaacccatcatcaattgaaaatatcataagttgaaaatgcatttaatacacctaatctagagaatattatagcttagcctactgaatattatagtttaccccagcatcacctaagagtatcatagtgcatgttgctaggccagaaaagatcacatttcaaaatttgaagtacagtttctactgaatatatatcacttcagcaccgtcgtaaagttgaaaatcagtggaaccattgttaagttagggcctctgtagttgtgacactatggcctcaaaagcctaacagaaccttttacagagttttctgacccttgctctaggctgtttgcacctttgctgtttctgttttgccttcccaataatgcataacaggctttcaacaaaagtgagtccttgggcaaattttatgatcttgcacaatcacaaggatagtgcttttgtcacactgtgcaggatttggacgcatctctgcatcttatgaggtgtacctgtcagctctgagcagcatctctctgctgccctggtcggttctggcatctttagcccagatggatgaacaggtgtgtgggggcagcatgggtacttgaaccctgactgctcctgcctggggcttgcgtggataactcctcaggccagacactgctttgtccatgcagcctgagatgggttttcttgtgccacaagtcagagagaagggacttctcactgggcctcctgaacttgatggtttgagataaggtcaaaccctggagctgccctctggaggtgctgaaaggaacatggtctggccagtgagaggaataagaccagatttacattctgtgtgaatttgtattctgtgctgcaggcatcagccttgaagctgaggcaccatcctccctaactcgaggaaggattcttctgagatcccgaactgtagggatgactgagagactcaaaaactaacaggcaggcaagaattgaaactgtggcttctgacgggactcagctccatattggacttcgaatctggtgtggcctgtccacctctaacctcatctcctgccaccccaatagtcactgtcctctgccaccctggctttccctagtgtctctggggctttgccttcccattggcctggaaggttctgaggcagaatagctgagaggtttggagtgagtgctaggacactgctgtgggttgaattgtgtcccccaaaagcgatatgttgaagtcttaacccccagtaactgtgaatggtgaccttattgggaaatagggtcattgcagatataatcaaattaagatgaggtcatatttgacaaggatgggccctaatccactgactggtgtccttataagaagaagatttggaccagacacaggtgtagagggagaaggccatgtgaggacagacagagactgggggatgagtctgcaagccgaggagtgctagcaaccaccagaggtgaggaagaggcaaggcaggctcctccctgcaacctttggagccattgtggccctccggatactttatataggatttttagcctccagagctgtgagacaatagaaacatttctattttaaagtagccaagtttgtggtaattggtcttggcagtcctggaaactaatacaaatccagagcccggttttagccgtttcttggttgtatgaccttgggcaagttactgaagttctctggagctcaatttccttaacagtaaatgggaagatcggggattaaacagtgaatacatgtgaagttcttagttcttagcacagtgccccacatgtacttagcactcagtaaataccagctatatggctggttcatttgacacatttcactgcctcagaacagccttccctgacatccgtactaaaagcagtccccaagtcactatctcattactctgtatattatcctcatttgtcccaaattttatttattttattttttttgaaacaaggtctggctttgtcacccaggctggagtgcagtggcgcaatctcagctcactgtaatttctgcctcccaggctcaagccatcctcccacttcagcctcatgagtagctgggtctacaggcatgcaccatcacacctggctgatttttgtatttttttttttttttagagacctggtttcaccatcatgttggccaggctggtctcaaacttgtgagctcaagtgattcgcctgccttggcctcccaaagtgctgagattacaggtttgagccaccacacccggccttatttgtttacttttaaaaataagacttctcactagcatgtgagtcctgaggacaaagacccttcttttgtttagtgagtgagcacccacaccagatgcacaagggcgtttattttaatttttaatttttgtgagtacagagtaggtgtatatgagatattttgatacaggcatacaatgtgtaataatcacatcagggtaaatggggcatccatcaccatttatcctttgagttacaaacaatccaattgtactcttcagttattttaaaatgtacacacactgggcacttaaatttagggaagggggaatgaggttgttctaaaaattttatattttgcaaagcaggtaatgctgatgtctctaaaatttttccagaaatccttcggtgtttttattgcaaaacagcaaagaggttcccgcacctaacctcagtctaccttctcttgcccacctggtacaggataaaaactgtggggttgctgttgtcaccttaaatactcacatatttgggcagagatatacactgtttttaaaagtgtagttctggcaacttctatgacttagacctatctactctttgggagatcttgttaactatagggagtcagtaacttcaacaccaaaacgagaggcctggattgctagctttagaatcatttgctgttaagctctgccctctagtgctcatcagtgtcacaacagttcagcatttggctacaattcggtttctaaatattctaagagcttttaatattaaatgtaatagcatgtcaggacttgtattcaacttcagaaagaagagctgtgtttacaatacatgaaaatgcagatttaaattgtcaaggaattttattattagaattaattgtcaatgttcttgaatgaagagctctaaaatgctatgatactgtatgtagattttgagataggaggtttgcatttggcccaaagtgttacctccggtaaccaagaagtttcctgggaacaacttgtatttgaattgtgatttggtatctgaaaaaacatctcggcttggcaggaaggatgctggtattgggtaaggcagaagactccatgcctgggagacagcgtgtgcccaggctgactggagcaggagagaacagtgggaggagccttgggagaagcagtaggtgctccatgttgcttgaatgggaaaagagattccgagaagaagatcacgttaagaaatgagtttgggaggaattttatttattgccaaactgtctaactacatataactttgcaacttgcttttttcattggacatcattccatattaaacgtatgggcctccctccttctttcgaatgggtacccagtattccattgtatgaaatacagttatagttaactagttgcctactgacatttgggttttgctaatgttctgttagaaacaattttgtggttagtacatagtcatttagtaagtatttgttgagtctcttccctgtgctggtcactgttccaggggctgaggatacagcagtgaacaaaacaatatccctgcccctgtggagcttttactctgggggtggaggactggaaagacaataagaaagacagtcaagtcaatcctgttagctgacgatgagtgcttagcagaaaagatgcatcagggaaagcagctatgaaagttggagtaaggggacattaaattttagatagggtgaccagggaagggcctcaccaagaaggtgacttttgagtggaaatacaagtcaactgtaatgtctaaggggaagaagaagggcaaggctttgaagccagggtccgcctcttccatggaggaacgaggaggccagaggctggagctggtgaaagcagctggtgttagagtggcagaaggtgatgtgcgagggattgtgtgtcagagtaaagacttcaattttttctggaatgagatgggaggcatctcaggttcactttggcttctgtgttgctgctagactgcaggggacaggggcagaagcagggagaccagtgaggaggctactgtgattgtccagatgagagatgatggtagtttggacctgtgagagcaggggaggtggtaaataagggggttctaggaatgtaacgtgaaggcagagccatcagcacttcctgatggattggacatgaggtgggagaagagaggagccatgcttgacactggtaggatggtgctgttgtcagtggaggtggcttggtgtgcgttagtgtaagaattttcagaagataaaaatctaggagtagaatgattcagtgtcacataatgggtcaaaataaaacttcttggcaaccgaaagttttttttatttgtcgtttcttacatttttctcagtttctaatttttttctaatagtgtttttatgatagttacttataaaaataaaaacacccctgtaattatatcccttagtctactccataggtaagatactgaaaacttatggctcaatcaaaattatgtaaagcaagtaacttaaatattagagcagaagttcttaaattcatttgtctcaagactttttaaattattgaggaccctaaaaagtttttgttatgtgacttctagctattgatactcatcatgttagaaattaaaatggaatattttaaaatgtttatttaacttatttttacttgatgagcatttcatgtaattcatttaaaaataagaataaacccattatataccagtgaatgtacatttgtggtaagaatgacattgttttacatatttgcacatctctttagtgtctgatagaacacaacttgattcttatatttgcttcggtgttcactctgttgttttgtgttactttggttgaagtctcaaataatgtggccctgcacaggtatgcagttcagaaagggaggagtattttaatagcctcttcagatcattatagttgttggtctttgatactagagttcaacaagttgtagttccttaaaagttaactgcaatgtggactctgaaatcctgtcaatgaacttgttttatttccttaaaattcaatttgaatggatctctcttgcaatttgaatggatcttttacccatgcatgagtttatatcatcatgcattggccatttgaaaaatattggtttacgagttatgcagatcttataaatgttacatatttcactatgtaatatcagaactcacattcattaatatgaccaccgatctcatcagaaaaatcattaaagtattggaaagctgtcaaactcatgtggtgaatacaagttttccaaaattctaattttcacttgaaacctggaattttatcattggcaacaaacactgtctgttgttttccttgaagtaacaggctcactttgttcgtttttcagaaaatggctgccaaataaatacccgagtctgaataaccaagtttgtcagacattctttgaagtaaaaattgtgctctatgaaaaagcagctagttgagcccacaattcaattgcacagttgcttttccttcacacaaactctgtgcttggaaacacagcagaattgttttctgtgcatgtcctgttgcattgtatagaatactaaagagacatgtactcgagggcccatatttaataaagtgagtaattctcactgcttcatcaaagacttctaggtggaactggctatttttcttcaattctttgagccaatgggagtcaagagtgcaatggcccctggtagagtttggtgcctctgccttgctttgtgctgaggcaccaggaattaacccatcatagcttttgcaccaccagtataaatgtcaacccagtgaaacaggcaaaaaatgtctctgtattattatgaaaataagttttgacctctcagacccccagaagaccccccagcctgcagatcagcctgtggaacacactttgagcaccactgtaccagagggtcttttgctacttaagagactaaaagctgcaaaaacacttaaaacacaaataatcccctcttgtttatctaaatccatatttatttctctagcaaagtttacttttaagctcagcttgcccaacagttgcatttacatttaaagagacttgtttttaatgtaggaaagacattaaattttcatttaaaagtaaggaaaaaattgagagtcaatccttgaagtaagggttctcaattgtgggcctgttccttgcagtggagtggattgtgacacctctggaaatgctaactctatgtaacataaccaagtcatgatatactgtaaagatctggttgctcatcatatactataaagtgctaggccagaagcaattgtaactctcctctcattgctttatattaaaactctgaaaaccccaagcttggtgaggccaaggctgggttatggcaaggtgctctgcctgagtatgcaagtgtagtcgagggagaaatttgttgcagggatccatttacttgggacaggctggaagtgcgcattctcctgatccttaagcttttattaattgctgcagccttggctccttctatgctcccagtgtggatttgctggctgagctccatccatcctttatgtgaatgaagataaggatgtgtcagaccctgggaatgagaacatgctgtttggcccttcaaggcaatttcctttcgagtcccagccctctccagatggcatctaattgtttcttgaatgacctcagtgtccaggctgcaggaacctggtctgagaagccatttcacatatttattagcctgtggatgagaacttactatataaagcccccattcacattctcaaaagagctttttgtacagaagaaataaggaaactgatggactgtttcctgtgaccaccagtcttcagccggattcttatttttaccaggcccaggtgggtgtattttgaaggggtctgtgtggtccagctgaatccatcctggttcagtgccctcctgtctgtctcctcatggtctctacatgaaagccttgacagaatagagtcaagtccccttacctcctggtttcaggattacttgaacagagtacaggtagtgtgagttgggaattactgcattctggaagcctctcccagtttggaatcccagctagttcaaagtttgagagagtaaaatgactcttttatttttgagatggagtcttgctctgtcacccaggctggagtgcagtggtgcaatcttggctcattgcaagctctgcctcctgggttcacgccattctcctgcctcagcctcccgagtagctgggactacaggcccccgccaccatgcctggctaatttttttgtatttttagtagaggtggggtttcaccatgttagtgaggatggtcttgatctcctgacctcgtgatccgccctcctcggcctcccaaagtgctgggattacaggcatgagccaccgcgcctggccgtaaaatgactcttagggccaaagtgggaagcagccgtaattcagccagaggctggcaaggctggcttacccggtgaggagcatgacttctgtgtggcctgtcatccctcacgcctctgcagttctgaactatttttggagagacagggaagggcccctaccttcttgcaaataccatgaacaagagccacgtctctagaaatatgcatgcacacttactgcacatcttagttccaggtgtttgtggaccccaggttgagaatccctgagctatctccaaatgttcagtgggcccctatcatgttcaggcattccaatgatgacaataagacatgggtcatgaggccaacagacaagggcaccagtcattttaatgagtgcttcagtagctgaaccctggaggacagggttggagctagggcttcttaaggggagaaggaaacccctacgggcccacacagactgagagcaggggctcccaaacttccaggccatgtccacctaaggactgtctaaggagcacatttgggaagatttgaatgtgatttggagatgatgtaaacgtcctgtcctttgacctggaaagaagtcatgagggttgccctcgcaggtgactgtaccgggaaaagctcacctggcctcaataaggggatgtctcagccagtacctctaaattgggtcctgtggccttccacatagcagaaaagccttttggaaacatcctccaggagctgaggatggtgctgatgccacataagcagggctgagaatgcagtttgtttgtgctttcccctggctgggaggtgctgggtgtgggagcagaactcacccctacaccagtggcacagtacattccaacaacatgaatccctctccctcttcctagaggcaaattcgtgtattgttatccttgaaaactcaaggcaactcaattatttccatggaagtccctggaatagactgcaaaacaccattaatttccattcattgctgacacatgagtgtacaaccctattattaatgggtgtataatatgcatgttttcatgtaacatcagttcatgttggctccttgtagcgtttctcagatacagagatcacattttatacacataatctccaacagagccagacacagtatgttacatctccatctcaagttttaatcttacactgataaggtgagcctgtaaacccaaattgatggtgtgagctaggaaacttacctctgggaagggcaggggtggagtggcctgggttgatgactacttctgggaaggaaaacatttttaggaccttagtctcttgcatctgcctctctcagcactttgaccacattctcttccatcagcttctttatgcagtgagggcctggctgtgggctgctctaggcttatattcttaaggcttgtggtccaaggggaaaaggggatgtctctctcagccctagtttgaaaagtctcagggaaggactctgtttggtctcatgtcattcacctgcttactcttggaccattcagtgttcagtattctgattggctcacacatccattaaaaggatgaatacacatgctactcagtaaagcttttaaatataatagccaccacctgctatctataccattcccccccttacatttttaggatcagaagtatattctgctatatttctattatctctattcaggatacatatataaaatgttgagacatgaatgctaagttttgcgaaaaaaaagaaaatcttttcaagtcctattcccatctttccctagtttatctccctcctggtttatgtactggatacccattgcctccaagtttgccagatttgctgctgttacagagaagttatgggcagggggtggggatgtccagaggggctgtggatccccagcccatctatagcttgtccttggatggattcccacatcttatcacaagtgacccaaccgggagtcctggtgttcctggatagttacccagatgggtttctgctgctctccctagtaattctcccttcctccacccagcccttccacccatttggatatacactgcaaggcgtacccaaatctttgagccactggcaaaggaatttattgtccccaccttggcaccaggaagggcaaatattgaccttctggatgtcactcctgcagacagcattatgcttggcagttgactacgttaggaagtgaagaaactggccggcagtcaatgaggtccttccatgcacagaaccctctgaattggcctcttcctatagaggaaggggtactgtttgtgtttccatgtgacaaaagcggtcccttagcccttcttgtgcagcaagcctttgttgcctcctggttcttctcagattctgatgtcagcatccatctctcccagccctgcactttcctttcagctgtgagcggaataggacctctgatggactattgcagatgagatctgctgcctgtgttgccaagagtatctgtccctctgttggagggaggtctgcctttcagatttgcataagataaagcacttctggtgaccaggtgttctccgtgcttccctcatcacaccagatagagccagccattctgattcgttgttgttttaatcattaactttaagagctgtttgatcccacatgtgaaatggagataataatactcctctcctagtgtgactatgaaataggacaccatggtaaaagttctctgtagaagtgctggctcctggcctggcatggtggctcacgcctgtaatcccagcactttgggaggcctaggagggtgagtcacaaggtcaggaattcaaggccagcctggccaatatgatgaaactgtgtctctactaaaaatacaaaaattagcccatctctactaaaaatacaaaaattagccaggcatggtggcgggtgcctgtagtcccagctactcgggaggctgaggcaggagaatcacttgaacccgggaggcggaggttgcagtgagctgagattgcgccactgccctccagcctgggcgacagagtgagactccatctcaaaacaaaaacaaaaacaaaaacaaaaccaatgtggcttctggggacctttcacatggggtgagtgaggtgaaacgatatctgtgactgctgcaggcttcttcaaggcatctctgaagtctgtggtgaggaggggttgttgagagtcaaacttgtagctcttccaattttctgtcctaagtattacatgcaaacaaggtccatccacccactgagtgaaggggttcccgtgctggttaaagctgctccagcggccataagaaactgcaatactacttgcctcaaggctatctatcccctcctcttaccagccacatccctgctacaacccgggtgtgtgcaaggtggccagccagggtgctttatcagtccgtactcacttctgtgaccaccaaggtattctcacctcccttcctacatgccactgaaagtctttctggatcagaaggaattttttggtcacgtgactctttgaaattgggtaaaagtcataacccctctcctcaatgaacacaacaatttgtatacagtttctagtggcccatggaagccccagtccacccctaggttcagaactcctcatctggactgattctcacagctactttggcaggatacagaattatccagtacgtcacttagatggtaatgcccatgatcagcttatgaccatgaaaaagagatattttcccactgaaatattttgtttgcatggctagaatttgcttgacaacagaaaagcgattgataagaccattttctctccaggctggaatgggtggggttactcctgactccacctctcacctggtactgaccccgccctccgcccctgggttcctgccttcctaggcgggtgatcccttgcaggcaggttcatccactcagccacttggcagcctttctaggtggagatagggatgggtggctttagaagaatgcactgtaactctggcagattcctgccattagggacttgagagaaggagatctaggcagaaggcagtatctgggaggacacagagagaaagtctagagagggcagaggggtcacaacatctgaggagctataccagacacggttgtagttctagaattggttggtatcagacaacccagtaatacagggcggggaaatatgaaggagtcggcatgtgagaggtggttctctggggatgctaaacacatgtggaagatctgttcccagggctgaattgcagggccagggcaggaggaggtggggctggaggagtgaggatcctgtagggcatccaatcaggactgaggctgaagtccaattctgcaactagcttggtcccaaggcaatgggaaaggaggggtaccacccaggccccataggcagagggggcccacaggatccccagtcagattggctcagacaagggtggtacatggagagctggtagttgtggatgaacccaggagtcccctgggttaggatcatgtgagcagatgctgtggatacacctgctgcctgttaaacaactcctaacatgacagagactctggagtagacaatcctgagacatctgggcaagtgtgattaaaaccatatgtggtatttgaataagcagttttagaatttaatgagtaacatatattttaaggctaaaagcttttagaagtctccttattataccagctcctaagtataccagctgggagccagccagtggtcagtggctcatggcatgggtgggtgtccactctcttctcgtggctacaggcgtggttcctgtagcccagcgtgtgggtgggcgtgtgccctgcgagtacagtggggaagatggggtttgttgtcccttctttcgaagggggaaggaagctcatgtttgtagagtgcctactatgtgttgggtgccaggccctccatgtgatatctcacttgatgcttacaataacttggtaagtctggggaggaaactaaggctcagagaagttaattaattccccaaagtcacccagctagctagtggtgaagaccagaacccatcctggctcgctctctagcctcctacctccagggtgtgttacagagccattttgaagacaagcaggtgtctgtctcacagctcagttttggaagatgccattttgcagaggtgcttgtgagacagagaactggcgcagtggaggtgggagagaggcagctgttcctggctggtaaggcctccagagggcctcgcagatgcccgtctgcccatttctgcagcactctgcatgggagggacctctgaagggctttgtggtcgttgcctattagttgcttacatagctcatgcctaccaaaagtggatggaaagggaaagagaaaagtgtacagcaaagaaaacccaggagctgagatggcaggagaagtaagtgattgctccaggtgtaattgcttgcatagtaagtgtagaagaaaaggaatcttgggaagtaggtggtgaatcatcttggatggataagactccaaggggtatatggatgggcttctagtggatacaagaatcccctgaagcagaggtgtccaagagggagaatgggttcttagtttctgtttctggttgggccagtaaagccccttcctcatccctcttttccacttatcactagagacagaaactaaaaaccatggctttggctgggcacagtggctcacgcctgtaatcccagcactttgggaggccgaggtgggcggatcacgaggtcaggagatcgagcccatcctggccaacatggtgaaaccaagtgtctactaaaatacaaaaaaaaaaaaaaaaaaattggcgtggtggcatgtgcctgtagtcccagctactcgggaggctgaggcaggagaattgctcgaacctgggaggcagaggttgcagtgagccaagatcgcgccactgcactccagcctggcgacagagcgagattccgtctcagattaaaaaaaaaaaaacaaaaaaaaaaaaaacccacggcttcaggctggtaaatgcctaaaacagagcaaaacggaacaacatagtaaagcggattggacaagttctaattgtaaagcattgcaagtatgtgtcttttgctctagaaggagggcccatgactttcatagaatctcagagaaggccaagatcatcagatagtgagtctgccatttgagagcttgggattatgtcctgtatgtattctttctttttcttttctttctttttgcctgaacgctaaaaacagaaaattgagcttgtgtaatataagatttctggggtgacaccaggaactaggtggtagtggtagagaggtgaatggggcagaattgtgtgtgatagcgtaagaaagcaaaacagggcacagtgcctaattttgcttcgcattactcagttatacaattttaatagctagttagagaaacagaaattggtaagggaagacagaaggcccagcagagagaaatctgctgtgaagactgtactttagtctctttgtttatgtgctaggcagatcaatattgcttccggatagagaccatttaacagccatactctttcatccccttgaggaatctggggaaactgttagaccaggatatgtacagcacgcactcctaaatgtactgtctgtgttcaccagggcaggcgaacgtcttgtccacagcaatacacaaagggggccagagggcgcaggcattgttgcctgccctcctcccactaagtcttgtttgcattccctttcggagcaagaaatcaatcagatttgcatatagggaaatgtgtagaactgtctttggcagcttctgtagctactgagcctggctggaagaggagctgaccttttgcacaaagtcctttcctcctgtcctccctggtttcccagctctcctccctcaggccctctggctctttgtgggaaggtgtgtgagctgctggcttatttgttcagaatcaggcagagatagggtgggtgctggggaagtcttgagaagcaaggctgcggatcaacttgcccctttatctgcctagggcttcccaggcacctgccacactgctctccacagagccgagtctgcagaggctgtcctcaccgtgacgccaggctggtgctgagtggggcaaggtccaggctaatcattgcctacttcccagggcaccaggaaagatggagctggttgcatcagcctcatgccctggctcattaaagctgtctttgttcagcaagagccagatcacctgggtttaggggaagcaaaaagccagaaagcattgatctttaggggagagggagtaggataaagggtcttagtagttgccacaagatgttttgagctgttctgatcacgattactggtgttcacccctgaccgatgtccctttgggcaggaacaagccaggccttgaagcctggggtgagtcactgtcctctagccatgggcagagtcactgtccatggggccgcttgacaaagcccaagagtgcctcagtgtaaggcttgatgccctgattctgggctgctttggggagggtttggggctatgggcagtattacgttccagatgtgctgaaacagtgaaaagcaggtacctagcaggcatatctttctcctgccatctccctccatgccctgttggagagagggcctacctcactgggagcctgatcttctagcagggaccgtggtgctttgggaaaaggactctgcactcactctcttggcccttctcagctgaggggctgctgccaacaggaagcatgtgtctgctgaatatggctggcaggcagctcctgtttccatggttactaaatagggcaggttagtattagggctgcccaaggaaaaactggcattgagggcagtgcttatgcaggggtcttcctccggcctgccttaaccccctttttgaattagagggtgggcaacatttggcctgaggtaatagaggtttccttcaaggacccacctggcttcccagccatggctttaatcacaagtgtttccctcggtgcaaaggagtgagccttccaggcagccagagaagggcggtggatgggagttcaccctgtaggaccttttccagagctcagagctgcctgactgggcccctcccttcctcagtccctgggagttccttagaaatgccctcccctatcccgaaaggggcatggtgtttagaaagccctgtatccaaatttgatgagtcccaaatcccacacaccagatcatcagaaagtggcccactgccccaggtcacagccctttcacggggctgtgtgagtaacaggtttaattataagacattaaaaaatctatttgtgtttctatgtgatcagataccagattctgcagtctgaggttggagtccctagccctttgttctctgctgagtggtacacaggtctggtcctctatttctttgtaactagaataatcattgtggggagaatgggaggaattgatcagcgtaaataggcagcgtttaaaagcttaacaagtcagtgaagggcactttgagaatgtatgcaattatcatctttagttacaaaaacaacacgttattttagtctctctccttgaccgtttcaggagaaaattgattaaaacctttgagtgctgcttcagaaattatttttggtgtgaaataaaaataaaagatgcttaggaaacagttacctaataagattagtcattatttaatcccggtggaacaaattctttgggtattttggagatattcttagaataaacagagaaaacctcaggtaacaagagctgtgataccacagtgacctaagtgtctttggttttgtttttaccctggctgtggagcactttattcgtaattctatgtgatttacatgtctgagttatttgcatattactttcaggaatgcatttcattcacgatttctgggggaagggtgtctgggcttcggagtctcttggctgactaatctcacgaatttctgtgcaggatttcagtcactgcccccctcccttttctcaggcctgggatggtgcctgtctagcctcttggggaggtttttagcttgaaggaattgttatttgctctccaaggagaataccaggtgaaaatggcccattctgtggtggctaatggcctgattgatgagtcatgctcacagaactgctggggcctgggcctggctgctcacacggacttaccctttgaactccatctaacggaaatgagggcaagccagaaaacgcttcctcacaggtgcggtactggaccttcgaggacagtggggacccactgaccagacagtcttcaagggctcttccagctcagaaaacccttctgagttctgccaccttggtgcttccttctaggttctctggtggactttctgtggcctgggagccgtcaagactgcagaccagacctccagagtcagagaggagaatgagtgagggaggaaggcagaaaggaagtcatcgcccacacttgctgtggcaatagcgcctcacttagcagctccatccccatgttgacacgttgatgaggccgggcccttgcccttgcgtgggtgtgagactgtggctctccatacctgctcactgggcccagagcaatttcctatttttgtgggcagacttgacctagtccaaaggccaaggtctcccgaggatttgacgctaatcccgttggatatttctcatacctccctcatgcctcatctggtattgttcctttctggactgaatagatcttgtttcttcctcattacaagtttctgcctgtgtgaagttttagaaagcttcaggacacattccatatttgaggccgaagccacaaaaagttaatatttggagcggtaggataggagaggaagagctacaggcagaaatctggatttgattaaaaaaaaaaaaaaaaaaaaagaactcgttgagcatccgctataactggaatgaagggaaaagcagttagttttccctaaaggtgttatgtggctcttggtaggggtagaggcctcaggtcgcagggaatccaggagggccttgcttggctgcgttggatgcgaggtttgtgtgcaggatctaggttacgcaaagtgggtaatcagagtggcgatgagtaattaaagtgaaggatttaaaggaaggtataggacaaacagttgagtcagaagtgggtacacagtccccatcctcccaacaggttgcacagccaggtgggagggcatagggcgctcagggtgtttgctgacagacttgctaattaaacaccaaaaggcaatattgctttgccagtagtgatggctgtgccaacgttatcagctgcaaactggctgccaggagcatcttaattaaaaataaacagctctggaggtgggcttgggagagtgaggacagggatcctgcctgggttacttagtacatctagtatttctcctagggaaagtcacttttaggccacctcctttcctcaaaggagcctctgttcataacaaggtggtgtgaatgtacaacttaccctgcttccttaaacctctgggtgctggagtgacaagcagacagaaccactaggagcaggtcgcatggtacagttcagccccagaaggaaattctgggtcgggggagaggggctgctaatgatttctgcctggtctctaaattgaggggacagctaaagcccaaggcctcttctaagaggggttagaatttcatcagaaagcaagtctggtcacatgagaatttctggcactgtgtgcatggcaggctggacaccagcctgcgagaattgagcgagtggatcgtattggcttcagcagaggggaaaagtcccagactagcctgggagaaggagccgactcactcccccggctgccgacttccctgacttctgggcagaaacagcacagctgctgtggtgggctagggctttaacgtccgaagccccctttcttttaaccctaaagaaagtgtgtggtccccgggactgaagaccgaaagatgcctaaggaatgcagtgctttccacgccctctcagcagctctgtgctgcttctatcaccgcaagtctttcattggagtcaaggtaggtttggtttggaaataaagtacatctgtcaatcttttgggggaccctgaaagcatgagtttcctaaagggcaatagataaaagtttgcagcttgctgattgtgaaaacagaggtgctttctttgactgatgggtcttcaagagcccctagtggtgtacctcccctggaagcagaacccagtggcacagaacagggctccttgtctgttttgggctgaagctgtttttcaggacactttcagttctctgtaggctgaaattttatactaaagtagctcaataggacagagctatttttcttctttctctctttgtctctcttccttcatttctaacgaacacaaggtagctgagcccttttctctgtttatcctgctggtccattacttatcaataatgtacataatgtacagaagccacacaatatttcctttcaaattgcagccaggtttcaaaacatctcagggttcagaactgttgttgtctttactgctcacattttaacatttgttataagacaccggtgccaagagctttgtataatatgtcaatacactattttgatgaaaatattcagagaacctcctttggctaattcaagatgaggcctgtgttctatttgcctgcctgtgacgcactaggaattaagattaatataggctttcgtggatcttggggtttgtctgccttggaaaaagcctgtcggccccagcctgactgcggacctcgtttattcctgggaaattggactctgaaagctctcaaggaatccttcccaccctgaagcagagctccctctcctgtgggactggctcattcattacctttgaaaaggctgcagcagggttatgatgttctgcttctttcttctcaatacgcttttaaaaaaatcaggaaaactacctgttagtgggagaaaacctttttgtttaaaaatatacagagtgggaaaagggtgagcttccattgattttgctccctggtaggagtgttcatttttgtccctttgtcaagaaatttgacagaggatgagtaattaatcattggttagaagcattcccttcctgacttgagcccctttctgtcctggagcccagtgaagtgatgcgagatccatgtggtttctggcctaaatatggatcgttcaagtgtggggcagatgaagtcatgccattaacagtattttaaagcttccaagatagactaggaggtcccaaagggtatggtgcacttcggggattggcagtgggtttcactctaatagaagtccttccacaagccaacttctgctaattcagtgaagtgcaactcagcattgggtgtatgagggagtcagcctataaatatctgggtctgagggatgagtttctgtttgggtacctgttggtctgcagttacggccccaaggctacataatatatagaaaaggccacttaatatatggggtagtcgggtccagctgtccttcagcttgtgcactctctatctctccaccgtggccactcttggtggttgactgtggtagaaacacccttctttccgcctggacttctactctattcccagtttgtcgaagtcttcatagcacagagagaaggcctgagctgctcactcactggaaactgtagccctcggtcccaacttagggtttaccaactgcaccctcaagatgagtctccctgttttgttttgcttagctagttacttgggaaagaaatctgcttgtacttaatcccccatcctgccagtggtgccccagttgataatgccgagtcgctttattgactcccactttaattaggggttccagatcttgctgctcataattagtttccgttgcaattagagtttcaaaattaaattgggattgattgcctgatagcaaagaggaaataaagctccaattcttgaccatgtatactgcttctcttggcatgaatttctcataccaaaaataacactgcggtagccatggtaactttccatttggtctaatccatatcatctctggagaaagtacgatggtattaatagtgtttgctgtatgggaacaaaactaaaaatatagagggtccctccttacataggagaatgattatacaggtgtttttagagagtaagatcttatttgcagcggtcttacagaatttaggttgtatttagaggcctcatacggacttgtgtataaagaccttggaaaggaattaaatgggaggccgaaaatggagagaaggatcagggatgtgctggccctcatagagttggggccaaatacaagatgttccagccatgttgagggtcatgactttaatatcccgaaggggttcacagtagacagccgttacataaaagactactggatcttttttctgggggaaaaaagacgaaagtgttttatttaagcccagtggaaagaaacttgtaatggagatattccagatcataacattaacagacatattcaagttctaaagtccatgcgtgttgaatgtagaatgggtgttgaatgtaaagtccatgcataagccctctgttaggtggggagggatttgtgggaggtgtggggcaataaatgagatttgaggcatggttcctgccttcaaagacttaccacaaggatattattaggtcataatatcacttcattacatttgcaaaagactttcaaatgtatgagttctttcacatcttgtctcattggagtctcaaaacaagctctctatgctatgaagacttcaacaactttgtctcactggagtctgaaaataagctctgtgaggtgagcagggcaataatttaccctttccgcagaggacacaccaaggctcagagaaacagcccgcccagaatcatttcgtggggaactaggaatagaaagcagattttctgggctgaagcctagtgctctttcttttttttttttgagacgtagttgcccaggctggagtgcaatggcgtgatctcggctcactacaacctccgccttctcctgtctcagcctcctgagtagctgggattacaggcacccaccaccacacctggctaatttttggtatttttagtagagacagggtttcaccatgttggccgtgctgatcttgaactcatgacctcaggtgatctgcccacctcggcctcccaaagtgctgggattacaggtgtgagccaccatgcctggctgctagcgttctttctactgtactatattaagacaattgacgcctaaaataagatgatattgtgtatgttaatactttattttgcagttcagttgggagagaacagtgtgagccttagtttttaggaaagcttcagggaggatgtgggactgtttttgtttttgatgttgttgtttgtttgtttttaagaacaggtaaccccttttaaatttttctcctttttttaataactggggatttggatggacaaagaaaagaatggcatagggacggcatttcagcctgggggagcagcagacccagtagctcagagatagaaaagccactggcatttgcaggagtgcagaaggccaggcctgctcagagcagaaggttcactgggaaggttagtgtgtgacatggtcagagaagtcacagaggatctaggaataatcccagcagccaggcctcctgtaccaggggttaataagtatttgaggcacatttccccattggctttcatcccattgcatccttagttcagctcagcagtcaccggttgtggtacctcggatgtgtcggtgctggggacccagtgggagttgttggtccagtggggatctctgctgtaataccatgcctggtgggcattctgcagacatttaactctggttgaaggaaacgatcggttatcactgatttggtgttgctctctttagagggtgctgtggctccctggaggcacatgcctggcatagatggggcaggagtggcgaggatcagggatggcctcctgcagggaggcagagcctttgctgagtctggtgaattagtcgaagttatccagagaaggaggagaattggccttcttcgtggagagaggagcacgcacaaagtgtagagacgtggagtaccctggtgtgggcaggcagggaggcatcagcctggaaggggagcacagggagtggccgctggcaggcccgcccccaggtccctggtgagctagaggaggaacttggtaaaaagcacaatgggtcacatttctggggctggcactggaaacaaacccctacctcttctggccccttgtgtctctgactgttagtaacttatttatttaggtatttttgtggacaggggacaaaggagctgaaacttgtcactttgtcaatgtttgcgcctgaggaaggtcaggggtgcctgtgtcagaggaacctaagagacgggaattaccttgcaagggcggaaaagccacctttctgaaagagcgcagatagagaggttggggtgtggtgcctgtggatagatggaatcagtaagtctcagctaaccaggccttaagtctagtggccatggtcttgtcaatgagcagccacagaaggcagggatgttagacatgtgctttcctagacttatattcgactgtctttgcagccaggaagtgctatgtagtattgtttcttttttgttttcctttaaagtcatttcccctaccctgaaaaaaatatctggagcctcttggaatccatattacagcctgaggagtcacatctgcccatcctagagtgccaggcccctggaacttggtttcatgtgaaactgtctttctgtggcggtgcgtgtgtgtggtgcagcagaggccctgctcatcttccctgtggctggtcatttggtctgtctgttacggtgacagcttggggactggtgacacatcccagcattgacgatggcctgagttgcctttgtcagtggggcagatgcaccatcagcacgagctgcgcaaggtggaagaagccttgcaggaaatgtctttccaagtaactcagcccctcctcgtggcagctgctagttgctcacttatctctccagccctccaaaaagaaaggacagtgtagctttttgaaagaggcttaaatgcattccattggcatctggttgggtgggatctggtttcaatatcaggggaaagacatgcttgacagagcctgtgtcccaggacccggttccctagcagaccctggagctgggatcctggccaagaacttgtttttgttggagagacctaagtgggaagcagagacgggattgggatcttgggaaaattctgttagtggattcagcacctccaggactgcagagggatgggccatgctaaacactggggaggacgctggaggcttggtgtgctccgaccacaaaggtctccccgcacagcctgcgcgagaggtcagcagtgcacgggggacccaggcctgttgctgggtttaaagatgttgtcagtgatagcttgggggccttttagctgatgggtatcttgggtatccccaggaacagcagaggagactcagcctgtcctggttgggaaggaaaggagagcctcaggaggttggacaccatctctggcctcagctgtatttccagtgtgtgtccacagtgccaggagctactgttgaaatctggctctggccatgagaatcttatggcctatttttctgtctagctcatgaaagtgctatgtttcatgtcttttagttcttgtggagaagaactctccccagtgtctactctagatatgtgtgtgcttttacaaaaatagttatgtagaaaggactgatgagtaaaatctggattctcagtaagatgagatttgaggaactatccatccagcctctgactcagaagccattgattcatcgcccttccccagcctacccctagcatgtgcactgagggcctactaggagggggaagacagaggtgaacattccgcccgaaggagctctgctgtgtctggtgggcggatggagatacaagcagcttacgctgtgctttgtggtgggtgcaaaggcaggaaggatgcacagcctattgtgagatccagggagaggtctttaacccagccctggatcaggggacttcctgaaggagataacactgtaggagccatagggacaaaaggcacaggagagggaaagagcttcctatacgggagcttgaggctgaagctgaggagtggaaggagatgagcccatagaggtggttggggaacagagcatgctgggcctttttttttttaagggcagtggggacccagcaagtggcttggatgcggagtgagtgagagcttgggcgttggactctatgtgtgggatgagtttgaggagcagcagcagcatccccctaactcatgcctgtgtcctccctgggcccctgaagcctcccatctgtcctgcttgtcctagttcagctcaccctaattttcctccctccaccttctcttcaggccttgtccttctaactctcataacgagatcgtgtttcctcttagcttagaaacatgctgtggtctttcccatgttaaaaaccctcctcgtttccatgctcattcctggtccccatcttcctccaccccgaagctggttaacagtctttttaaaattattgatctgggggtgcatgcacaggtttgtacatggatatattgcatagcggtgggatttgagcttccaatgtactcaccacccaaataatgaacattgtaccaatgggtaatttgtcagcccctcactccctatccctccgcccctcttttggagtccccagtgtctattatgtccctctgtatatcatacatgcataaactctcacttgtaagttaacacagtctttactccctccctttccattggccactcagccccttttatgccaccagtgacctgcacattgccaagtgcagcggatgctgtccaattctgatatgattggaactctctgcagcacttgacaatgttgaccatttcttcctgaaatcagctttctcaacctccaggacactgcattctgtttgttctcctgtgtccttcctgtccagtcctactgtcttcttgggtttctctttctagtctgcctctgaaaagcctcccccagccctcttctcatgctgtatcccatctgtttggtgaaagttgggatagaatacccctctatactgaggactcccaagccgtagttctccagataggctctccagtcaacctatgtccatagcacctggaccccatggcccagtaagtgactccatccagaaggcccagcagaccttagttctacatcttcttccacaaacccactatgccctcgtgcatttttattggatgttggtggctcagtcatctttctggaatgcccatgccccttcctcctattcattttccacatgtaattaatgagtaggtcttcatgatattaccttctaaacaccactctcacctgtctctttctttctgtccctaccaccaccctattttcttgtgagatgtaaacattcttgctcactgtttagcccacaggaatgctgtatgaactcatgagatctgagttgtattgggttgagtatcttgtgtctttaagtccagtttctggttctctgtttctctgcatgacatgtaggatgtttgctgtttgcattttttaaaatgcttgttaaatgagatatgtgggtatctagtgctttgagctcctctagaaggaatatacctttaaagtgacctgtgagttgtatattgaaagtggtgcagttgatgtctggccaaaacccatcttgtgatgaatcattttgttttactgcaagcctgctgcgtacttagcactgacatgtgatgcgctttgtcccagagcagagttctaagatggtagttagtcatggtactattttggagagagagaatttgaaagtcatttgttctacaccccacgctggaaggctgtctgaatctttggcttttcctccatgtgtttggcatatcttgtttttccttccaattacatctttgggtgtctttcaactacggtgcattttgttcattcagtactctccttttcctaattcatctcattcattcaaggtgaattaggaaatgagagtatttgaattaagttgattttgatttgctgacattcttattgaagagcaaataggacatctggtttgatgaatagctgtgttccagatcattcataatttgcattaagatgttgaattaacaagattgaattaccagtggtgaggatttctggcttggatcttctagcattttgaactctgatcagccggttttcaaactcttttattagggtctgccttagccagggcagtctttgttcttttcattctttaaagatgttaagaaagcactactattactgagtgtaatcttgctgctgaactcagcgattaatatttcacttgcattgtttcttttaacccaagtgccagccctgtgaaagcaagagagatattattcaaagtcgctcgaggacatggttaaagggagcaaagtagtttagacagggttttcacagtaggttggactggtgtttagcttttatcaaagcccttcatttctctagtccaataatgattaagtgcacccattgaccttcggccttcctctgaagtgtggcacatccgacttctctctaggaggaatgagaatacaggcctgcctcttggggtgatttggatgtctggtcctctgtgggctgctccaggaagtcatcatctaaatttgatctagacggaaggtacccgccagggctttcagcgtggcaagatgttaacaaatggcctgttggaaatctcatcgtgtttcggtttatctattaacgaaaaggtgagacccccttggagctgagctttgagtgaggctgtaggtaaatgatgtttatcaaggggtaagaaacatgatgggcaaactcactggggtcaagaagggatggagagagacgttacagtgcaatgagtacattgagcagtttcaccagtgagtgggtgatcttagtgaagaaaagaagccacatttgttggcgttgtatgtgctacattctgtcaagcttagaattctacccgaagttttcagaacaaaatcagtgagaaataattttcagtcccttggtgttctatcaaaataaaactgagcttcaaaagcaacagcttcatgatctggcaggatgggaatgtgtgcaagagaccttgcccagagaatgactgtggatcaaaggtaacaggggtttaacatcaaagaaggcatgggcacctatcacaatgattctaatgtaattagtttgtcatgtaggattaagttactgctgcctgcttacagagtgctctgctctaagacttcagtctgcacaaattaaaattaaattagtctttttagtttgcacacatggataacagaaatttaatgggaatttctcagaactttgataagcaaggggttctacagatatcctcttcatatttactatacatgatttctgagcctcttttgataagagattgattaggtttgataatgaataaaaggaaatctcttagatttgggatctctaggggttttgatggtattttcttgtctgcactagggtctgattgccccttgtatcctcactcatctgtgaaaaggaaaatcatatacagtaggaaaatgaaacatcttaatttaacagcaaattgcaaatcagtttttaatggcactaaaacgaccatttggtctacagtgtgataaatgatagagatctaactacaaaatggaaaaatggcatcaaaacccatctgcagaatctttgccgaaagggagattctttctaggatttggaagagataaatttatttcatcaaggtgcttaaacgttaacatcaaactaattgaagtgtttcagaatgctaaaacttattgaaatttttatggaatctctgctgccaatttctttgtcagaagggaccagaaaccctcactgaccccagataagatagatgtttattgctgcacattctcttcaaatgctttgtctcctcaaaaaggctgtgactgctgcagggcatggagtcctccttccatcacagctgcggctgcctcagatctagccagagaggcagagtagcacggcaggcatgcagtaagtccttgggtttcatttaaggcacggtgttccagtgactatcaaactcttgattgaaaatggagcccctgactatttctgcagaactttagccaaaagggtgaagtgtgcatggattaggaagctctctgcaaaggctgcttcactgagctttaatgagagaatttgaaggagctggctcatagcaaggggcccagtgaggccagaggtcctcatctgccaagggtccaacacctaaaaggcagagaagtctcagggacacactcagggaccctccctgctggcctgtagagtgcctcttgagtgaataagagtaagacaccctttcctcaggacactttattgtcatatgttgggcagctgttgtaatcaatatatagatccatgacagctgtgtacaagtggcacctccttagctatggttctggcaacgtcctggaccgctggccaggccaccatgtgcccactgggctgggtcaggcaaagatgcccaattgcccacgttcacatttggttttgtttacccaacagggatataaaatatgaatttttttctctttgaacttttttatttgtaaagttaattatttaagtaaatgctttggctttaatcacagttattagcataagaaactatttttctagcctagcatcccagtgggaaaagtaggattggtgaattcaaacctttcttcatttatctttggattataataaaataaactatttttaagtaagccacaaaaccagcaagtgtcagtaaaaggtgaaacagaaccaatctactaattatttcattgcaaggctttaggatcgccacaagtgccattcctgttctttctgttctactttagatgaaaacacccaagggctcgtactagaagtaactggtcttcaaacttgtggagaactggatttttattttcagcttcgggcagggtttagagtgatgaaagtaattggggtttattcattctttgggttcatgatcaatttatgcaggttttcaattgtaaaaataccaattgggtctttaaaagtcctttatatacttcagaatttggttgtaaacttggcttgaaattcaacgcaaggcaggggttcaaaagggctgagtttctgaattctccaaagaacttcatttcgggttggatttacttgtaagacgatgccagatgtagcagccttcttcagaggaagggttcagactgctttgtgtagtgcttttgaaagtgtgctttttggggattcagtttctttacatgtttacaacattattgggggcagtgatgatgcaggtctcaggtcatcacagggattcccagagttcagtggatttgagatgtggatctgtctttttggacccccagcttgggccacctggtacagttcacagcccaacccccgtggggtttcccaccctgagctcattggaagacactggccttgcttagaaattagaccaatggccgggtgtggtggtgcagacctgtagtcctggctacctgggaggctgaggcgggaggatcacttgagctatgaatgcgccactgcactccagcctgggagacagagcaagaccctgtctcaaaaaaaaaaatgaaaaagaaattagaccaatgttaacatcgaagatccagaactccagtcagacttataattttatttgtaatcaaaatttctggataggatttctagaaaatcccaacctgtggagttgtttgatacaatttgataagaggcctggactgttgtggacttctccctcaagctaataaactgttccaaaactgaagaaaggaggcttttgtttgagaaccctgatagcattccgggtgttggagcctgacactcccaactaggatagaatagcccagcagcttgctagcttgctccttctccagcctcctctcccttctcctccccacctcctctttttatgcacacattccctccttcttctttttctttattcaaccaagttaattgccaggcttgatcatggaataaatgaatgactagaaaatcatctcagtttttaaaattcaacaaaaaatttctcaacaactaagtgtccaagaagacagaatctacatacaaggacctcttagtcttgtgcaaacacaaaactgtcttgcactcgcatgctgggctgtgtcacctgtgtatttgtggatatgtgagccacctggcgctaatacatatacttgttaatagtgagatatatgcatacaaagtgcttgccaccaagcgacagtatgcctgcttactcaccctgcatctatagaaccattgagtgctactcaaaatcccaggaactgttgactttgcactgaaataaacgaataaacaaacctgtgcctaagtagagatcagttttccaacttctagcttttttattccattagaactaaattatcgagggccagatatctctaaaacctctgatggattttgtaattttttttctttacttctttagtgaagtagttccattttgttgctaaaagccgtctttgaaagagggttcaaattccacattgtgtcaagcgagcatccatgtgccaggtatagtgccagatgctttacctgcatcaggtcctatagtcctgtaaggtgggagttattatccccactccttatgcatagagaaacaagctcagaagtgtagagatggcccaaggtcacttgttcttgaccagcctccaagctctctcctctcctccacacccaatgtgacaaggaacctgctagacagagggcaagcaagtgagcatggttccagccagtcactgtctactgggcactcgctgtgtgccaggcactgggccaggctctgggagccaaaggtaaataaggcatggtctctgcttggccttcaaggtccccacctaccttgtctgactttcccctggctgttccccagttcccatcctggactcctgccaggccgtgtacctctacagatgtgtcactgtctgctggaccacaagacaaaggcatggaggcaggacatgagggatgttttgttcagggagccatggaaggttcctgcaattggaccctgcgtcagaacatgttagcaagttagcttgtggccaggtggaaaaaggcattacttgacttatgaaggaggctttgggctttatctggaggtcactgtgagcccttggaagcataaccaatatttcctcaggccttggcagccaacagccccaaataatgtcctgaaaactttaatgcctcaactctgctgactcttggaacccacttcataatggcaggacccttgcccatctcccccgccagtcatgcctctgacagttatttctgggggcccacagggacgcttcctgtttgcatccacagccctctcatgatctgggcctcctagcaaattcagagccaaatcccagtgtgtctgcaagttcagtatatgtcaggggccatgggtcagctccctggggcaacaggaaatggtgcttaaagctcaggattctggaggaacagggcaggactggggtctgcgcccccagggaccaggcccgaaccctggcatgaatgaaaactaaatattagaagctcgttgattctgtgtatatgtgtgtgtggtgggagaggagttgaaagagactgtggctgtcatgtcggccttagctggagcacccttggactaaaatctctgaacctaggggcaatatgacaaggttggtggtattgtaggtggcaggttgtgggactagaaatgggaggtagggaaactgttaggaggctattgcagaagttctaggagaaaagaacagtaatctaaacagtggggattcgaatggggataggtaaaagaatcaggaatgtcttaaccaatggaagccgattctgagggttctagttcaggtaatgaggacagaagagatgccagtgactggggaaaagggcgaagatcaggctttgcagaggggatgagttcaatttatccatattgacatctgagctttaatgcggattccagtaaatatccctaccaggcaccgaccctaagggctggagatggagatctgggcgttgtcagcacatttcaaaagactctgacctgtgcctccagccctggccccatccagcccattgctctcactgcagccagattgatctctctaaaagtatctttttatatacctgttgccttcctgggcaaagattttccgtgactctgactttctggagtgtgatggtctaaaccctcagccaccaatgttgggctgccctcagccagtccctgcgtttctgggtcaggactgctttggtcacaagtgacagggattccactcatactagcctaggtcacaagaggagtttgccggctgatataatcagctggggcttagggatgtgcatgctagaggtcactttccatctcttgctcctcttctctttgcttgctggtttgattctctcagcactttgttccacctggcaggaaacacgggggtgaggcaacttccatgcttcaagcctcatgatgttttcactgaagtgggatagagtatcttcttcgctcagttccatctagaaaaatcccaggaagaactctgattggaccaacttggtacaggcacccttcctgggccagctggccacggtcaggaaggtggggtcagaacgcatgcttggggtgaagatgtggctttcctggggagtggcggggttgctggatgtatataaaatacataacataccattgttgtgccttcgcatgctttagccctctcctcctagccagaaccttccagccaaggccagctctttttggcttcaaaagacaaaaggaaatgtcccttagctcaaatgtcccaaatactcttcctatccctgtccttaagttttatcctcacggtccaaccctgattctccagacatctgtcctcctcccatctccatgaagctgtttccaggacactcctggccacagtgacttttctcatttttccacagggaaaaccaaaggacaaagaggtggggtaacttgccccggctgccaagctgggagggacagggagcagatggcaggacaagcagtatgtttctagagcttggaatgtgttaaactgttctttgtgtgtcatcttccaaggagactgtgccttccttgagggcagggaccagtgcatccatcccccactggcagccagatgctggcaactgtttggtcatgacaatggatggccatggcctctgcagcctctttccaccctcagttcctaggcctggggatagagtctttcctgccgatttgcacaatttaaaatcctgtgggaactaggaagcctttcttacaggcagggatagagtaaaataattattaattataatgcagatgccacctttttcaaattctgctgtctcctacatgcgaatgagtgtccccagcctcctctgggggtttctgacagatcgcccaagtgcacccctccccgtcccgtcttcagaactcgaatctcctgtgcctccagggtccattgttgtgcctgatttgaaatgcaggctctgatgctcacgcaggagacccctagctccattcctcccatgccagaatggcttttcttccttggagagctgctgaaatgtgggtttctgcattaatcgaggttcccagcacgtctgcagacctggctctgtgcctccagaatgtgttttccaatcatctcctgggccctggctattccagcctgtcaagactggacttgctggggccacgtggggctgcagagatgtgctttccagattcagagtgatatttatgatttcttggagccagtcccagcaagctaggaccagtcccctccgtgtaaccgagcagaggtgctgggccaggcgggcagtgagtgaggattgaagaaacttgtggcaggcagcctccaggcacttggcaggctccaggctgctttccttaactgcttgcctcccaaacacctgcctccctcagcctcctgcatcagaccttgaacatgaagtctgcttattttatagaaacagattagtagcatcctgatatgagtctattatgacaattaacagtgctgactacatgccagggatgttcttagtgctttccagatgttgacccatttaatccttattaacacctcatgacatattatcatgcccattttgtagatgaggagcctgaggctctacagagttaatgtcacctgcccgaggccacacagcaggtgcgtggcacagtggcctgtggattgaggtggctcttaaacaccttgctgtaacactttttgatatcagggctattaaaatgctggggataggaaagatgtagctagactcagattttcatgaaaagcatcaattatagtaacttattaattttctaactatcctgcaatttggttggacaagagggggcctcatccaccccctacatttgccctgtttgtcactttacctacatctcatctcagaccccaatgctaatgactgggacaaacatgaacatttcgaagtggggccatgtgagtgggtaaccatgtacagtagttactaactctccttcccttcttttctttctttcctgctgaagttatacttattatttatgtacatagtaccttttcttactctccctgtgcctctaaaaggactactcaaatttcctgaagcacaagatatgagccctgcctgcatgtttgtctcattgtggtctcatcatggttgtaggtagatttggtccctagaatgaagctggcaagacctgtgggcacaatgttcttgatccaaagcccagcagcatcccttcctctggaggctgagcccacagctgctgtgtggggtgagctcaggatggctggagcctctgctgaggcagcgaaaaccaactttgtctctctgactcctcctctgctgccacctccttcccctcaagacaaaacactagaaaaacaaggaatcagatgccttctaggaatgaggttcaaactcaagggcaaatgttagagaatttgatcttggagagaaagttgtattactagataatgtgatcattattaacgtttattgcatttatgtgagcgaatgattattcacaagttgtcttgctctctctgcctggcagttgaagaaaacatatagtccagagggccagagtcctccattcacactcaatgtcaactttctaagagagcacagccgtgttactcattctgggtgccacaatgcctgctgtcccttgctgacagagggattgaggatgatttgagtccagcctgtctttaaagcacattgagttcagaagatgtctacaaatgtgagagagttggaaatgagctaggagaaaaggctatgggaactggggtggatttgaacaatgtccttgtgtcttctttattttcccaagattggaagcagttagaatgcctaggacctgacaccttattctctgtcttctcatgcatcattctgggctatgcaaataataacaatgcatgcgaatattatgtgagcgaatacagtactaatctcttctgcccttgccttagaaaggtagtctaaggaagggcaggaggattcttagggcattcgtagaataaattagaacttagatcaattagaggacacagatagccacacagaggggatgaaacctttgctgaaggcagaggctctgttgtgttaccttaaattgctagaatttgcttcatagccaagttgcaaaaactagcctatgccatgaatagaatgcttgcattccagggaaaaaatccaaattcttcccacgtggcagcagaaaagcgaaaggatacactgtcaccagtaattcaggttgtatgtgggaagcctacagaattccgccaaatgttgcagacatgcatgaccagtgctatgaagcaggaatctcatttctggtccccaagaagcacagatatcaatcacaatgttctcagaaatacagatggatacattttgccacaatttgttatatggtcacctctcactaacctgtggggtttacagtccatcaaagtacttatctaaagtggcaaaatcacagttggggagatcaagatctcataaaatacaggcagctgggaaaaataattgcattaatttatgtgacgaaggcagtagtgaaagttctagaaggtttccactcccaaaataaccactgtgtcatcatgaggtggccatatggggtgatccttttgaattgctttcttcagttgtctgggagacattgtccacatcatctgctaaggcagaggctcccagcagcaaacctggctctctgcagtgtattcgagccagccctcactggctggaaatggaaaaccttttgcaattgcttgttcactctgggtctccctctctccctcctttcctctcattttcctccctctctctttccctccttcccttttaaaatacaagtctaggcagttgtgtaaccttcaaacttttcataaaatatgcaagagcttaaaggcatagtttttgaagtctggtctttcatcccaaattatttgagagcgtcaatcttaatatcttcatttctctctctctaggtactttcctgtaataccctacctcctatagtaccctgtaggattcactctctggagtctacagggggaaagagcaataatttaggattttcctgttcttctcttaggaattaggacagaagtaacaagatagctgattttatattttttgtaaccagtttaaaagcattatctcaaaacctggaataaaagattgatgcatataaagtgctaaaaagaataataacccttgctgttatgagcagggctgagaaaggagccggggagagggagaggtggctgagtgttaggacatcagggaggaaggaaaatgcaaagataactgtggaaatagcttcttggatataagcaaataaattttcaacaaagaactgtgcaagacctgctgtatattttcagatctccacattttcagaggtcagaccaagaagtgggcccagggtgcagcacaagggatttaggctaagcctgcagactgcctgtcagggtgactcaatgggggtcaggtcacaatatgggttaggatttagttcagctgccagtgacgggaacacccacaaatcacaggcttccataaggtagatcacctagaagacctggaggctggcggtccagggctggtgtgttggccccacagtcatcagggacccagcctcaatcagaccttccacccagccaattccttggtgtggctccccactcaccgtccagaatggtgttgagtctccagccatcacatctcagctccttggtcagaactgagtcctgtggccacatctccctggaagagacagagattgaggaatgtggtcttttggctgaatggcagcatgcccagcgaaaacagggcttcagatgacttgagggcgaaagggagaatctccataactaagcaaagtcagcatcttttctcatcctagggtatttgtttactgaatacccagtgcctgatgttttcaggcattgctcaagggcagtggggaaaaagtagatggatttctgttttcatgaaacttacagtctagtgggaggcaagtcagacaataaacgaacaataaagcgtggccgagttgacaaactgcattccacactcaagctgtcttcagatgaagccgtacaatattaatgatgggagcggacggtgtcaaacatcaccgtctaaagcctgcaggcaccctggacagccagcgtccgcatctctttgatgcaaattccatccttcagacactcccaagtgagtgtctgcccagtgagaaggagggagaagtaaacaaatagtaagccagagccccatctaaaaatcagcccctgagttactcttcagctagcgctccttatgggccaatgtgcaaagaagcactagaggatgagaatctagccctaaaattccagggctttgttgttgttgttgttgttgttgttgtttggtggaaaaggatttggagctatttctttgctgacgtgcaaagtagtgtaataggccgggcatggtggctcacgcctgtaatcccagcactttgagaggccaaggtgggtggatcgcttgagcccaggagtttgagaccagcctgggcaacatggcaaaaccctatctctaaaaaaaaaattacaaaaattagccaggcatggtggcacgtgcctgttgtagtcctagctaccagggaggctgaggtgggaggatcgcttgagcccaggaggttgcttgagcccaggaggccaaggctacagtgagctgagattgcaccactgtgctctagcacagtgagaccctgtctcaaaaaaaataaaataaataaacatttttaaaaagtagtgtgataagtaataattttgtggctcccatgggggtttgaaggacaagctgggaaacttgggagaaccacagggacacagcctttttctgttcatgggactttcagcaagcggttcctggtcagcatgcctggtcttgctgggaactgggcaggtttccaggttcagttcacatgttgtaagcaggcatggttctaaattaaacctggagccaccgctgtccacccagcactcactgccatggccactgtgcaacgccgcagaccactgattctcaaacatctgaggtgaaggaccagggttgtctttttaaatttgtttcactttcctatctgtcataaaaatgaaatattagaaatgtgaaataaagacagacttctgttattagattcaagagacataaaattgctctgtccatttgccctaaaagtttctaaagactgactcaattcctgaacatgagtttaccaacagcaaagaagttagggccatcgctaccagcccaaggactgtgctttgggcctcactgcccagaggcccaggatctaaggccagaagggaacagctgccctccccacgctatgtcaggacagtcctgaaggagaatgaggaagctctccgctgggaagagagcaggctgggctgctgtgtcttgctgtctgtacatctctctggcccttcctgcccagctgcttgagtagactggtaaaaggaacctcttggtggactctcctaccatagtccccatgtgcaggtgaaaattttattacatggttgcggccggagaaacgaaaggtcacagctctttgtaatcattatccaggctcccctacctgaatgcaggctgtagcataactggttggattagtgaagcaggcggtcacctccagctggcatggcctggtgtggcctgggcagggtgagctcatggttgactctgtgttgcagttctccaaggagaggcacatcatggacaggacccccgagaaactgaagaaggagctggaggaggagctgctcctgagcagcgaggacctgcgcagccatgcctggtaccacggccgcatcccccgacaggtacctggtcttgtcccttccagagcatacacggctgctctcaggcaatgtacagattgatgacccgcagggtcccactccgaggccacatgggcggaagcacctgtgtaaccaaaaacaaatactctaaaaatgacttcatttagacccttctctaagaagaccttgggaagagctgaggtcaagaacccaaagcacacatccacatgttcaggaagtgaagggacagccagcgctcctggggtctgcaagcacagcgttgtgggaggcagcagccacagagtcagtaaccggaagaactaggagggcgggctgtggcccaggtaattgaactcttggccagctgccagcagcctcagaccatttgcagcccctccttctcaaggcagtggcttagcttcgggaggagagagggcaggtggcccagatcaacaaggctgcctctgccccattgagctggcagttattcacactctccatcacttccctactggatcctgtgacccagaggtgggaaaaaaggggaattaaacccatgaccacagactcatggcccagaatatactttgtgatcgtcatttgggtgattgccataaataatgttttttcatttaatactgtaaaaattgaaaaatagagtaagtctgcagaattgaggcatagaatttcccttgggtttttattgtaaacctgatctggccaatcattaaccaaggacaacatgacaggaagtgtgtggacaggggctggggggaagggcatcatgtcgtaagttttttttcttttttttgagacagagtcttactctatcacccaggctggagtgcaatagcacaatctcagctcactgcaacctctacctcctgggttcaagcgattctcctgcctcagcctctctggtagctgggattacaggtgtccaccaccatgccctgctaacttttatatttttagtagagacggggtttcaccatgttggccaggctggtctcgaactcctgccctcaagtgatccacccacctcagcctcccaaagtgctgggattacaggcatgagtcactgtgcccaggcttttttttttttttttttttttttaatgtagtagatttcttggcacaatcaaataaataattattattctgactttgtttttttaagtttaaaattgattgtagaaaacatagatagcaaaaagaaggaaattaaactcttatccataattctcctcataattctcctggggataaccacgatgaatacttttgtgtacatacatcctcccgggctttttgaaatcaagtatgagattgtactacatatacttttttggtagcccattctactcacttactatgtcctgggaattttcacccactgtagaatattcttctgcaccagcctacattgtatgtctgtccacggtatgcatgcactacaatttactggacacatagggtgtttctaatactctgaccaatatcctttaagattgctgtgttcatacctacaattattttcacaggctcaattctaagaagtggcatttctatgtgaaaacatttttaaggcaaagatgcaattttaaagtaaccatggtagcctactattttgacctaacagaagtatactgttgatcaaatgttggaatgttccagaaaaattgtcagaattataaaaccgatactatcaccaccgtccgtctccttatcatggtcattacattcgtttactacttgcatgagtattaattttcagtgataaatcgttccaaactggataactgaacactataaccataaccgtaataacgagttattgctaacattttagccccttaaatctttgtagccattctataggtaatattatcatttgtgtttttcagatgatataagtgagccacaaggagattatgtaatttgtccagagtgatacagctgagccaggatgcaaacccaggtggtcaggctacaggaacagccaggctgcaccacattataaattctccagttgctgtaagcagcagcatcatgcttgttaactatttttgagcatccactgtgttccagtgcttacatatgttatgtatacaaatacataaccctgatagtaactgtaagatgagggaccccagcctgactttgttctaggccttctagccagtaattggtgtgtccagaatctataccccagtcctgcatgtggactcctcctccccactggccaggcctggagaggggcatcttaggagagggcccctaggatgacttctagacaccaacaaatacccttctttctcttcactccacttgttggggagggaaaatcaggcctgccaggcacacattttctcatttcttatttcctgtttcattacatcattcaggtctgtataaacgtcatgttcttgtgacacctccccaaccaccctattttactggacagccctcatcccctccccggcacttcctgcctcctttcctggtttacttcttccctgaccttacagctgacataccatagccactggttatttatcctcactaaaacagaagctccccaccaaaaacaggagctccataaggtgggctcttgtgtgccactgtcaccactgcatcccctgagcctgcagtggtgcttggcacgagtaggtggtcagtgaatagttcttgaatgaatgattggctcttctatgaatttgatctttgaaaaactaaagagctgacccaagaagagacatagtagcattgtcttctgttggcccagagaagtgggtagccataagcttttagaaggaatgtgaatttgcctttcctactcctcactcacctttttgtcccaaaggtgtctgaaaaccttgtgcagcgagatggtgacttcctagttcgtgactctctgtccagccctgggaactttgtcctgacctgtcagtggaagaacctcgctcagcacttcaaaatcaaccggacagttctgcgactcagcgaggcctacagccgcgtgcagtaccagttcgagatggagagcttcgactccatccccggcctggtgcgctgctacgtgggcaaccgccggcccatctcccagcagagtggcgccatcatcttccagcccatcaacaggacggtgcctctgcggtgcctggaggagcattatggcacctccccaggccaggcccgggagggcagcctcaccaagggaaggccggatgtggccaagaggctgagcctcaccatgggtggcgtccaggcccgagagcagaatttgcccaggggaaacctcctcaggtaggtcagggcctcctctgcaggactatgaggggcgccggggtgcccaaggttagttaggcaggtgaagaattcatcatggaacaaagaaataaaagatgttaataggaatgccgactgttcgcagaatagctgtcacgaggcagtgaacgattagctcccagctgagcagtgtcagcaatgaatggtacaggagctgaggaagaatttcggggggtgctgatggggataccttgtgaagggggtagacttaggctggtctgatggctgggggaaatttggatagatgctgcaaagggctgggggtgttccaggtgggaggcatagcatgggcataagtgtggggacagaaaatggtatgaagagcttgaagtgaatgtgctggtagggctggaacaaagggtctgtgcaagggacccgtagcagtgggcttagggagatagccccagccagatcatgggggccttaatgccaggtgcagggctttaagggagctgtacagactcagcatagcgaacacggtgtcctaagaatagaaatggacagtgatgtaccgggggtgaggagagagacaggaacaggaaacccagttagtgagtcatggagggccccggctgcaggagtggagtggagggagagtcaagagatgtaggagcctggcctcccaggactcttcttcacgtggtagagtcagaggagggcacattggagaccacaggagtgaccaggagggaggggactttggaggataaaacacactttttcatctgagctggaagactatgggcttgttgagtgccacagtccagcagcagttttggggtccaggaggggagttagagctgaaaacttaaattagggcttggtccacctggaaagggtggttcacttggtgagaacagatgagatttctaagataggagatgcagagaacatggggtctgtagtctgaatctcagggaatgggggaagagaaagattcagggcacttggtggaaaatcaaggcttcaaaacctcactgatcctaagcacccagctgtcaaatgtcagcgacgttggcctgcatttgtatagggcccgtctttcacagagctcagagtctttgtgcatattatctaaaagcactgggaaaggaaaggagggaaaaggcaggcatcggggacatagatccagtccagcccctcagtcacacagcagccctgacccggctcccagcttctaatcttatgcacgtaaaccaacatattttattctactcactggtttttttttttggcgggggggtccatgaggaaatgtcataaactgtcatttctatactgcaaaacttagggaggaaaatacaggactctgtgtggaatgtaaatgacagctgtgtgctgcctggaggctccggcacatgctagtcagcatctggctggggacccagtagccaggcacaaatgccggctccacattgggcaacttttcaaccatgggcaagcgacttgaccttcctgggcctcaccttcttcatctagaaagatggagcttgtgaggtgtacatgatttaatatatgcaaagtgctcagaacagtgcaggcacagaggaggtgctagggaagtgctcatgataattattatctggaggagagtagaatgtcagactcagacccagcacagtggctcacagctgtaatcccagcactttgggaggctaaggtgggcagattgcctgagcttcagagttcaagaccagcttgggcaacatggcacaaccctgtctctacaaaaaatatgaaaattaatataaggagctcaaacaactctataggaaaaactctaataatctgatttttaaaatgggcaaaagatttgctcttttgagaaatgagtatttctcaaaagaagacatacaaatgggctgggcatggtggctcacgcctgtaatcccaacaatttgggaggccgaggcaggtggattacctgagttcaggagttcaagaccaacctggccaacatggcaaaaccccatctctactaaaaatgcaaaaattaaccaggtgtggtggtgcacgcctgtagtcccagctactagggaggctaaggcaggagaattgcttgaacccaggaggcagtgagccgagatcatgccactgcagtggcaaacaggcatatgaaaaggtgttcaacatgattggtcatcagagaaatgcaaatcaaaactataatggatatcaccttaccccagttaaaaaggcctatatccaaaagacaggtaataacaaatgctggtgaggattgtggggaaaagggaaccctcctacactgttgaggggaatgtaaattagtacaaccactatggagaacagtttcgaggttcctcagaaaactaaaaattgagctactatatgatccagcaatcccactgctgggtatatacccagaagagtggaaatcagtatatcaaagagatacctgcaccaatgtttgttgcagcactgtttacaatagctaagatttggaagcagcctaagtgtccatcaacagctgaatagataagggaaatgtgtatatacacagtggagtactattcagccataaaaacaatgagatcctgttatttgcaaccacgtggatggaattggagatcattatgttaagtgaaataagccagacacagaaagacaaatgttctcacttatttgtgggatcaaaaagtcaaaacaactgaattcttggacacagagagtagaaggatggttagcagagcctgggaagggtagtagtgggtggggagtaggggatgggagggaggtggggatggttaatgggtacaaaaaatttagaaagaatgaataagacttatttgataacacaatagggtgactgtagtcaaaacaattatatattttaaaataaagagtgtaattggactgtttgtaactcaaaggataaatgctagagggcatggataccccattctccatgatacacttatttcacattgcatgcctgtatcaaaacatctcatgtaccccataaatatatacacctactatgtatgcacaaaattttttaaatataaaaattagctgggcatggtggtgtgtgcctgtggtcccagctactcgagaggctgaggtgggaggattgcttgagcctgggaggttgaagctgcagtgagccatgaccatgccacttcactccagcctgggcaacagagcgagagcctgtctcaaaacaaacaaaaaaactcagggcaattgcaaggagggaggcaagacctgatatttagaaatcctccttttcatagtaataggattggacttgagatgccttacagtgttagaaggggtaccttttcttctgtttcctttgggaaggataggctgctgaatggtcgaagcagggaattaatgtcatgcacagagtgggagtgtattcggcaggataacagaaccactgctgcagggaaggcctcctagttggccctgaatgatcctggtttaaaaactttttaagataagaaatgaaaaaaagactaagtctcttaagtcaacaagtcaggcctaatagagccacttttctgtttgccctttggaatgcagatcctcctagaacttgtcaccactttgtacacgcagcacgcccagaaatgtttaagtgggaggaggggaaaagatggctcatggcctgctgccctgccccagtgtccttcagtggctcccttatgcagctctggccaggtgccacctgccctgacgtcgggcctgctagttggctggctggtggcctgccctgggcgaaggtgtgtgctcacaggcaggttgcattccacaccctgccgttctggcccctggagtccagccgcagtggtcactgcttaaatatcacttctcgggagatatttccttttgtaatttgccctcggtcttgtcttatcttcgaaaggttgctggaatttctctgttccttggagtttgggggttttttgatttgttttttctttggtgcttgtaaaggtaggaaagaacttcgtgatttctgtaacataacaatgttttatgcttatgggaaggccaattaaagttcataacaacttggctggtgcagtgcctctgtctctagctagggagattctggtgcttggtgctggagaaattcccagtctgaattggaaagggacagaaggaataacagcgagtgtgttgaaagttaccttccaccttttccttgtgtggttacacagtgtgcctcccaactgctgcttggtgaccgtgccggtgccttttcccagctcagcaggaggaggctgtgtgggggtccccccagagcagccaggaggttggggatggcagcctccccaggcagtcctgcaggttatttgggggatgctgagatttgcaccaaaatggaagtttccccacagcttccttcctaactgcaacactatggagcatgtggaaaatgcatgttagttaggcaagccattccctctgggcctgtaagtaattttaggctctgttaaaagtacacattccagttcatcagattttcccgggagtatcgtaaaacttttaccctactctgttcaacaggatggaacagcccagaggaggcatcctaggactcagctgctgcattggtcatggggacagggggatggagtacacaacacagtcatatattaatcgtcccatcagtaatttgtttctccagcggtcattcctttacttttagggtatgctgtagcactctcgttctgagcagttttctttttttttgtttttgtttaagttcccatggcattgcctaaaagttttattttacacgttagtaacacatttccatcctatgtgtcttttacttcagaaacaaagaaaagagtggtagccagcccgcctgcctggatcacatgcaggacagaagagccttgtccctcaaagcccaccagtcagagagctacctgccgattggtatgtttcggggaattttcagggagaacgtcagtgttaccctggtttccttcaggctgttaccctgccccatctagttgtctcattcgaaaacgacacaaggcctcaggcctgcagcctggaggggaatgggtttgcagaattatatccggcggcgaagcactgagctagacaccgtatgccagcttttaggcctcgtagcaagccttcagggtaggcatgattattgccatttcacagctgaggaaactgaggcacagataggttaagtaacttgtccagaatcacccagcatttgaacccaggttttctgattcaagcccatttaaaaactggtagtcttcatgacaaatgagcctactcccttttcccgggtgggcgggtggatcctggggcttttggcagaacagctgtccaggccaactccccttcctctccattctgcttccaaggctggaagagtgataaggtatggggtatggggagacctactaagcagttacattagtaagacagggggttgttttcattattttcataactgactttccctgggaccacaaagggattttcctaatgcccctgcgtaaactacctccatgtaggttaccccagtgtctcttttcccttccctgtctccagctctcctttggaagctggctgggatccaccctttgagagtggcattttaggtggctaacgacttctgtttcttagggcaagattacattattcatgccctcctcgctcatatattttatcattctgactgtcccagccttctatgaccatacaacatttgtagcccaggtgtcagcagtccccgggatttctatttgcacccaggagtgtgggatggggcaagcccagcccagccctcacgatgctgtagactccctgagattgggcgtgggacagtcacactgaattttcttttggaaatgaaaatgaaaattgaagcccaagggcatgaatggagggctggggagctgccactctggttttgtttgttttatattctccacacagatgagctttctctgaccttttcttatcccccacaggctgcaagctgccacctcagtcctcgggtgtggacacaagcccctgcccaaactcacctgtgttcaggacgggaagcgagcctgccctgagcccagcagtggttcggagggtctcctcagacgccagggctggggaggcgctgaggggatcagacagtcaactgtgccctaagcccccgcctaagccctgcaaggtgccgttcctcaaggttccctcgtctccctctgcctggctcaactcagaggccaactactgtgaactgaacccagcgtttgccacaggctgcggcaggggagcaaagctaccctcatgtgcccagggaagccacacagaactgctcacagccaagcagaatgaggcgccaggtccccggaactctggcgtcaactacttgatccttgatgatgatgacagggaaagaccttgggaacctgcggcagctcagatggagaaggggcagtgggacaagggcgagtttgtgacgcccctcctggagactgtctcctccttcaggcccaacgagtttgagtcaaagttccttccccctgagaataagcccctggaaacagcaatgttgaaacgtgcaaaagaactgttcaccaacaacgaccccaaggtcatcgcccagcacgtactgagcatggactgcagggtaagcgctgggggtcctggtgctcctctggcttttcaaggtttggtaagagctaggggtcccggtgctcctctggcttttgtaggtttggaaggaggggatccatctggcctcactctgcctcacccattaaatgctttgcccataggaaagtctgaagataacaccagcatgggaatttatttaaggggtgggaaccacaagctgggacaacctttgcccaagcaggaagcttataaaattcatctcagacagagggatggcaggctgctgccgggggtgggggccgccctcttctcccacccacccctgctggcatcagcagctgcaacagaatcctcctcacacctggtgcttatttataaactacccccttgcctcagctccatcagaattggtaaagccaaagctacaggagagtagattgtagatgaaaatgtagtttctggagtagcagaccttggttatttttattacattatacttatgcattacatatttattttattactaaaatgatctttagtataaacatctttaaagctaccttgatttttaaaataatccttcctcaatttagaaaaattctaaaatggcggagcatgttggctcaagcctgtaatcccagcacttggggaggcctaggcggtggatcacctgaggtcaggagttcaagaccagcctgaggcatggagaaaccccgtctctactaaaaatacaaaattagctgggcttgatggtacacgcctgtaatcccagctactctggaagctgaggcaggagaattgcttgaacctgggaggcggaggttgtggtgagctgagattgcaccatcacactccagcgtggacaacaagagcacaactctgtctcaaaaaaaaaaaaaaaattctaaaatacagattaaaagataaaaccacacaaatccagtttcctggagatcaccattgtcagcatttggtttacgcaaaaacattattattttctctgtaaatggatacatgtaaataattgcatgtgtaatatctgtttgccacaggtctgtacacactattccaaaccctgaacctttcattgacaaacatgactgtctttccatgtgattaaatatttacattgtcacctttttttttttttctgagacagggtctcactctgtcacccaggctggaatgcagaggtgcgttcacagctcatggcagcctttgcctcccaggctcaagtgatcctcccacctcagcctcctgagtagctgggaccacaggcgcatgccaccacacctggctaactctttgtattttttgtagagatagggttttgccatgttgctcaggctggtcttgaactcctgagctcaagtgatctgcctgccttggcctctcaaagtgctgggatcacaggtgtgagtcaccgcacccggcccatcaccatttttttgtaggaaacgtttattttagatgtaagtgacttttgttcataggtggtcccaaagcaacctcatccttaagagagattaagtcactttttcagatccgtcgggattcgttttaggaccttcagtggctagcaaaatccacagaagcttgcattccttatataaaatggaatagtatttgcatataacctatgcaatcctcctgtagattttaaatcatctctagattacttacaacacctaatacaacgtatatgctttgtaaatagctattatactgcattatttagggaataatggcaaggaaaaaagtctacatgtttcataccaatgcagctttttttttttttttcctgaatatttttgatccttggttggttgaatctactgttgcagaagccacggataaggagggctgactgtattctagacaccagatgttgtctcaggcgatggtgggctcggtccatcttttcaatataaagaggctggttcctgggcatttgaagcccttttttatttgtagctcagtgaagtcaattagcttcagacgtcagggcttatttaggaactgggttttccttcctatgtgttgaatcatggcaagaagtccagtctcagaacactcctgcagggagtgccaaagttgatggagggctccccaaaacaggcttgaggaactttaggcagctgctgaccatcctggagtaaacaagacccttgctgacaacagaacttgagggatgactcagaaaccagagtaactcattgcccaggcctgggaggtggggctgagggtggacttctgctgagcaggccttgagaagagagccagggctgcactggaagaacaagggcctgctgtacttttggccagatggcctcgggcagtgctcacaggtagtcacgcaatttgcgaagttatccggacctcactttaaagcgagcttaacctgtttgggaggtaggaggattgaggatttctgttctagtcagtcaggcacattgggccctgaatctgagagcagaaccatgtcagtgggccaggagggagactctggcctggtatgaacctgcgtgggttctccatagaggaagctcctcgtagaaacaggcctgggtttacagagcagcccgattcccaggggaatgaatccttcctgtggccctgggcagggcttaatgatcctctaggtggaggagagatgcctgcctgcccgcccttggcaggaggcctgggacctgcccactacctttggtagccatgaaactagaccccaaggatgttcccaactgaagaatgcagtctccctggcttgctgtggtgcattttgtcctcctagtggggcctcactctcatgtctgcctgcaggcacccctggacaaggggctggatggggtccccaggcagcgagcaggagctagcctggactctgcccacccagccccagggcagggctatgttgaaacttccttcttccctgtctctggagtctaccaccatttccatgttatcttcctggaaccactgacttccaagcgggcacaatcagcatctctaagagggaaatacaacaagacctgttgtttcctatcccaagtgcagtggcagcccagacagggccacccagaagctgagagcaggctctggctagcatctgggccccgcgtgcttgttcccagccatgtgggcagatgcccagataggccatcaggacagtgggtggtcctaagagccctccaggctccctgtcctgctgtgtccatgcccccaccccccaagggcctagttaggagccactgagcccctcccaccgtgtgcaagatctttgcctatagctagaagtgaggaccagtagtgaagcacttggcccgactgagcctgaatcctgcctctgccacatcagctgaacagcctccccttctgtgcctgtctgtaaggaatacagctacccaggtggtcagcgaggactaaatgagataataatatattaaaagcccagggcaccttgcctagcccacagtgagcactaagtgtttatccgtgttatatattcagctttgactgagcgcctactgtgccagggcagcttgtggtctctgctcttggagcacctgctatcaggtgggggtgggctggggagggacagtgatgcaggaacttgggccacaacccaggtgggaaacgccctgcaggggaaggcacaggagctgtggggcctctgggcagggccttgaacagggagttgggtgtggagatggggcagagatgtccaagatgagtttggaaggctgcatctttggcccgatgaacaccaaaagcatcttgcagacggcaggcaacgcacatgcacagacacttagttgtcaaaacccatggagagaggggttggtttacagcagattcattctgtgtgggtggaagaagatggggttaggggtggggtgtgggagggcttcataggtcttttctaagtctctacttctgggctcataccagtttcttgccttcaaggcactttacagttgagttgggtgcagatctgatcctctgtgccaaggggaacagaaccagtgagtggagccaggcaatctcatggcattttagaaaggcccttgcggctgggaggagggctgggccgggaccccatcagggctctcctgggtccgtgcagcagcctccaaggcagtggaagaaggagcagagggtggagtccagagatgcagcagagcagaccagctaagatttggagggcagaaggaagcctcatcgggggtgcttctgccaccctgccctgtggagtcggctcacagtaaatgctctagacatgtttgtccttcctttgtgtcagtgagctgcataaccttgggcatttgtcagggaacctaatgcaggccctgcggtgtgagcttgggatcccctcagccctcaggcaagcaggcgtggctccagggaagtgacccaggcatggcatatatgtgccgacgaaatgcagactggagagcaggggccgccgcccatctgccaggttttccagagcaaacctgaatcaatcacaggccttttaatctcgccacccagagcgtgggggacacccctcagaagtacagggtttgggacctctgacagagggcagctgtctaaatatgcgaggaagcgtgcatggcgtgcgtctgggctgccttgccaaggtcaagttgtaaatctctttcccaagatctggccagaattcttcccctttccacatggctgatgattcaaaacttgtattttcaggtagcttttaggggttctaaagttatctgaatcctttgcaaagtccttgagaaaggtgaacttagcagttatgttagaaaaggggaaactgaggcccagagagcacaggtaggagcacagtaggaattctgcatcctgtcgtggcgtctaccactagagagctcatccacagggtcatcccctcagggttgacagtagttcagccacagaagttacagggtagggttagtaataccacctaaacatccagatgtgttttgatagcctggggtaattaaggttgaggacaagtgtaccagatcaaggagaggaaccgtcccatgcctgccgtgtgttcaggtggctagacttgttgttgcatctgttagttccactcttagtacatcattgtgctgtgaggtgtcattagccgccgtttaatttttcttttgtttttagagacagtgtcttgctctcaccccggcttaagtacagtgacatgatcatagctgactgcaacctcaaactcctgtactcaagtgatcctcctgtcttagtgtcccaagaagctaggactgcaggcacacaccaccatgcctggctaatttttaatttttttgtaaagatggggtctcgctatgttgctcagctggtctcaaactcctgtcctcaagcagtccccccaccttggcctcccaaagcactgggattagaggcataagccaccttgcctggcctattggccccattttagagacacactggctcagttgtaacacttctccatgacattgtaataactaatacctgattctaataaactgagattacatactagaattgagatgggttgagagctgtctgggacaaagattttaagaaaagcctctcaggagaaagaagagtgtttgagagctcaggtttccaatcactgtacacatttttaatagtttccagacgtatagagcatttactgagcccaggagaagcgtaattaagggtaatagcagccagctgtggctgttaagtgagaacatgaatggcaaagcccacagcggagaggctcttggatgagattctgctcttccactgcaggggatcggtcagctccgaacacatgcagccttgctgttggcagcaaaacgtcgcagcaggatccggccggtgtcagacaaaagctcagagaactaaactgttctctggctgggcagaaacacttaacaaatctgtagatctgcagagcagtgtcagcatctcccaccagtctttcttttccccctaagttttatactgtactatgtgtatttaaacaccctaaacatcatataagaacagcattgtcagcagctgcttataaagaaatgtaactcataaagtgtccacgccatcgtagttcagtgtgtttcttctcatatgctgaattcatgatcaggcaagcccacttcctgatccagtgtatttcaactttggctcttgacaggttgctaggatacttggagtctctgaagagatgaggaggaacatgggggtgagctcaggcctggaactcattaccttgcctcacggacaccagctgcgcctggacataattgaaaggtgagcagtgccgtcctctgcacttccgaccctcccagctccttccaggcatcagagcagcaggttttagaacaaagagaggcgcagcaccagcctagccctggggtaacagtacttcagggcgcatggcctacagcgactcttcccagaagcctgagcctgagaattcctggagttgcacacaaagacagcacaactcaggaacaaagaatgtgttcccgtccctgctcctggaggagtggatggagagaatagatggcctgaagccagtgactcaattggcctgtgtgagcaggagtcacagatcctgcagcctggggcagagctggggccccagcacctggagtctcctgggtctcctgcccagcaagctgcccctttgtctctttgggggttaagattgcttgaggaattaggaggagtttgtgggaaaggctgggaagagcagagtctagacagtgttttctttgaggggtggacaaatagggtcagaggttaggggatgacggcactggtccggggcctccgaggcatccctcccctcttctcatgaaaagccagggccctgggcatccattgaaatggaatgtttaggaattagaaagacaccaacaatgaggtatgtttttaagaaaagaagctctagactagatatccatattaccacaaagccagcctttttgacacattttttaaaagttgatttgggcaagactatcttgttaagttttctgtctgtccagcccatgtcctagttgccattactgactgcccatggctttccatgaagttccaggtcacagtgctgtccaggaaagctttctgtggtaacagacgcattctgcactggctattacagtagccaccagccacatgtcactctcgggcacctgaaatgtgactgatgtgattgaaggatgactttttataattagaatttgctgttttcacggtaaaaagccacttctcgggggatggatgtcgctgctttagagtttcctcggctgtacagcagataaaatgactcctatgctgctgctgttttggcctcgcagccgtggatacatcccatagaaaatacccagaatgctgaattgcagccatgtgggaggatggaggtgaagaagtgggccatgcggattttgttcgggaatacccattgcttaagcctctggggaattctaggtcccgcttctgaatttccctgctcttcctgatgagacttttctaggttccagcctctctccgggtgtcccctttttccctcctgccctaggggcctgacctcccggctccactagcttcgttctatcagcagaggtgagctgtgccaccacactttgccatttctcccatgagacatttcagcctgaaaggccgcaggttccaggcctcatgaatctgagccctattttcttagtatcattcagtgtgctgggacaggctgagggtgacaggtttggggcttctctcttggctgttttctgactttccacttcatttgtcttttctcctgactgcctcttggctggggtcttgctccttagcttgtttcttgtgacctgtgggatcttctttttagagcctggggagtagttttattaattacaatgtgtttattaaataaaggccaaggttatagaggtcctgatgtgtcacatgatatcaccttcttgcatttgagaatcaaatacaaaaccaccctttatttttaatttaccacctcacccattccaggcatactgctctggaagtgtccttcatgtgacatctgagtgcctcctcttgccaaccacaggagcttttgctgcagatttgccagcctgagttgtttttcccatagtcggtgtatccaggaggtttcaggcaaatattggttgagtgaatggatataaccattcagttaaccatttatacaacactagagggccattaaaacacagggagagaaaacactgaataaagaatcaattgaatgcagcatgggaagtgagtttatagttaaaagcaacatctaaaatgttctgtcaatgttaacattttgcaaatggataagaaaactcttccaaaaatgtatcagataacagctgggcgtggtggctcatgcctgtaatcccagcactttgggaggccaaggcaggtggatcacttgagcccaggaattcgagaccagctgggcaacatggcaaaaccctgtttctacaaaaaaacacgaaaattagctgggcatggtggcatatgcctgtggtcccagctacgtgggaggctgaggcaggaggatcctttgagccagggaggtcaaggctgcagtgagccatgatcacaccactgcactccagcctgggcaacagagcaaaaccctgtctcaaaaaaaaaaaaataataataataataataataataaaaatatattttaggtctatgtttggattcattaattgagaaagacaaatcaggagaaggagataaatggagaaaagaggaaagagatggagacaaagagggaaaatggaccaagatacacagggagagacatgtacagagacaactctagtaacaactgctatttattaggtgcccgccagtgccaggcactttaattattattattatttttgttttgagatagtctctctagttacccaggctggagtgcagtggcgcaatctgctcactacaacctctgcctcctgggttcaagcgattctcattcctcagccactcgagtagctgggactacaggcatgtgccaccatgcctggctcatttttgtatttttagtagagatggggtttagcccatgttgcccaggctggtctcaaactcctgggctcaagcattgtgcctgcctcagcctcccaaagtgctgggattacaggcctgagacctggctcactttaattattttcacacctatacacagtctctccttctcacaacccttgctcccattttacagatgaagaacctgaggagtggagcagttaggtaccagcccaagcttacactgcaagtgagccccatacatgcatatatacgcaaacacacttggaggcagagcccattacctatttaacaaacattagagaaatgagtgatgctaagcactcaatgaatccctgctgccctttgctcagggagagcaagagaccgaccaacacacctgggcacggagagagcacagcgtggagtaacatcgtaagctccgaacgttcaggacagagtggccctggagttcaaatgcatgctgtattttagtaactacagctataaactggggcttcgcctccagcacttgtaccacagcctggaagaaactgaggcaattctggtctaaagcagttaactcctgggtcctgatttacagtgggaaggaaagggggtcacagtctatgctttctgccgcagactgaccccattcatattgatcctgttgtcatgcggagaaaagatcaccctgcttcctgttttgggtctctgaggttgacccatgtagtttaggatgagaaaagggaggtttgttggggaaaatgagatttcgattttattagggtctggccttacaggcacattccagcccatcaactattcaatctttatcctcctccccattcatttcctggcctctggagtggggctggagaacaccattcttacctcctctttcctgcctttgttctgatggccatgttattgtcttggatcaagcatgtcctcacatttttctgtcccttccatccccaaatccagggggctcagtggaggtggccctgggattccccgaggagagattctcaggcgttttgggggacctgctgtctccatggacctctcatggtacagggtactaggagccacatgcacttctgagcacctttgccccaggagctccctctttgtgcccccaggtccagggttgaatgtggccctgtccggggacatcttgctttctgactgaaagtgcaccctctgtggcctactttggccctccacagtcagcctgctaaggggcgttctctctgttgagattggccgtctaaactgtgctgccggcacattttagagcaaaaggagcaaatggcacaaaaacagccctgctcttggctgatttggtttagttttctcctagtcccattggccctgaacctgaccgctgatctcctggctttcagacacaacacaatggccatcggcattgcagtggacattctgggatgcacgggcactttggaggaccgagcggccactctgagtaagatcatccaggtggcggtggaactgaaggattccatgggggacctctattccttctcagctctcatgaaagccctggaaatgccacaggtaaatttccaattactttatgtgtacttaatgttctgtaaagagatctgcatgccatgtttggcaaatcagactattttagtcaatctcaaaagtaaattgaatcttagtgaaagctgcttcatttaggggacagtgtcctaagtatttggggtctacttttttttttcttttttgagacagaatctcactctgccacctaggctagcagtggcacaatctcagctcactgcaacctccacctcccaggcttaagtgattctcatgcctcagcctcaagtagctgggactataggcaggcaccaccacacccagctaatttttgtatttttagtagggacagggtttcaccaggttggcctggaactcctgacttcacatgatctgcccgcctcagcctcccgaagtgctggaattacaggcatgagccactgtacctggactggggtctatttttttttttttttaaacgaagtctcgctctgttgtccaggctgcagtacaatggtgtgatcttggctcattgcaacctctgtctcctgggttcaagcgattctcctgcctcagcctcctgagtagctgggataacaggcgtgggccaccacacctggctaatttttgtatttttagtagagacggggttttgccatgttggccaggctgatctcgaactcctgacctcaggtgatctgcccacctcggcctcccaaagtgctgggattacaggcatgaagcaccacgcccagcctctggggtctattttttaaggcagtaaatatttgctgacagtccatgctttctctttgatgtacagtagcaagtgtcatcctcatgaacagtagtgattcaaggagaaccaattaggatgagacatctggctaaagtgtgttgtataagaaggagactgcctccatctgggtcaccaggtgtgggcagtctaggataatcactgggaaatgagacatttgcagagcttctatcagaatccttagaatagtttatctcaggtcacctaaaacagactgtcctattaaaaagttcggattcctggtccatctgccatagaactccctaattaccgtttctgaaactgggcatttgaatttatctgctgtgccagggattttttaggatgagtgtcaaacctgaatatctgtatctgaagtcaagcaggcctcatagaggaaagtcaggctgccatctttattgctgaggatcagcactcccacttctgttctcccaagccctggatgcttggaggacttgagtatgagtttacagtccagccagcaaaactttctagtaacaccaaaaccgctggtcactcggcttggctgtttcatagccacaggttagctctgaaatcctgccaggtactcactgaaattccatcattgccactgaaaaacagccacaatcacatgtcccgcaagtcagatcatggcaggaatagaatttacttgcattaaagcaaggtcaccttaaaaataaaaagttgaaaacttagtgccttcatcgggaatttgtggggggtcaattctaattatatttcagaagctttcagaattcttcaggtagactggtattttgtaggattggtatttgaaataagcagcccataagttctgccagattttcatgatatactgatttctactataacgggttatcattttttcattcaggtattttaatgtgcattatgtttatttcctgtcacctaaaactgcctagaattttgacagcagagccaacaggccaggctgtgggtaaagccttccagcccagagcttcccctgagactggtaaaggagatgttttgtgggatcacatggttgccatccatgacatcaaactcagcagttagggacttgtccccaaccacattaccatgctttgtaggcggctccctgccttctaacagtgtcagcctttcccttctggagcacatcagcagtgacaggacacagtcctccagagcatacagtggcctaggaggaagtggcatacccagagaaagcccaaaaggagggtcacattactttgcgtgtcaccatccaacccagcccttacactatagccacatctgccaccttctcttctcagcttctagtatcaagagaatatgtccaggagatgggcctagcccagacccagaggcttctttcagaaaggcaatgcctcagggagtgggtgtagggagcaggggtctacagaaggaagggcagcatggtgggcagcaggaggaaggcggccacagccttttcttcacagcacgtctgctggtgctgagcctactcaccttccttttggatacaggagctcttcaaggccaagtaaatgaatctcagctctaccacataccagctgggaagccttgggcagttacctaatctcttctgttttctcatctgtaaaagccaaaatacctgtcttaaagggcattgtgaagattaaatgaaattcttcaaatatttgacacaaacttggctcttattccccaaatactaatgcccttccttgtttcatgtagaaaacttaacatagccttgccggttttagggtatgagttggggaccatttatcttaggacagtcagagtcagtggtgtatgctgctgctgactaaattgttccaaaagaaaattgaggccctgagttacctgcagaagaaaagaaatgagtagcaggcatggtgtctcatgtttgttgtcccagctactcagaaggctgaggtgggaagatcactgagcctgggaggttgaggctacagtgagctgtgatcgcaccactgcaccccagcctgggcaacagagtgagaccccatctcaaagaagaaaagtcataaaactctttaagagacgagttaaactatagctatccatacagtggactattatgcagaaatttaacaaaataaggctgttctatatgtacttatactgaatgcttttgaggcaaggaatgggtgtggtttatgtagtatataatatgcatgtatttatttttaaaaggggtgtgcgtatagacaggaattttggggaggtcaattccagttttatttcaagagctttcaaaattcttcaggtacactggaattttctaggatcagtatttaaaataagcaacatcagttctgccgtattttcatgataatgctgatttctattataacaagagtgtaatttttcattcaggtgttttactttgcatcatgtttatttcctctcatccaatactgccttgaattttgacagtggactggccagcaggccaggctgtatgtgaaacacacacgcacaagcagttgaagagagttgccatctctgggatgcgctaacagcaatgcagatggggcggatgggggattattttttctttctaccctgctttcagacactttgacatttttaccatgtgtatctatcacctgttccaaaatttaagcaaaagggtaattttattttatttatttttttttttttgagacagggtctcactctgtcaaccaggctggagtgcagtggcatgatcttggctcattgcaacctccgcctcccaggttcaagcaattctcccgcctcaacctcccgagtagctgggattacaggcacacgccaccacgcctggctaatttttgtatttgagtagagacagggtttcaccatactggccagactggtcttgaactcctgacctcaagtgatccacccgcctcagcctcccaaagtgctggcattacaggcgtgagctaccacgcccagccactaaaaggtaattttaaaaagaaccttttccaaaacaccacctttcttccagatcacaaggttagaaaagacgtggactgctctgcggcaccagtacacccaaactgccattctctatgagaaacagctgaagcccttcagcaaactcctgcatgaaggcagaggtgagcacgtgggcagagcaagcatggggctaccccgctggggagtggagtacaagtacacagggcatgttatgaggccctgagttatctgcagcactgtggatggctcatcagggcttttatcagatgacagcgttgcttgtagaaggctgcagttgctgtaacaagacaagggctatgagtcacctcattctgtgcttaactttggaaaacatgtgatatggaaaactctactccttattcttcagagtccacatgtgttcccccaaacaatgtatcagtcccactgctgatgccgcttgtgacgttaatggagcgccaggctgtgacttttgaaggaaccgacatgtgggaaaaaaacgaccagagctgtgaaatcatgctgaaccatttggcaacagcgcgattcatggccgaggctgcagacagctaccggatgaatgctgagaggatcctggcaggtaagagatgggttttgtaagctgttctctaacactgtatcgtaattgaaatgaaggaatggaagagcatggctgacttcacttagaaaaagaccaaaaaggaaggattaaagaatggaattccatttcctatatggctagttattacttcctcttaattccagaatgactcaagtgccctgtttctccttgtgtgttctgttgttcaatggtatagaataaacagagagaaggggtcaagaaagaactggggccgggcgtggtggttcaagcctgtaatcccagcactctgggaggctgaggcaggtagatcacttgaagtcaggagttcaagaccagcttggccaacatgatgaaaccctgtctctaatagaaatacaaaaattagctgggcgtgatggtgtgtgcctgtgatcccagctactcaggaggctgaggcaggagaatcacttgaacccgggaggcggaggttgcagtgagccgagatcgcaccactgcactccagcctgggcgctgggcaacagaacaagaattggccaacttgcctaccacttattaatagtacctctaataggtgagattagaaaaggtgatgtgccaagatgaggaggtggagttttatccagacctcatttatctgcattcctgttccttcccagtcacactgggaagtgagctcccctgctcttagcatcagacacatcctggaaagtgtggggcagtgttgcgtaaacggatttttcttacaagtgctatggtgacagaaagcagcctcctcagtcagcacggccggcatttatcacacatgtggcatgcgcgcggcaccgtgctaactggatgtcctgaggaatttaagcaggtacgataaatgcagtgtatactgtgggagcacttaggggaagggactgatttggtcagagatgttaggaaagaggaagcacctggtgacagcttcccagaaaacactgcattgattgttaaaggacaaaagcagttaccagcaagcagggctgggaattccactcagatggcacaacccaagcaaaggcgctgagagaccttggggaaaactgggatccacaagtacttgggtttagatttgtgcaaagtatgacctaaggaatggccaactaggctacagagggaggtgcagctgggaagcccttccacataagaccgtggctgaagaagagccagtgaagggtttaatcatgggagggtgtcacatggtcagatttctgttttaaagtaaattactctggtgtctgtgtggaggaaggctggaaggctgaaggtttgctggcagaaagaccattcaggaaggagggctttgccaaggcagtcatcaaggatgactattttccattactatataattttttaaattcttcaagggctcacagtttgattcacaaagttaagaactatgtgggggcaggagactccatttatttaattctaaaagggagctgcctcagaaccagatgtgggacttagtcgtttgcaccatctgctgtgggtataagcaccgcatacctgtttcattttcttcctcaaaaagttctccaggattggctgtatgttactcaaacaataaaagcacacaagtcaacaagtatcagagtgcctacttagacaaagccaatgaatacattaccatggatgttgcataagccaatacatcagggtgggttttgagaaaagtgtgccataagctgctctacagctttaaatcactttaaaggtcactgatggaatttttcagtcgatcctaatatagatttcacagcaagtacccattgctgtaagtgacagtgaacccaggaaaggcagagatctgctcaccagcatagaccagaccacgtgaatgggaaggggctcaaagcatgtatgaataggagtcaccatctgggggccgggcgcagtggctcatgcctgtattcccagcactttcggaggctgaggtaggcagatcacctgaggtcaggacttagaggccagcctggacaacatggcaaaaccccgtctctgttaaaaatacaaaaattagccggggaattttgagagggaatacttgagaggctgaggcaggagtatcaagcgattctccttgattcttaatttcattgagccgagattgtgccactgcactccagcctggtctcaaaaaaaaaaaaagtcaccatctggcctttggttggttatccaccaaggatattctggcatcatcaggaagaaaatattcctgttgtcctttctacaaccaagatcctgtgatctagatggcaggtatatttaatggcagaacaaactatcccagcaataataaaggatgagaaccacatgactctttggctagaggcttctctctctttaaaagagttgcctgaacatctttggccttaagcagaccacatcctctcttagatggaatagagttaagaaataggcccacacatatggctgacagttgattttcaacaaaggtgccaaaataattcactggataaagtataatcctgcaaatggtatctgctattggatatccatatgcaaaaaagtgaatctcgatccttacctcataccatacacaataatccaaaatggatcatagacccaaaatgtaagagctaaagtataaccttctgtaagaaaacataggagaaattctttgtgcccttaagctaagtaaagacttcttggccaggcacggtggctcacgcctgtaatcccagcattttgggaggctgaggcaggcggatcacctgaggtcgggagttcaagaccagcctgaccaacgtggagaaaccccgtctctactaaaaatacaaaattagccgggcgtggtggcgcatgcctgtaatctcagctactcgggaggctgaggcaggagaattgcttgaacccaggaggcagaggttgcaccattgcacttcagcctgggcaacaaaagcaaaactccatctcaaaaaaaaaaaaaaaaaaaagaaagaaagaaattcttaggacacaaaaagcatgaaccacagcagaaaacattgagtacacatatatctgataaaggacttacatctaggctatacaaagaactcttacaactcagtgagaagataaaatttaaatagacaaaaatttgaatagacactacatcagagaaggcatacaaatgacaactacatgaaaagatgttcaaagcattcatcattagggaaatgtaaatttaaaccaaccacaatgagataccaccacactatctagaatggctacaactaaaaagaatgataggccaggcacggtggctaatgtctgtaatcccagcactttgggaggtcgaggcgggtggatcacctgaggtcaaaagttcgagaccagcctggccaacatggcaaaaccccgtctctactgaaaatacaaaaaattagccaggcgtggtagcacacacctgtagtcccagctacttgggaggctgaggcaggagaattgcttgaacccgagaggtagaggttgtggtgagccaggatcgtgccactgcactccagcctgggcaacacagcgagactccttctcaaaaaaataaaaataaaaaatgataaaactaagggttggcagcatgtggaaaaactggagtcttcatatgttactgctgtgaatataaaatgatacagccattttggaatagagtttaatagtttctttaaaagtaaacatatactgattgtatgacccaataattcctttcctagagaaatgaaaacacatgtccacacaagatttgtacacaagtgttcacaaccacttactcatagcagccagaagcaatccaaatgtcatcaattggtgaatggataaacaaaaacaatggcatgtccataaaactgaatattgatcagtaagaatgattagcatgcaacatatggaataatctcaaaaacatcatgctaagtgaaagaagtcacacattaaaaagttcatagtggatgattccatttatcccatatttctagaaaaggcaaaacagtagcaacagaaagcagatcagtggttgactgaggtctgcagtaggaacaggaattgactgcaaagaggtactaaggtgatggaagtgttctaagactggtggtaatggtttatgtaaaaacttaccatcataaatcaaactccacagccaaaaacaggtgaatcatatgacatgtaaactatacatcagtaaagttggtaaaaacaagtaacgaactcctaggtacaatgaaccctccttcccacagcactacttcccacagtggtttgtacaaaccaatttcactctattgttttttaatgagtttacctgttatttcttctctgaaggtgcttaggttctgcagggtggggctctgctctcccttatatagaacagatcctatatttttctttggggacattttttaaagttctgagagagagaagatgttcattttgatgctactttaagcaagctttcagtctatttttttttttttttttttttttgagatggagtctcgcttgtcacccaggctgcagtgcagtggcgcagtctcgctcactgcaagctccacctcccgggttcacgccattctcctgcctcagcctcccgagtagctgggactacaggcgctcgccaccacgcctggctaattttttgtatttttttagtagagacgggatttcactgtgttagccaggatggtctcgatctcctgatcttgtgatccacccacctcggcctcccaaagtgctgggattacaggcgtgagccaccgcgcctggtgctttcagtctatttttaacacatcttaggcagaactgaagtaactttttgtttattttgtttcattaggttttcaaccagatgaagaaatgaatgaaatctgcaagactgaatttcaaatgcgattgctatggggcagcaaaggtgcacaagtcaatcagacagagagatatgagaaattcaaccagattttaactgccctctcgcgtaaattggaacctcctcctgtaaagcaggcagagctttgataactctccagagaacctttagaatatcttttcaagtttccccagcttcatctttgggaaagcttactgtttttgataaagtaataatgtgcaaatctgacaatatacaagcttttagtatccacaggatattaaacgtgtaaattgcacagagcacacttatttatgaattgtctaaagttactactgattttaaaatgaataatttattattaaggtaactactgctaatgttgatcagcaaatttaagagaagacctagctatgttggctggttgctttctattatcatggtatttgaccattttagttttaattccatgtcagataagtgtaaatagaagagtttaaaagcatgaaacatttcagaaggtatcagttatatgatattctttaaacaaatatgaaaaatgtaaatactcatgaatgaaaatacatctttttgtgaaacagttgtatccagtctctttcatattaaacaactcatcttggtacaataactctacctcttagctacctcaagcatgctcttccctaggtaccgtatcctgatagtaaaccaaaatgaatgaaagtggtatgaaaaatttaatgttcctggattaaaaggcagagtgattgatagtgacacaaggtagaaacagctcgagaggacctgggttcaaactcaagctatggtacttgctaccagctggagttaggccaagtttacctcattgaattccatgtgcagcatggacacccagtatgatgaacataacatcatctcttcacatatttcagagtaatcaactgttttaccttttcctctagctgataagtacaacaatgagtttcctaggttggctttctaggtttctcattttgcaaaggggatactttctagtttctttctagtttagcaatatccctctcaactttccctattgtacaaaatttggaatataagactttaacgtattctgttactctgccatcaactgtcaaacttcttttaataatctgtttttccttcttctattttaaataatattaggaccataccaacttttatattcatcttaaaccggctgtgaaaatttcttcatgatgttaaatagcctttaaaaaatatgatttattggttacagaagttacactgtaacttaactatcaccctatgatggtttttaaaaatgtgccacattttttaaaaggtgccacgttgttattttttgttgaaaaaaaccaaagcacatttctacttctggcaatatggtggttcagatgttcttagccctctcaccataactaactaaatcctgaatacattttaataaacataccttttagtgtatgatcaaccttgatagaaatccccaaggaacaaacttctctccccgccgcacctgaaaaaggtacagcacatttgaatcaactcctcatgagaacttaagagccggggcagacctagaggcaaagagtaacgtcagctcagtgaatgagagtctgtcttgggggaacttaaaatgcctccattaagcaggaatccttaaagggtccctgttaatggaatagaaaacattcatctgccagcaaaggaaggttgccaggaaacatgactgtcttcacatacagctccaggaagaaaacaattataatgactatagtgttcagtgaggattggcaaccacacacctgtcctcatacaggtctggagtaaaaattacaaaatccaaaaccaagaaattgatttacagtggtcccaggttggtggtgtctaccagatataaaagcttattattaagctatagtaattaaggtttcatcagaaatttaacatgacagagtgaaactgttgataaatgggggaaataatgactttaattcttgaacaattggttaagcaaatgaaagggggaaaatggcctcttacctcttatcatatacagaaataaaatctggatgagttaagaacctacatgtgaaaggcaaaatcataatacttttagaagaaagtatcttttactttgaatcaaataagaatttcttagaaaaagcattaattataaaataatgattaatctgcattaaaatgaataaattccattcaaaagacatcatagagaacctgaaaaatcagagatattgacaacacataaaatggacaacagaatactatggttggtaggcagcctccaagatggtccccaatgttctctgcctcctggtgctcacactctgtgttgtcccttcctgcattataccaggctttgtctgtgccaccaagcacacagggcagaaatgttgcatctgagataggttatgagaagactgtagcttctgtcttgagtcttggatcactcaatctggggaaagcaagatgccaccttgtgagtatccctatggagaggtccatatagcaaggaactgtagcctctggccaacagccagcaaggaaaggaacagagg

SEQ ID NO: 14203 - DNA, 32393 bp, Human
tcaggcacatctacccgcacgacagactggagcaaagtaatctctggctgaggaggccaggtacccagctaaaaccaagggcttagaaggcccagaacaaaggaaggaggcacaccaccgccactgcagctgggaggaagaagtggggtagctgagtttgaaaagggctggaaaatagggaactcttgcctggtcacctttattttctctgcaaattgagacctggagtcatcactcagagagccaagaagagagatggcttttccagcctctctcctgttgctgtttaggtccgttgtggtagaacaggcaggcacctacttacagacccctgagatggttcaaggaaaagctgtgccttcggagtccagagtttcaagcctagctctgggctcagctgctttataaccttgagcaagtcaagaaatctcagtttccttatctgttaagtgaccacgacagtgcccagcctgcctgcctgctcacaatcctgtttgggccccacggagagctgtaaagactctgcataagcatcaacgctggtggaaatgtgagtgggcattcttgtgggagggacagagttgccaaggcaaagctgagccacaaagggcaggcagaaaagggctgagaggaagatcggaaggacgtgagatggggtgtggccgagaccaaccccacgtggaccgcctagtgcccggccactccacagggctctgcccgtctctgacccagcatcagaactcctctgctgtcggggtgagggtgacagggaagtggggagccgcttctggacaagcagggctcccgtggccagtgggagggagcagctggcccagctgtccacagccgctgggagtcagcctctgttctgtcttaagatcactatcatagagccttggcctcgtcctctgcgcttggccttggaagctctcctgggacctctccccaagcccaggacacctctctgtgttcctggctcagtctagtcaacagtgtgagtttctctcccagcctctggcctagcaaagctggcctctccagtgtgtgcctgtgtgcgcgcgcacacacacacacacacacacacatacacacaaacagaagcactgcatactatataccacatgtacaacacacaccacacacagcaaacacaccacacacatatcacacactacacacacacacagaagcaccgcatactacacaccacatgtacaactcacagcacacacagcaaactcaccacacacacatatatcacacactatacacacacacatatgaacacacaaagaacataccacacatagcatacagcaaatatgcaaacacaccacacacagacatctcccacaaactccacaacactcaccagcatgcatgctccctacacatacacaccatgcacacatgcacgctcccttcttcctaatggcccctctgtgtctcatatcacacccatccattccatcctctacacagctgcttcagtgattttgctaaaacgcaaactacaccatttccttatttaaactccactccctcttccagtggctttccagaaaattcaggctaaaaatcctagctccttcccagagactgtggccctccacagtctgttcccccatggcccgtgccgcatcccccatcagcgagtctgtgccacctgccctttcccccactgtgggttcctcgtgcatctctggaggatggccccactacctacctcatccatctgaaacgtgttcatccttccaaacccagttcagagctcacctcctctgtaaagctttcttgaccacccaagcagaatcactcccttcctctctgcagctcgtgcggtgtgtggtggaatgatttgcttcccgtgtctgtctcccctgccagcaggtgaccttctgaagggaattcgtgtctatagacagagcacttgttcctggcatagggtgggctcagtgaacacggggtgggtggcactcatccccctcatcctcccacacagatcaaagtggaaaaccagcttgacttccaggacatcaccagcgtggtcgccatggccaaaacctacgccaccaccgaggccttcatcgactccaagtacgacatccgcatccagaaaattggatccaactacaaggcttacatgtgagtctctggggcaggggctgggggagtgtgggaggaaggcagcccagaggtgcatgtccagccgctgtctcctgcacccaagggtgcatcattatcctccttcctgtctccttactgcccttcttctctgtccagtgtggctgaggggctgatgtccagtcactgcttatccctgggcagagatctgtctacccaagcaagggctgtttcctccagagcaagaaaggtgcttggcatgtctagggaactgcacatacacacaggatatatgtctttgagagagaaatttggggacaaatcaaggagggctttgaataccttgctgagggttttggagtatttttctcttctcttctgagcaaagggtctgatctgtgtttataaaaaggtgaccatgaggctgggaggtgcagaacggtttctctgaagccaataagaccagttaggaggttacaccagatttctctgcctgcaagcaacagaaaccacatctcattaacttaatgggtttttaaagggaatttactagaaaaccatgggttatcagaaactttaaaaaagcaaacaaaaatatctcccaactcaattatcaatttcagaaacattcagatacagagtagccccaggaaggtgggcagccagaaataataataaacaattttcatggcatccctactggtaaatgaatctgccctagtcattttcaaggcttaactcaagattgtgattccgtggaaaaaatactgattagtccaactttgatcgcattttattgattagagaaaagcagaaaactttataagaaggcatgcagtgtgggcagagccattgcccagtggaaatagaggtgctgaatctagaggaaaaggaaagaatgccaggcagagaaaagcagcccgccttcaccctagaggtggttcaacaaagcacggattacatggggctgtggttataaggatgaatggggacttctggaataggcagactgtctcgttcttgggagaggtctttgctccaagccctctctatctttcactctggaatgttattgttagttccacttgaaatgatgagaccccagagggccaatcgttgcctggttgccaagcatttatggggcactgactgtgtgcagggctccatatctgaggactgcaagggttagccctggacagctggaaagtccctccatccgcaggcttctgtgtgggtagcttgtgctttaagctagggttggcaaaccacaaccacaggccgaatccagctgccacctgtctctaaatacagttctgttgatcacagccatgcacgcccatttatggattgcctgtggttgctttagcactacctggattgcctagaccaagggtcagcaaactttttctgtagagggccaggtggtaattttaggcttgacgggctatatcgtctctgttgcaactactgagccctgtcattgcttgtgaaactggaggaggtgcaggcagttgccctagaaggaagtgttcccaggaaagggatggagctcattcttgaggagtaactgccctattccactaatcaacctcttcctcctgtgaggcaagccagacctgccactgctctcagatggcctcggggtgataaaatcacctcctccctgccccctctgagttatggcccattccagtgcgttcctgaggcccctgccttcagccatgatatcatttccctcctctcttcattgtttgagcttccacttgacattgacgacaccttgtcccagttttttttttttcttgaggattacctcattgcagcatttttctgctgagcctccctggcctgacagctccactttgtcattacttaccgagtttcctggaccttgggctggcccatctccaaaggagggggttcatgtcagacttcagtgtagaatttccccggccattcaaccccctctctggcccactccttgccctgcactcgggcctttgtgcttgtcgctactgggctgtcattctttctaagtcctagcagacacagtaaggaagtacatgtgtgtatccttacccgtgtatacacatatatccataattttttctatatgttcccatccacatccctatgaagctaaacagagtcctatggatgtccctgactttcatctggtaccacttcgttcattttagcctttcctgattgctaatctataacttcccactccaacagagaaaaatccagctcccccatccaccatctattccacttttttggttccatctcagtgtatgtgcccagtctcagaatggttcacctgtagctccatgggaaacaaccttgccaactacggtgcagtgccttatggctcctggtggtcatctattctcagcatttttacttcaattttctcttacaatgatacatttttgtgtcaattcctctcaccagttcaccctttgatctcaatgacatagcttcccttgaccgtaagacaaatagctttacctccaccactatgcttaaactcgttcagtctttgccgaggccagatgcatcattagtgatagatagcttgtctggattctcccccagtgtacacagttcctcacccagtaggtgcctactgggcacctactacctgccggatcccactggatactgggtatacaggggatgaagttaaacatgtcccctaccgtcaggattctcctccatcagagaagagaggacactaatgcagtcatcagaagggagatgagcattactgagcattagtgtagggcgtagtaccgggcagtctatttttgctgtgtaaaggtgggctgtcaggaagtcgtatgtcagatgaaacctgaggatgagcaggacttagggaggcaaagatggagacaaagactgtacggagtaaagggaagaagacctgcagaggccatgacattgggaaagagccatgggcagtggagcaccggaagggaggtcggttgttactggagcagaaaaggcaaggaaacagagaaggatggcaagacagtcagagaccagaaggccttcctaatcttcaccagagaaaagtagtcacttctctctaaggatcacttttctaacattttggggccctcaaaagattccagaatcaccaggggctatacacactgccctcattctcctcaaaaacaggccaaagtttgggggatttcatcagatgatgtaggcattttttaatttaatctttcaatttcaaagatgacttagaaaacaatacctaggatccaacaaataaaaaaggcaaacagcatgaagggaaataaacataggaaaatatagttgaagacaaggtgtgtacgtaagaatacatgccattacgtgagccagttatttgaatcagagcctcctaacagccaaagcaaagaaggaaagcagatcagtgacgagggtccctaattccctcaatgtgttgtttgttctggtacaggagaacctccatctctgggaactggaaggccaacacaggctctgccatgctggagcaggtggccatgacagagaggtaagagacaaaggaggtgtagggagaggcactggccatagtaggagctgaagggggaatgcaacaaaaggccctgaagagaaggccactccgccctccgtccagtgcctcaccatccacagagcacttttttagacatgatcatcttcactgcccacagcaacctacagggcaggtattaaaataaccccattttacagatgggagaagaaaactcagagaggggaagtgatttgtctaggatcacagagctagttgatgacagagctgagagtagaaccctgatgtcatgactccaagtccgaggtctttccagccctgaccagctgctataggaagaggtcaggaagccctggccagtccctcctgtgctctgacagctgcaaggaagcattattaggagaccaggcatattggagagtccacttctctctcaagcgtccttccatctcaatatgaatagggaaaggttgacgtcccatgaatcatgcatgttttagggatgctctctggctgaagggtttttcggtctttctccctttagacactgtgtgccagccccacttaaggaagtgccggccgggtgcggtggctcacacctgtaatcccagcattttgggaggccgaggcgggcagatcacctgaggccaggagttcaagaccagcctggccaacatggtgaaaccccatctctactacagatacaaaattagccaagcatggtggtgggtgcctgtaatcccagctactcgggaggctgaggcaggagaatcacttgaacccaggaggcggaggttgcggtgagctgagatcgtgccattgaactccagcctgggcaaaaagagcaaaactctgtttaaaaaaaaaagggggggaagggtcgaagggccaagtcagctggtctcagggcctgccacatacataccttcttgcctgcatgccctgtgacctctgctagcagccacacaatagcaatggacagagcatgggctgtgaactcaaaaagctctgttcagtaaacacctattgagtacctactgcaggccatgttgtgctgagcgctaaaggatgaaaaaatccaatccttccctctaagaactctgtatcggttgcaagggctaccacacaaaccaaattggtttgcgcagaaagggggatttactggctcatgtcactgacgactccagatatacagtgtcaggtaaggccttaaggctcctcctctgcccacccaagttcagcttctttgtgtgttggcttcatccaggcaggctctttcatttcatggtggcacacagtggctccaggctttcatcctcacagtgtcaggttcaaaagaaggaaaacttctgtttcccagtcatttcaaccaaagcctagaactgagccatatgtactggttggcctggcttaggtcacatgaccatccctgaaccaatcactatggcccaagacactgcaacgctgtgattggaggcctatgtcaggtctgcacccctggagactggagtgggagcatcccctacagcaacaaagactgagtgtgaccttaggcatgctcatgctttctgagcttcttcaactgcaaaacgaaagcagtaatacccaagtcagagtgcaggtgtgaggactgaatgagagagggctgcacctaatccagaaccagcccctggcagggaggaacacctgtccttcccatcaaccccagggggcagctgccaccttcaacctgggaacccacctgtgctaatgagtctcttggaggctgcgctcatgacctggcacgactgaatcatgtggctgaggcagtcacctccttcccccaacaggtgttcacgggacagtcgtggccatcttctctatggcccttccggaatgtgagcccagccttccccagtgcctcctgagccactcacagatgtccccagcaggccacctatccctggctctgccaagtcccaggctgcatgggccatccctggaggaacctaacgtgggagtgggcctgcccaggcctggaatccactttcccttttccaatcacaggcagaactccagggtctgggctggagagatccccagtcctatccccacaggagcaaaatccatacagggactcatacacagggcctgaccccgccctccactggttcgcctgcttgccaggtggcctgactcctgggcaaaaccaatgatgtcgcttggtcagtgctagtcccacctggcaggaggggagcagggccccccccccgattctccaagcactctcacgctgctgtacgcctgcagccccttcctagaccctgggatgcctgtgccctatggggcgtagccagcaggggaccccaaggttcatcctttcaaaacagcctctggaaacagctgcctctggacctcagctcaaatttccacgttccattgagaagaaacctgatttatgagtgtgtctcagggcagagctcaccctgtgtgtggcacccacaagtcagccactggggccaaaaacgaggaccctgatcagagagcccagaggattcttcgagctccaaggacccaaggttgtccccaaacgtggccacgtatcagaatcacatgaaaagctttaaaaaattatagaaattactctaacatagggtggagccccaagtctggctgtttgtgcgtttaactctcctggtgattctgatgtacaaccagaatcagatctaggctttcccattttatgataagagggagaggcttttccaaaattattaaggaattaatagcaagaatgtaggtccctggtctcccatgctgagtgagaatggatgggctggggcaccttcagaatgagaggaagggtggcttgcttggaagctggaatcagacaggatctggatttggaagcggtacagtcacttaatcatcgctctgagcctgttcctccatcagtaagatgggttaaaaccttcctcatagagttgtgctgggattcgagggaatgaggagtcagcccccgggcccagaatgcctggaacataccaggagctccatgggtgtgagtctccatccttctttttatttgatgatctcacatgctccgtgctacagctgaatgagaaaactggactgggagtcaaggagatcgagggaatcctggtgttcttacaccttactgtgtgatctggaccagccaccctccctctctgggcctcagtaggctttggtggatgagatgagactccattctaagagcattccagtcacagtccctcctcatcccagcacttgtggctcagagacgcaaagcgatgtgagagtaggcgtgccccgtgtgaccctggagagtgagaagcaagaacattgacacagagtcccctgtgactcccaaatccagcccacaggggaagctaagtgcaaagctggaacagtttcttcacatacaaccacccccttgttgcagggtcaaagtccagtgctgagatctgtccccagcaaagcaaactggccttgcagacatcaagtggctggaaagggaacaaaagcagtgggtctagagggccaggctccctgggcgaggcagaagcagcctgccagtctccccagcccacccgccccgggccctgggaaaaatgcaccctttgtcctccacagcctcttgtccggccagggctgggactggaagggcagcctggagggacttctggagcccttggagcagctttcccaagggaaaagggacacaggggtggctgggtgtccaggatgactccggatggggacagggcaagctccccattactgcagagccagcaagtcctggggtcgggggagacctctcccaactctggttccttctctccctgcctctctcccctccttcctggctctctcgtgttctttctctgggtctctctctcactgtcatgtgtgtccctgcctctctccctgcctctctgtctctgcgtgttggactccaactctctctccgtctttctgtctctcttgctgcttctctgtctctctccatcgccgtctggatgtgtgagtcactgtccctccctgcctgtttttccatgtgaatccacttctctccctctacccgcttccccactttcccaggccacttcactgtctgtccatctgtccctgcaggtacaggctgtgggtggacagctgctcggaaatgtttggcggcctggacatctgtgccgtcaaggctgtccacagcaaggatggcagagattacatcatcgaggtgagggatgaagcagggagtcctcctggctggtccagcctggcaggcgtgccagggggagggaatccctgcatggtctttggcaccatcagctgtgtcctggctccagggcacacgcaacccaggcctcagtgagttgcttctggaggctccttcccaccctcagaggcatcgaaaggcttcatgcctggggacttggaactgagtcgggagacctcagggcccgaggttgaacaacatccccaacccacaggcctaagggaaggaaagggcatctggtcaagggtcaacaagatactgtcccatggggccccttccatttccccagtgtccaagcatgtgaaatgggcaccttccttggtcaccatgcagacagtccatcatttgttcattcaacaaacatggccttagggggctcccatgggctaagcatgggtgtggctctggggatacagccgtggacataatagacatggggtgtgcaggctggcaggggagagggtgagaaacagtggcagagcattgaggatttggaagggggatggaatggtacaggggcatgaatagagggaaagatgtagggaaacagaatggtaacagagggctcacagaggggctgtgggtcccggaatctctctcaagaccctccagcagcccatgcctctcccaatcctatagtcctcccatccccgccgcttcctctctctgtttccccgtatcccactaacccccacctctcctccatgtcttcccagtgtctctcacggtcccacagccctcccgtcccctccccaactcttcttccctgcccccccactccatgtcccatggctctccactgctttcccctgaaaaggcccctctggcctcagagtccgccataacttcccatctccacactcacagctccagtgccgcgtccagccccctccttccatgggcggtgctgacacaaggccaggacacgtgagggagagccctgcggccgtcccctccccggggtgtgggcggctaatgggaagcacatggctggggtgaccacaggagccagccggtcctcccgtctctcatgtctgcctcgctccccaggggcccacggccaagcaggaccaggtgactcagtgggtgggagcccagtcatgccaggagggtgttcacacccaggccttggaggtaggaggagggagtccaggatgaacacagcccctctctcctccccagagaggccaggaagctcctgcaggaagagctgcatctgcattagcagacctagtcccactctggagaacagctctcctctcaaggcccggaaacgccttccctctggccgccaccacacctgaaattccccaagtagcccctacttggaggagccatggaaggggctgggaacagactccttgacctgtacagttgctccctggaggagccggtccctcgccttctgggagcttcagcccagaggtggggcaggaacccccagcacggcagctcctgagaccccaccaggtcctcctgcctctgcatcccctcacggggaccaccagacatgaacccagatttggcacacacgcactcatttgtttattcactgagccgctgctccaggagccagcccccaagccaggtggacacagtacaactgcaaacacaagagcaggggccctgtctcctagagctcccggactgccctgacccccaaaggccagctcctcccttgcaccagcagtctctctgtcccctgtgagcccctacctctccgggtctcagctttcagtcttagggaaaaaaaaaaaaatctgtgttcatgggctcaggcttcctgcctttagccattcagagggttggggatgaaagacctttcacattaaaaaaaaaaaaaaaaaaagtaaaagtagtgggctcggacttcaaaaaataagaaaacaacatctcccaagaatgttccagaggaaaaatgaaagatagcttttcagatttttttttcctcgcagaaacattgcagagttgtttcctttgcttttgagtttggagtggggtcaggggagatgggaagcttgttaccagaaatataaaaggtattttcccccagtaagggaaaaaaaaaaggcagaagagatcccaaaacactggtttcttcagccatctctgtggtgagaactgaaaatgtgtgtgaaatgttttgtgaagaggctcacagtgaaatactcaggggaaaagacccttgaacttgtcctctctgaccttgtccggggaatgacattgctcactggaaaaatgtttccctggggagacgagggtggccacttcctttggctgtctctaccgtggggattccaaaatgaacctcaggttccttgcggtggctgttttccactgcagggaatgtaggaaacagagaccagaataaaatggggtgggcaggggcagggggagagaggacaggcagggtgcagcaagcctgtgtaccttcgcggcagactccacagtcagagctcagccagtggtgactgagagactgtccctgtctggggcgctgggatccaggaggcctcagtcccaggtacgacctgcgcagagctcaggaccctgctagaagcagtactcacattcttttttttttttttttttttttttttttttgagacggggtctcattctgtcgccaggggaaagagggaagaggaaaggcctgttttccggggccctggcaaaacccaggcgggagggaaacgcgttccacagggagctgggctattctcaaagtgcttctatggggaggagcctgagggatcctagtttccccttctgctcttcttacaaatagagcaacttggctcactgcaacctccgacactcccaggttcaagcgattctcctgcctcagcctcccgagtagctgggattacaggcacctgccaccacgcccggctaattttttttgtatttttagtagagacggggtttcaccgtgttggccaggatggtctcaatctcctgacctcgtgatccgcccgccccggcctcccaaagtgctgggattacaggcgtgagccaccgcgcccagccagtattcacattcttaagctagcttttcagtttcctaatcaaagtgggtgcttaaactcacagatccctacaagtcccagctggaagggtcttagcagctgcccagatccctcagttcactgttgagaaaaaaaaaaaaaaaaataggcccgtagaggaaaagaaacttgcccaagatcacagagcaaatacacagcagaagccaagcctggaacccaggttccctcttctcagttcctaccctggtgtgctgttccagtgcttggtgggaattagcctgatgcagtgggaggaccgtgggttgccagtgctgtgtccttgaccttgccacttctttgaccctctgcttcctcttgattacaatgaggataatagtactgcctcaaagagctattctgaggtttatgagagatcctccacacccaatgcttagaatagagcgtagcacgtaggaaatgccccataaaatacggcgcttcttagtatccttatccttatgagccgggcttatcacaagggcgtcttattcctccactaaacaggtgtctgtggagggcacacctgcttagcaggacacagggcccattcctaaccttgggggctcccagtctggtggtggagacatagtaagcaaggggtgacagtgccgtggataagctgtcccgtgtgaaaccaggtgagaacggcaggatacagttgtcaggtggctcgtcagagcttgcactatcagagagggcttcctggaggaagacctagttagctgttccctgttggatgaaaggagttggccaggtaaggagtgggtagagggattacataagaacctggaggagagagaaaacctaatatgtccagagcgtgggaacaggggagacaagacggtgagtctgatggggtggcgtgggtgaatgcaggccgccgactcctgcagtggagcagagagggtgacgcggccagctgttccgcagatgcgccaaggcctgacagacaccccttccagatctcccatagcttcccatgcccagggaatcacgtggagcattggcctgtgtgaccttgggcaagtcccctcccatctctgggcctcagttgctctatttgtaaaaacagcagaaggggaaactcggatccctcaggttcctcccgatagaagcactttgagaacagcccagctccctgtggaatgcttttccctcccgcctgtgttttgccagggcctcggaaaacaggcctttcctcttccctctttcctctgaaccctgggtcaactccagcccgcgtcatatttttgtcatgatcaagcccccacctttactgtttctgctttgtggaaagcagccttgacctggggccaaaggagaggtggccagccccgaccctgggagggggccagggtgagaaaggagggggcggagagcggctccccaaagaaaagcacagaaaaggtcggcagaggctccctggcccttgtcgcattgctgtcatccagcaaacgtgggccgaattgaactacctccagggagtggtttagactgaaccgaagggaactgatgtcgctgccggccagtcccagctggaggtgatttgcatggaggacatcgccatctggtggtcacttctgtcctgagccctgagcccccacttctgggatgtgatgcccaaccgccatctctcctggcatgggggtccctcagctctcccttcctccccacaggtaatggacagctcaatgccgctgattggagagcatgtggaagaggacagacagctgatggccgaccttgttgtctccaaaatgagccagctcccgatgccaggaggcacagcgccctcccccctcagaccttgggtaagaccctcacgatcaaaggagactttatagccatgagaaatgccaggctgtctggaaatggggagcccctggatccaaaggggatacccccaggaagaaaccaccttggggagaaggaatgggggtgtggacgaaggccagacattggggagagctttcacagcctgccccagtaagtgaattgaggaggctttcagaggccccttcccttcttcaccatcctggggagaacaatcttgtctcaaatggcctttgggcactgtgggcagagatgatcgactgctgtcccttctgtgccctcggtgctgggcctgagcaggatgtgtgtgcgtgcgtgtgcgagagcatatggacacacaagccctctgtgtgctcccagggaaccagtcaatggacgctattgtgtctcccattttccccaacctcgatgagctcccacgtcgctcctcccctccacagttcccaccatggattaccagactgctctccaaagaatttgccagctccccagctttatgtaaaagcaagtccccaaacttccacctcccaccccagatttccccacagaaagtaatctatgataacaaacatcagaatcgtagttattatactgacggggctgctggctgggaaggggcacggggcaggctttatcgcagagaatgccctctgttttgatctgggcagtggttacaccgacgtatacacatatagaacttcactacactgtatactccagaactgtacactttatgtgtaagagtctcttctcaatgataaaaagatcttcataaatgctgccctctcacccaggaagtaaagggctgtggtgataccaacaggcttcttttctcttctgctctaggctccacagattaaatcagcgaaatccccagggcaagcccagctggggcctcagctaggccagccccagccacgcccacctccgcaaggtatgacccaggacgagccactgcaagaaagcatgcagtgagggtgctgaaatgcaccgagggatccacatgtgattcccacaaggggctctgggaaaatgcacctgaatactttatccacagaatgaatgagactatggggttggtcaaactctttaaaaagtcaagaaaggagaagggaaatagaaggttaatttattaagaacctaatatgcaccaagcactgtgccagggaatgtcccacctattttctcacttttattttcccagccgtcctgcagtgaaaatgtcattatttccttttttttttttttcttttgagacagagtcttgctctgtcgccaggctggagtgcagtggtgcgatctcggctcactgcatcctccacctcccaggttcaagtgattctcctgcctcagcctcctgagtagctgggattacaggtgcacaccgccacgcccagctaatttttgtagtattagtagagatggggtttcaccatgttggccaggctggtctcaaattcctgacctcaggtgatccgcccacctcagcctcccaaagtgctgggattacaggcgtgagcctttctactgcgaggtaaaagttgaggctttgcccaaggaggcagaaaatggtagatttacaagtctggcctttcagacctttcaaacctaggaagtgtttattcatttcaatgagtggtgcctgatgatagatttgtgagtcgaccagctagagtaagaaagatagaaaaagggaagatcatctataaaaccttggccattgaaattcctcctcaaatatattccagcattactacattccaccacttattagagaatggacaaactattgtaaaaagatgaaaagcaatcagggcaatggctaactaactttctcaaagaatatcagctgctctgatattcttgcatgcagtcttgagagaaatccgccccgtatcctctcttgcaatcaaaacctcctgggcacactcgctctggcaccagcatggagcttcagagcacctgtgcaccaagaaaccaaagcaggcagtctcgctgcaatcttttaaggatcttcttaaaaacctatcagaggccgggcgcggtagctcaggcctgtaatcccagcactttgggaggccgaggcgggcggatcacgaggtcaggagttcgagaccagcctagccaatatggtgaaaccccatcagtactaaaaatacaaaaaaactagccagatgtggtggtggtgtgcacctgtaatcccagctactcgggaggctgaggcaggagaatcgcttgaacccaggaggcggaggttgcagtgagccgagattgcgccactgcactccaccctgggcgatagagggagattccatctcaaaaaaacaaaataaaataaataaattatatatatatatcagaaagaaggcattactatcatgttgtggccttcccagtcactattattaaaagcaacagattcattacttcgtgaaaaaaagtcaaccttggccaccaaatggcttcctcttccacaggtcttagataaaatgtcccattcatttttcttgtttgtgtttctccttctggaaaagcaggagatatttttaagaaaagggaaattgtataattgtacacaactgtgtacagacatacctcagagatattgctggttcggttcaagaccaccccagtatatagtaaatatcagaataaagggagtcacacaaattttttggtgcatataaaagctatgtttacactacactgtagtctcttaagtacaatagcattatgtctgaaaaaaacaaagtacataccttaatgataaaatactttattactaacaatcgtctgagccctaggtgaatagtaacctttctgctgatggagggtcttgcctcaatactgatggctgcttactgatcagggtactggttgttgaagcaaggggtgactgaggcaatttataaaaataaggcaacagtgaagttagctgcatgcattgactcaccctttcacacaagatttctctgcagtacgtgatgctgtgtgatagcattttacccatagtagaacttctttcaaacttgaagtcagtcctcgcaaaacctgctgctgctttatcaactaagtttacgtaatattctaaatccttttgttgtcttttcatcaatcttcatagcattttttttttttttttgagacggagtctccttgtcgcccaggctggagtgctatggcgtgatctccgctcactgcaaactccgctttcccgggttcatgccattctcctgcctcagcctcccgagtagctgggactacaggtgcccaccaacactcccggctaattttttgtatattttttagtagagacggggtttcaccgtgtttgccaggctggtctcgatctcccgacctcgtgatccgcccgcctcagcctcccaaagtgctgggattacaggcatgagccactgcgcccggccccttcatagcatctttatcaggagtagattacatctcaagaagtcactttattagcttatccataagaagcagctcctcatcaattcaagttttatcacgaggctgcagtaattccatcacatcttcaggcttcacttcttattttagttctcttgctatttccacgacatcttcacttacttcctccactgaagttttgaacccctcacagtcatccataaggatgggaatcaacttccaaactcctgttaatgttgctattttgatctcctcctatgaatcccaaatattattaatggcatctagaaaggtaaatcatttccagaaggttttcaatttcctttgccaagatccatcagaggaatcactgtctatggcaactatagctttatgaaaaaaattttttttttgagacagagtctcgctctatagcccaagctggagttcagtggtgcaatctcggctgaccgcaagctccacctcgcgggtcctggttcaagcagttctcctgcctcagcctctcaagtagctgggattacaggcacgcgccaccatgcccagctaatttttgtatttttagtagagatggagtttcaccatgttgtccaggctggtcttgaactccttaccttgtgagccacccgcctcggcctcccaaagtgctgggattacaggcatgagccactgcacctggccaaaatgtatttttaaaataatatgacctcagattttaaattactccttgatccatgaactaaaagacgtgatatgtattaaaaggcatgaaaacaaaattatcttgtacatctccatcagaactattgtgtggatagatgcattgtcaatgagcagtaatattttgaaaagaatcttttttctgaacactaggtctcaacagtaggcttaaaatattcaatgaaccatattggaaatactatgctgttatccaggctttgtttttccatttacacagcacaggcagagtagatttagcatcattcttaagggccctaggatttccagaatggttaatgagcactggcttcaactctaagtcaccggctgcactagccccaacaagagagtcagcctatcctttgaagctttgaagccaggcattgacttctcctctttagctatgaaagccctagatagtatcttcttccaatagaaggctgttccatctacactgaaaatctgttgtttagcacagccactttcatcaataatctaagctagttcttctggataacttgctgcagcttcttcgtcagcacttgcagcttcaccttgcagtttttgttatggagatagcttctttcctgagacttcacccaccaacctctgctagcttccaacttttcttctttagctttctcacctctctcagccttcataggattgaaagtagttagggccttgctctggattaggctttggcttaaggcaatgttgcgtctggtttgatcttctttccagaccactcaaatttttccgtatcagcaatgaggctgttttgatttcttatcatttgtgtgttcactggagtggcacatttaatttctttcaagaacttttccttcacattcacaacttagctaactttctggtgcaagaggcctaattttcagcttgtcttggctttcaacatgccctcctcactaagcttaatcatttctagtttttttatttaaaagtaagagatgtgtgactttccctttcacttgaatatttagaggccattattgggttcttaactggtccaatttcaatattgttgtgtctaggggaaagggaggcccaaggacaggaagagagatagggaaatggctggtaaatggggcagccagaacacacacatttatcaagtaagttcactgtctttttttgtttgtttgtttgtttgttttttgagatggagtctagctcttttgcccaggctggagtacagttgcacaatctcagctcactgcaacctctgcctcctgggctcaagcgattctcctgcctcagcctcccgggtagctgggactgcaggtgcatgccaccacacccagctaatttttttgtattttcagtagagaagggacgtcaccatgttggccatgatggtctcgatctgctgaccttgtgatccgcctgccttggcctcccaaagtgctgggattacaggcatgagccaccacgcccggccagttcactgtcttatatgggtgtggttcatggcacccaaaaacaattattaatacaatagtagtatcaaagatcactgattacggatcaccataacagatataataataatttaaaagtttgaaatttgtgacaattgtcaaatgtgaggcacagacaccacatgagtacatgctgttggaaggacagcattgacagacttgctcaatgcaaggtcgtcacaaccctccaatttagaaaaaacacagtatctgcaaactgaaataaaatggaccacaataaaacaaggtatgcctgtataaaatacacattagtattctccttcaggcagatctagtgtgtttgaatccagttccgtatctcactgcctttgcagtgttaggcaagtcatattacttctcggggcctcagtttcctcagtgtaaaggaggaaataacagcttccatgtttaaggatggggtgcttgtccatgagataaatgcaggtgaagcaattagcaaggcatcagacacagagatagtgcgtagaaggtgtcagttcttactactaataatttactacgaataactatgacataatgcttactattaataacgtgtgtcttatacatattgcttttcatgtttattattaacaatccttgtaactaatgcagtgccccgttacccagcaagaattctatagtaataagtgttccgaaactacatattcctcactctaccaggctcctggctgtgcctctgccccacaccctcctttcccctctgccctgggacctgctttttaaaagcacatttgaacagagccgttttaaaacagagagctactgtattctgatttcctctctggcccagagtaaaacatgcttgataaagagatattattttaagggaaatgaggctaaacacacttttagtgagttgaaaaacaatcaatttaaaaccaattaaggtaattaaagaaaatgcccagtgaattaacgctcagattaaaaataacaaggctaatgaaaaacaacgctttcattgagttccccaattaacaaatcacattattattttgaacttgctgttcatttcaactcagtaaaagtgaaattttcttttaataagcttcatgtctgtgcttaggcaaatactttctatatatgttaatattttgtgtatgtgctcatatgaaaaatactaaattgtttgctttgccaagaagccgaaagaaataactagggcagtggtaatggttagcactctggtctctgaatccagtaactagggtgtctctcttgataaatcccaggtatatgatagggactcaacaaagagttactgaattaatgaatgggtattcacattttctaagatatcaacctgggaagggaggcgaatcaggggaaactgaagataaaagtagaaaacaaatgttttatttgaactgcggtgggtttagaaaacccaaaagtaaccaacatttaaaaatcaggaggtgagctgggcgcggtgactcacacctgtaatcccagcactttgggaggctgaggtgggcgaatcacaaggtcaggagttcgagaccagcctggccaatatggggaaaccctgtctctactaaaaatacaaaaaattagctgggcgtggtggcggacgcctgtaatcccagctatttgagaggctgaggcaggagaatctcttaacccaggagacagaggaggttgcagtgagccgagatcgcgccactgcactctagcccggataatagtgcaagactccgtctcaaaaaaaaaaaaaaaaaaaaatcaagaggtgttgcttaaacatctagatttccagcatctcttgatagcacagaagctctagaaacaatgggcctgtgtttctatacagcaactgtccctggcgttactaacagcggcttccttgatcagagcaagggctcctaggggctcctgcgtttgcctccagccctactcctcacttccatagtgacagagaggggcaattgctatgttctttatgcttgcacctcttcagagaaatagttctctggactgtttttatctcaagtgggcaaatttttgaaagcctcattacttttcttatatttgcctgctttatttatttacatacctggttggccctagaggtgtttgagataaatgtgacctcccatctactcgcctatacaatcatgaaagaggtaatgaatcaaagccatgtaatataatcagatgctaaactgatgctgcaatttaatccaatttagtgttccacaagctcacaaaaatgttcagatcgggagggatgtttgatgtacagtccaatgaccttattttacaaatgagggcccagaagcccagagaaggggagtgacttacccacggtcacacagcgagttaatggcaaggcttgagtcaggacctgaggctcctggtgccagtgtggagtcagggccaccagactccacaggtcatggaggttatacaggtggcatgtcctctgaaaatgtgctcagctgacgtgacatctggtaagggaggctggctgaaatctagtccttgcccctttggcatctggctcagagctgcttcagctgaaggaagccgccttttcttaattagcaataaagatgttatgaggactcaggcgagcctgcgtggtgtagttttcataaaggaaaaagtaataaaacagggtttttgagtcaaagagatctaggtttgaatctcggcgtgtccccttattcgtagtgacatcttaagcaagtcacaatatatctgggtctcagtttctctgtaaaaatggggccaagcacagtggctcacacctgtaatcccagcactttgggaggctaaggtgggagaattgcttgaggccaggagttcaagaccagcctgggcaacacagcgacaccccatctctacaaaaaaaaaaaggcagaaagaaaaagtggtgttgggcctgtagtcccagctactctagagactgaggcaggagggtggcttcagcccaggggttcactgctgcggtgtgaccatgccactgcactctaccctgggtgacagagaccccatctctttaattaaaaattatatatatacatacatacctatatacacgcacacacacactattaaaattatgttcacctatttctttttactttttaaaatgtgcctactagaaaatgtgtaattatacatgtggctctctctagagttccagggacagcactcccatggctgggggtaggggatgaaaataatgcctaacccacagagctgttgtgcccagtccaaagctggtgacataataggtgctcagtagaagccccattgttacagagtcacagagatgggttccagcaccttttagttttcagtctcctaacgtgcctacggtgctctcaaaaaaacgtggcaagaataaccccactctcccagcagcagcatgtcgtagggagaagagacctacgggcagccagtcggctttggcaaaatgcaattcaccatcaacagccctgacacccagaatttgagggttaggagagtgcaccttgattgttgggggccttggaattctactcaaagtcatttctgggtggctacaacatccccaagcttagatgcctcttggcttgcttgtggaagcctgtgtgccctgtacggtgagagggagaaaccaagattctctttgagctttctgtggctcctcttccaactgggaaaccttaataagactcagtctccacctctatgtggtgagaagaatggtatcttccctactgacctctctaggtcaagtgatatgttgcttttgaaagttcttggaaaagtttagagagcaactcaaaaagtaagagttaattcttgtcgttgtttccaaagaaatacatcttcagtgtggaaaatacccgtgagaaaaaaaaaaagagaattaaaatccttcttaatctcaccacttttgtaatgattatttagtgtctcattactcaacgtaggataagctgggaacccgttagaaatgcagaatcgcagatcctgcctatattagttttctcaggctgccttgataacaaaatgccatagactgggggggccttaaacaacagatgtttttttcacagttctggaggctgcaggtacaagatcaaggtgctagcagggttggtttctggtacagcttctctccttggcctgcagatggcagccttctttgtgtatcctcgtgtgtcctttcttctgtacctgggtacatgacactcctgatatttctttctcctcttataaggacaccaggcctatcagattagggccccaccgtatcacctcatttaactttaattacctctttaaagatcctatctccaaatagaattgcattgagggttagggttaaggtttcaacatatgaattgggacagggtgaacacaattcagtccgtaacgcagcccgagactcactctatcagaatctttattttgaccagatccccagtgattcatatgcacattaaagtctgaggcacactggttttagtgtacagtcttccagtcttgcttttttatatatgtttttacatatgtgccaaaataaaaccataagtactgtattctaagctattttgttcagcagtataatatttagcatatgttatcaacagtatcctgtgtcatttagtattactcagccacatcctatgtgatgaccacagcatattccattatacagatgtatcttaatgttcctaattacttccttatggttaggtatttatacggttttcagtttttcaccattataagaaacactgtaatgaacatccttgaagcaacattatttgtgtacagccatatctatcctaagaaaaaaaattgaactgaacctttttttttctggccccttaggaggccctcgccaagctcagtctcctcagccccagagatctggaagcccctcccaacagaggctctccccacaaggccagcagcccctgagcccccagtccggatctccacagcagcaaaggtcaccaggctctccgcagctatcccgggcatccagtggcagctccccaaaccaggcctccaagccaggtgccaccctcgcctcacagccccggccccctgtgcagggccgtagtacctcccagcagggtgaagagtccaagaagccagcaccaccccatccgcatctcaagtaagtgctttgggaattggaaaaggtataggatagagctggggtgtaggcagagcttggctgattcagggttagggacttggagacaaaggaagacccaacgaggccttgcctagacttcaaataggtaaaaacaggactagaggacagaatttgctggggaggcccaacaaggtgagagtatagattagacaccaccgtgaccctccgtgtatacacataccagccatttaccagctattgtttgctgcataacaaacaaccccaaaacttagtggctgaagaaaacaatcattctctttgttcataattttttggttcagctgtttgttctgagtttagctcagctgggaggttcttctgctggtgtctcctatagagttacagaataaaacataggatacccagttagattcacatttcagataaaaaacagataattgtgagtataattatgccccaaacattgcatggaatatacttacactaaaaaaaaagtcttagctttttatctgaaatgcacatttatctacacatttttattcgctaaatctggcaactctactttcctgggatcactcatacgactgcagtcatctggcagcttcactgaggctggatggtccaagaaggcctcacacacacatctggttgttggtgctagctgtcagctgggcctctttctctccatggggtctcatcctccccaaggctaagccgagctttcttacatggtagaactgcttttaaaaagggagaaagtacaagctgcaaggcctcttgaggcccagccttgggagttatgaaatgttattttatcacacgcttttagtcaaagcaagtcacagggccaaacccacattcaagaggtaggaaataaatttttggtaggaggagccatgaagtcacatctcaaaagggcaggctacagggacaagaggaatcattgcagtcatttttgtaagccatccatcacaatacacatatacatcctgtttcctctcaggcccatctcttggtttgtcctaaagagaggtcccaagtaactgatctttggaaagctctaccttctttcaaggccaaatgttgatcatcacagttcacagctaacagctattgtccacttactatgtgccaagcactttacttacttgggttttttttaagttctcacaagcttaggagttaataactatttcttatccccattgtacagacgagtaagcaaagaaagattaaataacttgccaaagtttccagttaataactagaagagctgggattagacccacgacatccagtccagggatcatgctaacaactatttttttgaataggtaatatattcacatagttcaaagatctaaaaggtatcaggccaggtgtggtggctcatgcctgtaatcccaacactttgggaggccaaggtgggtggatcccacctgaggtcaggggtttgagaccagcctggccaacatggtgaaaccccatctctactaaaaatacaaaaattagctgggcgtgctggtgcacgcctgtagtcccagctactcaggaggctgaggcaggagaatcgcttgaacctgagaggctgaggttgcagtgagctgagatggcgccattgcactccagcctgggcaacaaagtgagactccatctcaataaatcaatcaatcaatcaatcaatcaatcaatcaaagatgtatgttgaaaagcctcgttcccgccccattctcatccaacgctttgctgcccccatccccagaaatgacttttgttagttcctatgtgtcctttcagtgcttccttatgcaaataaaaatatttgcataaataaataataaaattgttcagatcctcgccctcattttctcacacacacaggagtattcactatcaacaccattctgctcactgcttttcatgtttaataataaatcctgggctggatgcgatggctcatgcctgtaatcccaacactttgggaggtggaggggggcggatcacaaggtcaggagatcgagaccatcctggctaacacagtgaaaccccatctctcctaaaaatacaaaaaattagccaggcgcggcagcgtgcgcctgtagtcccagctgctggggaggctgaggcaggagaatggcgtgaacccaggaggcggagcttgcagtgagctgagatcgtgccactgcactccagcctgggtgacagagcaagactccatctcgaaaaaaaaaaaaatcctggagcaccgagtttcttcgaattttattttttatggctgtatagtattccgctgtaccattgtactataatttatctaactaatccatcacaaatagaaacttggtttgatcttacaaataatgctgcaattaataaatctgaacatatactttcatagttgcaagactcactctagagaaaataacctgacatgatattgttagatcaaaggataaatgtatttttagtttgacagacactagcaaatggccctcctggcaatatggaatagcagttgacagcacagactctagagtcagactgcctgggttcaaatcctagctccaccacttaaaaactacacaacctcagataagttgcctaacctcgctgtgcttcaatttcctcacatgtggaatggggacaataaccgcacagggttattataaggattgcaatgagtttatgcacagttggtgcttagaatgctgctgccactacagaggcttatctgcatacagcctgtcaccacataaggagatcagccaactaatcacaggacagacaggggctctgggccttaaaccaggtttggtcactgaccttacagtgttctagctaaaaacacataaatttcctgacttactgctttaaagaacttggttcaattcaagtcagcaggtatttactgaatttacctactctgtgccttgttctagataagactctctgaggggtaataagcaaggagtaaaagacagtccctgcgttgaagtccccagtttttgttttgtttttttttttgagatggagtctcactgtcgcccaggctagagtgcagtggcgccatctcggctcactgcaagctccgcctcaaggattcatgccattctcctgcctcagcctcccgcgtagctgggactacaggcgcacgccacctcacccggctaattttttgtatttttagtagagacggggtttcaccgtgttagccaggatggtctcgatctcctgaccttgtggtccgcctgcctcggcctcccaaagtgctgggattacaggcgtgagccactgcgcccagcacagtgtggtgcagtttttaatgtgatgacagcatcacatgcagagctcttcaacttttgacacatttacataatctcttcctaggtctgttgcctcccctcctatgactgagcctcctgaggcagggcctgaatcatattcgtcttacacccctgtcccctagcacaggggaagtgctcagcaagcagttgctacaggctggcatttaggaagcactcagaatggcatctgccattcaaaaagatggcactaaaagaattccaaaagcgggtgggggacagaattagccataaagacattggagaagagatgggaattgaagtccagaatgtcagagctggaagaggcctgagggtcagcaggacaaacccttcgctctacagatgaggcaaaggaagccctgagaaggtaagttccttgcccaaggctacacacatcaaagagcagagaaggttctagaatacaggcctcctgatacctaaacgagtgctggaaataactataacctgatgttgatacagcacattgcagtttacaaagtgggtttgtacccataggcaggagagcagccaagctactctccagcaatgcctgctgcctcaacagtctggtataatggaaagaatgtggcctctgggtgctcccccattacttgctgtgaggaccggagcaagttacttgactctgtgaacccctatttctgaacctaagaaatggggaaaataaccaccttgcaaattatgtgtgtaatgtacctgacatcatgtaagcattggaatgcctggtttctggtcttcataaccttatgatgattggggtagcccatctggcttacaggcaagcccccaagacccatttctttgatagtcttcgccttgtcttcctcaacccccttgcctttctgtttcagcaaatctcagtccctgactaacagcctcagcacatccgacacctcccagcgtgggaccccaagtgaagacgaggccaaggctgaaaccatccgcaacctgaggaagtcttttgccagcctgttctctgactaacgccatccaggctgggaggggaagagtgctctgctacactcgtccccctcctgcctcatcttccttctcagccttggttcctgatgggaacagaatggagggcctgagaacatactttctaaatgcctttgacccaggaaccgattatctatatttgttcccattttccttcaccgtgacattccagcattgtctgactgtgaggtgggcctttgagagcctccaggttcctcaaaacaggcctgagcgatgggcatcacaccctctgcctacccacgtgcctgcttacctgccagataaccaagtgagatgtctgcgagtggctagttttcacattcttactagtgtttggctcacctttgggcaaaggccccctctaggccttgccccacctccatcaaacgcagacactgtagtcagacctcagcaatataggaggcaataatcttttaacagtgttttgcaaacaaacaaaaagagaaaaatcccagccaggggaactcgccacctgcccacgctagttccatccacgctcaagacccgcccttagaccaggcaggcaaaggcccccatcacactcggccactagtggggtcctgaggccaagaaagaaaccagaccctgtatgacaagtggggtctttcagaacacgacagaaacaggggggcccttgtaatgccactcatactcagagcattattcttatttggacagccaagggcagatcacaggttattgtaggaataaagactagtttacaaaggagaaagaggccctggacttcccaaggaaagggtcaggttagggctcctgtacccattctgttccaccactgtttgatctctctggcctcccaccaggaatgccgtttcctttttatggatctgttgggaaccagagagaatcaacagatcaatgacataggatccgaagtgcaatggtagtcacttctagtttggcatttcacaaactctgtacagcaaggtattggtaggttactcaatttcaaaagggccccatggccaaatatgtttaggaaccgctgtttgtatttctttttttggagacgcattgtatataatatatgtcaaaggctttcggaattcctgcaggaaagaaatcagctttgttaaatccaaactgatgatttgactcaataagttagttgcagagctggaaaaagtagtctaactcccttcccagtgctctttcccctataccagtctgcctctcatgcttagacagcgttcagcggtgatccaaatcaccaagcacctggtgctggaaacattgtaggtgccagaagcagcctcctggtcccaaagagagcccaagatattagaacatagccatgttagccccttgcctcccacttcgcaacatgagatatgtcttccttttgctgtccacagggaagggagagagggaggtaaaaatggaagtggctttggcctggagcagcttctagttatgcccaagcaatgtagattgtttggtaatcagccaagatccatccaggttcccaggagcataaaagcaatcatctcctttttggtccttcaaaaccaaactggagtggtgacgtcagggccagagaccctctccttctgtgggcattggatcacttagaactctcaacctcagaaaagcctgccttcaagctggcttttgacgggctattggctggagactgggtcagtattgaaagtgctagctgtgcacctggctgccagaaagccacttggcctttaggacagtcctcttcacattgccctcttccctcactcatgatcaggtctggatttaagagcaagagaccccaggataattcagaagtcctctctctcctcctgttcaagactcttggtctgggattcaataataagtagcagacctgacataagaaagatcagataggtccaattgccagtgactattgggagccataatttggcaggtggagactggtaggctcaggcctgattaacactggctaggatcagcagcaaataaaatagccattgtgtgaggtgagaggtgaagaggtgaaggcctggtactctttctagcgcccaaaaagcccaccacccttactctgtctccatgctcggctgagttccatgttataggacagtccctgcatgtctggcatgtctggagctcactctgcccagtaacacatctcccttctttttgctcagcctgtgcaatgcaacagaactagtctggccaggagctggcagaatcctatccagaggcagctgagatgatgcagtgggcagtcagacacatgaagctgctgctttgcaggcatcactgtcgacacattcttctagacccccaaggtgggtggaggtgggggtcctggggtcaat

SEQ ID NO: 14204 - DNA, 10765 bp, Human
ttctttccttatagcattggccgagacctccacgacaatgctacacactgtgaagtagtgattgtgagctaagactgtcacttatagaaaaatcatgtattcctagaagaaggttttcatttcatcttagctagaggacatggagcacttcaggaaactatttcacaaaaatgtaaattagaaactgtgtctggtagccaataatccatttttaacagtggccctgtgctcatctaagcaacagaaattacttttgtataggagatggcccttccaggggagaaacagctcagttgtgatacacttgtcttcatcctgactttaagtacatttaactccacactaaacccttgtggccacaacacagctctgcacctgtcatttgctctagacaaactgctaaacgcaattgtttctgacaatggattactctgtatcccgtgggggaattctcagacagcagcattagaaggggccttagagatcaaccatttctcttattttacacacacctaaaactccctacagccgtgcttcatcagcttcgagcagatgagccacccagaaggcagctccagttattaggtcctagggcctgggtgtagtcaggccctttggaagctccaagtcagagatcaaacacatcctccccactacccacgcctagggtgactaatgcctgtgggaaaaacaactgaactaaaaagtcccacaggaacctcaaacccagcacatccaaaatggaacttctcaccatctcctccaaactcagtcctcttatacagtaatccctgtaaagctagaacaatctccattccccattctcagggccttcctctcccgctcacctgaggagctaccaagccttggcccacaagccctctgagagtccctcctgcccaccctgtgttctccatactgaataaggacttggccacaccttgtcaactcttccctctgctctactcctgacccctggatccatccttcatgctgtggctgaagggatccccccatcatgcaaattctgccacatctcccgcctaaaacccaggaagactccccactactctcagcacagaaagtacactccttagtatggcatcccctgccctcatggcatggccccatccagccctccagcctcacaccctgcaaggacacctagacccccacctccctcaacccttcatgactgcgcttctgatccctgtttcccctggctagaccctgcgtgccctcccgctggaagcggtctaatgcctgcttgtttttaacactcaggttggggcccctgcctgctcccgggagcctttgctgactcctggaccccgttgctccggctgagcgtgggctctttctctaggtctttcctcccaggactctgtgtattcatcctatcgttaaactggattctctacaagagtaataattgcagagtcagccagctctcatcccttttcaggtttcagaaaagacctgtgaacaaaacgccttgagtctgatttagtgtggcaatgccccaagggtcctgttctccctgggtgtcctgcacctggtgcaacgtcggcctggcatctagtgagccatctaaaggaacgatgatgagtgaatgatttgcctaccccttccagtactaggctggaggtcgtggttagggcccatccctacgcaggacatgcaaagtgggaggcactcctctctctacgtcggcagggggcgctgcacagctgcggggcggggtagcttagacacggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagccccgcgggccggccgcaccgcacgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagtgagtactcagcccgccaggtctttggctcgctcgggtgcggaggggcggctgcttgggaagagtgggtagaaactcaagtctgcctaaggagagactggaacagcagcagccgtctcctgcaaagaggaataagaataggggtctcaccgtgtgctaaatagggcatgtctcttttcatctcgaaacagcctgatgagctatcattatgcccacttcgtagaggagaaactgaggcccagcgtgggagatttcctgctttcctgcctagggtccctcagctacaaacagaaggcagatcctagccagttctaaagtcaggcttggccgggtgcaatggctcacgcctgtaatcccagcactttgggaggccaaggcggacagatctcctgaggtcaggagttcaagaccagcctgaccaacatggtgaaaccccgtctctactaacaaatacacaaattagccgagtgtggtggtgggtgcctgtaatcccatctactcgggagtctaaggcagggaaaattgcttgaactcggaggtggaggttgcagtgagccgaaatcgtgccactgcactccagtctgggccacagagtgagactccgtcttaaaaaaacaaaaaaagtcaggctttctcactccactgtttttaaaacactgggtcccaagtctgactcagccacttcaccacctggtctgggtttccctgatcaaaaacatgtaggctttctctgggtgagtgttgggttcaacacccttgtccaagctcatctctagaccctcacagggagctggcttctagccctagaatagagtggcgctttgtaataactcgagtcatctctcaggtgttgaaggaaaagtgttggaaatgggttgagggaggtgggtgccaagcatgaatggatgggtgaaggtggccagaatggagggaaggtggtgcaggcaggccatccaggctgaagctcctccacctgctcctcttccttccaggcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggtgagcctttcctgtcctctccactgtggacctgcaccctccctgaggaaggggcctctgatcctcccctctggtacctgatggaactgcagagaaattgtggaagttcattagcagctgtcaacagcaggagagggaactttacaaatggcccaagtgttaaagagtcctagtgaaattgtgtctccagagaaagcaagagtagtaataaattataatgatgttggttttggctatgtctacactgagtaaagtggatatttgcagtgttcctgtagcctgccaacagagatagaattgtgtcaggtccacatggtttctctggcaccacaccactgatcaatcccggaaatagttacttgggtgcatactctgtgttggggggcaggggtacaaagatgaaatagccttgtccctcctgctgcccaccagcttctacttggtgacacagttccttcttggagcaacacatctcagggaggactatgacagtgcacatgcagccttcattttctagggaagagttacctaattttatttacagcttcgttcttttaggtttcatattttaatgtaaaaaacattgccgttaaaaactgctccagtagctactgctgcaaaggctaaaggctaatgttttaaaagatgtcctctgcctttctgctctctaggaattttttcttgagtattttctagcttgttgccttaggaatatcttaaaataagctcaatgccaccaagccttcttaaagggctcctttcccctttcaatctttcataatgtgctgtgcattgctcctcacaattcaattaatcttaattggacagggggctcaagtgaaaactgctttgtttcccgaagaaaggttcaaaatgggtaacttttaggtgctccaattcatatagatttttttgtgcaaaagctgacacccctactcccagatatagtcctaagggtcaaaagattatagaaatcaatttaatgttttgtacatcatttgtcaaatttgctgtagtagaaaacaaatgaggtagatgcaagtgattcaccggccatatccagggcacaggtttgtagaatttgggctatatgtttattttttagtttgatgccattcaaaaaccaaacatttcaattaagatttcaaaattctagcttctcttgaaaagatctgaagaacaacactggactcacacctccaaatctaactctttataacctgctcagaatagtggggttgcccaggtctgtttaaacacctccgggaatagtgtattcatttcctactgctgctgtcacaaatgtagtgggtttaaatgacacaaatttattatcttacagctctgggcatcagaagtccaaaatgggtcctactgggctaaagtcaatgtgtcagcagagctgtagccctttctggaggctcttggggagaatctgttgccttgctttgtcaggtctagaggctgcccacattccttgacttgtggccccttccattgtccataccagcaatgtctggttgagtctttctcatgctgctccctctggactgaccttctacccgcttctacttttgaggacactgcttacactggattcacccagataatccaggatcatctctctactcttagatcagctgattagcaaattgaatgtcatctgcaccttcattcctctttggcaggtcacatagctcattaccgggttccagggattgggaggtggatgtctttggaggtggagaattggtctagctaccacagaaagggattttactacttgtgcccaaacgtattctgaattttcaggccttgcttcttggctcatgctgttacctctgtctgaaatttccctcctccattgtcgacactttactcctcttaatgtgggtgtcccaactctaggaagctttgcttcccttcctgcccctcctcagaagcttcatgcccttctcaccatgtctcacctactgatgcctcctggtcatttgggcaattgtctgtctcagcagctaaacttgcaatccaggagggtatacatggtcctcttctctgtcatgttcttagtacctaatggagtgcctgccacccattaggctgttgaatggaaaaatgatcgtaatcttcaatcatacagtcctttacttcctaagatacatttcataattttacccaacggtgctttccaacacactaagatgacatctctgtgtatgtgtgtgcgtgtgtgcactgcaaattaaatctcagcttgtcttaagggtttgcatgtttgttatatccatcaaactgtgaccttaacagttccccctttagaagttatacttgaaataggtattcatagaatacagtcactttagcaaaagaagaaacaattttcaccagaagcaagtgtcacagtgaggtgtggaggctggttagcacaggctgttgacatgatttattgtgtttacataatgaaaaaatatgtaatccagagaaacatgccccaagcttagggagaggagggtgagagacagaatgtaaggaatctattttcttttgtattatgaagaaccagaatttcctgcaagtcaaagtgacagaggtcaagggcagccagccggagccttcctggcaccctggcttaccagccttgtggggtgccaggtgcattatcaatgttataaactgagtttctccttcattttttataggccagacaaactctagaattttacccttgcacttctgaagagattgatcatgaagatatcacaaaagataaaaccagcacagtggaggcctgtttaccattggaattaaccaaggtataaaggattttcctcccagagcatgcagtgtggttaaaaactgtgcatcaaatctcacctgcttctaaaaattcacgtttctggtatccatcattatgggattttaactggtcctacttcagaagttagatttgggagaaaaattatttttaaaaaatggttttttttgcaacaatgtgaatacacttaacacttaaaaatagttcagatgctaaatattatgatatgtgtttttaccataataaaaaaaatttgagacctgaagagtcagaaagatttatactaagaattaatactttgatatatgattttttccctctagaatgagagttgcctaaattccagagagacctctttcataactgtaagtcaaaaaatgaaaagtttcagcctgtatgatgaattcatatcactgatgtctgattattttttcctctagaatgggagttgcctggcctccagaaagacctcttttatgatggtaagacacacagctctttcctcaaatgcaatgggggaaatgtttttagcccatctcaatggatacttccccatcttgtcatgtcacccaggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggtaagacttcattctatcagtgagagcacctttttcatgctaaagataaccagccagggtctttgataaagagatataaaaagaggtctggaggccttttaaaggcctgacagacctacattttcaagaagacagccttgagggtgccgtctatagggagcacaaatgtgagcagatcacattatgaaaagcagactccaaagtattcactctgtggtatcccccacactcggcaaatgtttttgtgcattttcttatgtcagcctcaaaacaaccatatgggatctgcacaaaggagggaaccaaaccttaggagagttaaaccacttgtctgaggctctgcctcttaaaatccttcaagaggatttcactacacttaccttctcactcacctctaaaggctccaggacgtgctccaggatttgcatgcaaggggccagtttgcatatctgcaaatattgctgggaaacaagcaagattggtgcctgattatgacccattgtgaaccaaaatgtgaaccaaataaaagaatgacctatcatctggggcatctataatgttattcataggcaagaacttgctttgttatgttctgaatcaccataacacagatgctaatataaaacaaatatttatataagtgagggtgactgctttggtgacgaggacatgggataaaaatatggtggcagaaatcattgtctgaaaagtaattgttttacttttattcttttcgtgtgtgtgtgtgtgtgtgtgtgtgtgtgtgtgtgtgtgtgtgcatgtgccagatttcttgtttgaaaggcaatgagcttcatccaagtatcaaagaatgttagcatctagagagctgtagttgctatttcatttttaggaccaagagttgggtgatttgggtgctagaatcaattctaccagtaaccagacaactattcccaagtcacttaacccctctgtgcctcagtttcctccagtataaaatggggtgactttattctagctttcttttagactttttgtgaggaagatatgaaagtatttattcatcaagggtgcaaatgtaaggttttatattctgttatcaaatcaaagtgctaaacttgggaaattcattgccaggtttatctgacacaaatggcatgtcttcagtaaacaggcctgttactgatagtgagttctgatcaatagcaatccatcacctccctgtgctaaacagaagtgggctttttaatgtaacatatataaaattaattagatattgcagcagatgtcattttaaaggaactgtttctttctaagacacaactcccactgatgattttttctaaatagttttaagggtcttttcagagctcattgaagatggatgtgcttggaaaatgagtatttcttttctcattctgcctggtgatctggctgagagtagatttggattgggtttaggagtggcataagggactgagttgcaggctctgagacatgtactggcttcactcatttttatgaatgaatatttgaattttggaataccatgtaagtcatgcttactgttcattctcctaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtgattctgcaatttttctaatgtacttttaagtgttaaaatatacattgtgggaaaattgaaaactctgatgagacttcaacaaaattactctggaaagaatgccacaatattcttattcctttcctagtccctttcatctcattttaaagggaccctagtaagacaagatatgctttactactaaggcagccaagtgagtcatggtttttgagggtttattatttttgttcaacataagactaaaagtatgctgtgcattagaaaaatacttcatagtattcttcaaccagaaaaaaaatgtcactaagaggccttctagcctaattattctaatttttgtgaccctttgggctctgagagaaaagttgtctctaatttgcaaccagaaaatctctccatttgtttaaaactgtatagaacttttgcctgaaccacatggataattgccttactttggcttaagagatgtgctcttaatgagctaaatgttaaattccatctttttaattctctaaaccaggagtccccgatccccaggccatggagtggtactggtctgtggcctgttgggcagtgggccccacagcagtaggtgagtggcaggtgagcaagtattaccacctgagctccgcctcctgtcagatcagtggcagcattagattctcataggagtgtgaaccctattgtgaactacacatgcaagggatctaggctgcatgctccttataagaatctaagtaatgcctgataatacgaggtggaacagtttcatcccgaaactatctttgccccctgccccccgggtctgtggaaaaattgtcttccacaaaaccagcccctgctgcccaaaaggttgcggaccactgctgtaaatcatgtaaatcttaggtttcatgacttagttcattttgtactgctgtaacagaatatctgagactgggccatttgtaaagaacagtgatttatttttttactgctctggaggttgggaagttcgagaacaaggggccaacatctgatgatggcctttgtgccccatcatcatatggcggaaggtgagagagagagcaagggggtgctgaacgtgtccctttataaggaatccactcccatgataacagcattaatccattcatgagggcagagtcctcattgcctaatcacctcgtaaaggtcccacatctttatactgttacaatggcaattaaacctcaacgtgaggctgggtgcagtggctcactcctctaatcccagcactttgggaggccgaggtgggtggatcacctgatgtcgggagtttgagaccagcctagccaacatagtgaaaccccatctctattaaaaatacaaaaattagccaggtgtggtgacgaacatctgtaatcccagctactcgggaggctgaggcaggagaatctcttgaacccgggaggcagagcttgtagtgagccaagatcgcaccactgcactccagcctgggcaacagagcgagactccgtctcaaaaaaaaaaaaaaaaattcaatgtgagtttgggagggggacacaccacattcaaaccatagcaattcacctgacacaatacaatttaatgttaaggctttgataatccattcctccttaatagaaaaaggacctaaaatacaaaatattttgagtgacccctttcctcagttactcctcccaactgaatcccaatctttctccctgtaaatgtgttatctccttcccaggtcctcc

SEQ ID NO: 14205 - DNA, 130971 bp, Human
ccccacaccaaatgactccaaatagctgggattgggcacaggcattcataattgttttaaaacaccaggtgatgcaaatgagcacccagcatcgagaatcagtgtgccaagacccctttataacagacaccttgctcaacctgtcccttctttcacctgcacctatattccacccttgtatgcccacatacctttttgttatagttgacaatttccttaaacaggttctcctcttcctcatatttttgtcctgttcatacagttaccttattgacctgagaccacatataactggatagaggtaataattactcctgtaacaactgaccttggcaggcttttcccaagccttattgactctgtttttcactctttcacaaatatgtatccttaacatcatcatccacgattgagttaacctgtgatagtgttgctgtttttgactagtctcttagcaatcaagctaaatctcccactgaatctgtgtgttcctctacaaaccatatctgggtggaatgtacgtttttattgtgatataattaatatatcataaaagtcatcctcttaaagtatacaactcagtggtttttagtaattcacagtattgtgcaaccatcatcactatgtaattctagaacattctcattactctaaaaagaagccgcttacccattaaaagtcacctcattcctgcctcccactcgctgcaaccactaatctcttttgtctctatggatttgtctattttggatatttcctatacatgaatcattcaatatgtggtcttttgtgtctggcgtctttcgcttagcatattttcaaggttcatccacgttgcagcatttaccagtagtacttcattcttttttgtggccgaataattttccgttgtatggaggcaccgaattttggtcatccactcatcagctgacggatatttgagttgtttccaatttttggctattgtgaataatgccgctataaacattcatgtatatggttttgtgtgggcatatattttcatttctcttgggtaaatacccaggaatggagttgctagatcatatgcaaactctgttcaactttttgaggaactccaaattggttgtgaacattattttttgacctcaatgcagctttcctttacaggagggaggtggactgtacttgttagcgcgctgcaaatgattctcaggcatattaaacatttttctgtattctgttaaacattgtatgcgcagcaagaatgacgcctcatacagacctttcttgtcatttcgttttattatttcaaaatgtaagacaaatctgaaaaatggaggagcctgcagatacctgtggtggcgaggatttggggtctgtctgagctccggcgttcctgcccatccctccagctgtatctctggccacctgtctgttcctggcacaaacaaggcctgctggttgccaaggacatgactacggggccatttccatgtgagaaggccctggggggtgtcaaaatgcagaaacgtgactgatgggcagcggggcacccataaacttcccatagccaggtgcaggcatacctgcaaatgtaacgcccaactgtgtacaaagcagaaatctaaatgccagggcggactgggagaggttcccgtgacctctgacccggcctctaaattctcccattccctccccactgtcctgccgcgccccgtgtcgcctcgcctggcctcgcctggcctcgcctccctcctccgctgggggtctaagcctgcgcagtattgcgaacgcgggcggcgtttcccgcatgcgcagtcactgcccggcccggctttttcagtaggagccccgcgcggtgcgcgctcacgcacgcgcacggcctcgcctgcgcgctcacgaggcctctcgcggcacgcgcccccgccccgcgccgccccgccccgccccgcctcttccccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctgggtaagtgcccacgccgggccggtggccgagtcgctgtccatcggtccgtatgatgatgctctgagaaaagaagtggggaggaaaacccaaaccaaaaatcaaatctgggacccctctttaaggagacaggcgcggggtgctgggtcggggctgcaggatggcagggtgcgggtcggggctgctggaaccctagacctcgctccgcgcaggctgcaaggggctgcggagtgtcggtgactgcaggttgtcgaccttccaaaaaaaaaatgttaatgcattagtttcttttataatctcccgggatagggtcagctcctggggaaagttgcgggtttattcgtctgttttcctcgctgtacacctttctctcccttcccctaccagccggttcgcggcgcctcttggagctaacctgtggcgggctaggagaggacacgggagcgtggggtttaatctcagattcccagttattcctgaccccacggggctgcgggagggaggcaccagaagcaccgtgcctgcctggctgggcaagggcgaccgaagtctcccaagcgcacgatggggagcaggcgttgtcaccgcgtggaggcgcacgaaagggagagggtcttacataagccgggggcatctttgaggtttcttggtgacccaagagatgagtctttggattcctttcccacctccctgcatccttacactccctatctggtggttctgtcactgcatgagcacaatccgcagcgccctggcagagggtcccctccacttggtgatagagatagcgccccaactctactccccatctatccagtgctgccgccggtccttgaagctcaatgcagaagggtgacgtcacccctcagccagggccgcggggggctgcgtggtgcacctcgcggagggatgcgcctttctgcgcgggggaggggggaggaggaggagggggaggaggaggaggaggagggggctccaggcttgtgccttacctcatcctgtttggcaaatcatggaatcagtgcagggctgacactgcagtgattcactgagagaggtgcgtggtacttaaagaccattccctgttatttctcttttcatgtcggtgaccccgtcttccctagttccttacgcccataatcaagctacagctaccccgcaggggaatgaatatcgaccctcttccccccttgtcccccaaatctgggtcattttagcttctacggcagtcattttgaaatctgaggctctgtaggaaaagccagttcaacctttgcttgttttcttcttgcacccctcacccccgcccctcacccaccaccatatattagccctatttttgctttgaaactggagcacagtgctgtatgaggtaccgagaatcagctagatggcaaaccggactgtttgcaatggtcaaggaagaagcagagatttattgaggatcaaaaatattcctaatgcacccggacatttccttatcgctggcgttggtggttcttcaagtcagggaaggtatggactccccagaccacacataccaggagctctgcaatgagctaggatagattaactggcatattgcacaaggcaaacacagaaacggactttatttggactgacaacgacacaggttgaaatgtctcagtagtggaattgtgagctatgcacagatcatatcatcttatgctctgcctgtaaaaagcagtaacacatgctgattgctgaaacttcccagtagccattcctgggaactggtttagctttttatgtgtttccttaaatctctttttgtttggccctttatcatttacttgacttcctatttgttactggagtgaatcatattgggaggggggaggtatttttatcttccttaaaaataaggttaacagtgcacatgaagaaatattgttctttcagaatcactgcaagctggtaaagaagggggtcttccaggctgaggcttttcatatgagcactttaactctccttgcttacattccacccctatgaatctaattacttaatgcccccaatacatcttaaacaatcactgcattttatgtcctccggaagttccttgatgccttcattttaattttttctactttcaagattttcatagtcttaaatgttaacctggaacattttcaatagtttaaataccaaagccagttctggctttggttgttgtaatcatttcatacttacaaccaaaagaataagatctcttcggatgtgtgaggatattttaaacaagacgttatttttaagtagccttattgaggcatgattcatatgccataaaagccacctatttaaagtatacgattcagtgagttttagtataagtagcacatattttagtatataagtggtatatatttctgtatatttagtatattcatagatatgtgcaaccatcaccccagtcaattttagaacattgcatcatttcacaagaaacctgtttctttagctgttatcccgtttaccccccaatttcaacttcccaccctcatgcccaccccctgccagccctaagcaaccactactttctgtctctagagatttccatattgcaggcatttcatataaatgtaatcatacaatagttgcccttttgtgactgtttttttcactcagcataattacttcaaggttcatccatgttgtagtgtatatcagtacttcattcctttttatggttgaataatattccattgaatgattatagcacattttgtttatccatttgtctgttgggggacatttgagttgattgggtcatttagctatcatggataatggtgctataaacattcatgtacagatttttgtgtgaacatgtcttcatttctattgggtatgtacctgggagttgaattgctaggtcacatggtaattctaagtttaattgtttgaagaactgccagcctgtttcacaaagcaaagcactccttccctttgaccatgaggattccaatttctccacatccttgccaacatttgttattgcctgacttttttattatagccttagtaggtgtgaaggtggtatctcactgtggttctggtatgaatttccctgatgtgtaatgatgctgagtgtcttttttatgtgcttgttggtcatttgtgtatctttcttgaagaaatatttattcatatcttttgaccatcttaagatgtggggtttttttatattaagtagtaagagccctttatatattctgagtacaagtccctcatcagatacatgatttacaagtgttttctcctattttgtgggttatctttagatggtgtcctttgaagtacaaaagtttatttttatgaagtccagcttacctattttttctttttttttgtttatgcttttggtgtcatatttgagaatcctttgccaaaaccaaggtcacaaatatttacctgttaaatgtttataagaattatctctcagttcagtaaatgcagttggtaaatctttcttcagcacttagaactatgtctggcacatagtaggtactcaaatatttgtcaaaacttctgggattatgctaggtagtttacaaaaagatgaccttactggtcttgtttgtttgtttgtttgtttgttcgaggcagagtctcgctgtgttgcccaggctggagtgcagtggtgtgacctcagctcactgcaacctccgcctcctggattcaagtgattctcctgcctcagcctgccgagtagctgggactacaggtgtgtgccaccacgcccggctaatttttgtatttttagtagagacggggtttcaccatgtgggccaggatggtctcgatcccttgacctcgtgatctgcccgcctcagcctcccaaagtgctgggattacaggcgtgagccaccacacccagccgaccttggtgttctttaaagtggaaggtggaggaaagattagacagaattatttcctttgtgttcgtgagttgttttaataggaatttttccctttcattaccttaatttagatttagaactagaaggcatttgaacttaaaatggtggtagagcagtagcatcataaaggttgacatacttgagcatatgttaaaccagaagtctacacttttgaaagagagattattgttttatctggctttctctcctgtctataatcacactctctctctgaggtgtttctctaaagtggtggttctcaaaagggggcagttttgcccccctcccatatttggcaatgtctggagacatttttggccatagctggaggggaggatgatactggcctttcgtgggtagaggccacagatgctgctaaacatcctacagtacatgagacaacccctcacaacaaagaattgccttgctcaaaatgtcaacagtgtaaccaacctctgcactactggacttacatagcagtaagtcctgtgaagaaaaaatggagcgttatgcaaaactgtatatttattggtgtttggaaccaccgtagcagagcatgcgcaacacaatcacgtgagaagaaaaacattctctattgtgtactatataattatttgaagacaaaaggtaggtacctctttatataattgtgtttgaatggatgggatgatttgtcttttggttaaataatatcacctgaatgctgtgtaaactgatccttcatttctcctgatttgtatgttttattttcaggtctatagaagaggagggaaaaacacacctaggagtaagttatcctgtgctttaaagactagcaaacaatgtcaggcttatagtaggtttactcactaaatacttatttccttaatgaatgaatgaattaatgaataaatgaaattttattgactactcttgggctcagttatttatttcaactcacctcaatgggaaagtttttttaaaacaatgttatttctagtctacctgtagtgatttaaatgtgctcctccaataaatatgtgaaaagatggaatagcagatttcacaaggacttgcttatcctaatgatagttcaatcattatatttttgtgatcagttagtttgtcagacattttggttatttaaatttttaattagaattttttaagcatgaataaaaaagatcttgccctatatatatataacaaaatatcctttcttcacaaccaatgtaactgtttcaagatcaagcaaagaaatgtaataaatattttgcttaccaggtgaatttttgttttatttatacatttttaatgtattttaaatactcatctgagttctaagctaagatttaaatccaccatgtgtgaagagaagttccccttgcttaattcaagtgtatattgggcctgatttcttgattatctaaggaggtaattagcttatcaatagtgctatcaaattcttctatgataaaatatcagcgatttgtttttcatttgagaaacatcactaatcttttctggaaaaataatttaaaacaatttttttttttgtccagaaagtttaggtacttgggatataaatagagggaaaagtcttaaagagcaactcctaacattttaaagagtgtttgaatttgggcactgtattagtctgttcttaagctgctaataaagacatacatgagactgtaatttataaaggaaaggggtttaattgactcacagttccacatggctggggaggccccaaaatcatggctgaaggcgaatgagcagcaaagttacatcttacatggtggtaggcaggaaagcttgtgcagaggaactcccatttataaaaccatcagatcttgtgagacttattcactatcaggagaacagcatgggaaaaacctaccttcatgattcaattatctcccactgggtccctcccacaacaagtgggaattatgggagctacaattcaaaatgagatttgagtggggacacagccaaaccatatcaggcacatactttagtttatagttattcttttgcacatcaatacaattcagtcattcactgaatgtctattacatgtcaggtattgagtagtcaatagaatgtgtaccaacgtttactagctgctgcttttggcattttacctgcattttaaaataacacatgtattctatttctcaacttttcagttttagatgttatgtactgtcttcccactatggaagatgaagatttagctctcttgcccttttctcccatacttgtatcttccctatattgtagtagaccctaatatatcattttatcattgtcatattttggttagagtggtcgtcagtgatttcattatgttaatgactaggtaaacctagtcacagctgagccatgtagtgtgtatattatgattacttgcatagctttttgttttctctacagttaagaattgccttgtttggtcctttgctttttagttgcgtgctcactcctaatttatccctgtactttccccaagatctgtttcttcactcagtctgttcaaacacttcatgtgtcatatcagattcttgttctcagaggcatttctcccaaagctttctgatcttcaatctggactagtattttctgggcctttgaaacagtggacatcaatatagtctcccttcaccatcatcctggtgaatcctgtctccttttacgttggatcctcggtttttgagatgtcatgtctttctcttccttggtgtttttttttttttcattttggtagagcaagtttaataattttctggaaaaaatgatgtattgggggttaattttttgagctcttacaggtatgaaaatcttatttttctcttgcacttaatttgatcatttggcttagtgtagaattgtagtttggaaatcatttatcctcagaatttttctgtttctccctattccaagtcttgttcttgttgttggtgttgagaaatcagatgttattctgattcttcttgaatcctgcttttcttctctgaaagttcttatgatctcttgcttgctctgaaatttcacaacaatatgctctggtatatgtctattttaaactatttcctgggtaccctttcaatctggaaattttctgtatacctttcaatctggtccttgagtttggggaaattttcttttgttttttgttttctttaccttcatttttttctgtcctatttggatgttggacctcctagactaatcctctaattttctccccttctattttctacctctttttcttcttgttctatttctgggagatcacttccactttatcttgctgctattgcatttttcatttgtttcatatgttaatttctagaagcttctttttgaggtctgaatgttctttttttctagcatcctgtttttgtttcatgagtgtaatatagttttaatatctctctgaaaatattagtaatttttttgagtttgcttcttcctgcatagtttccttcagactgttctgttttctggcatattacaggcttacctcaaatttctggtcatgttttgctcttttttctgtacgtgtttaagagggggcactacgaagctgattggaagctcttagcctgaagtacgtgtttatcaattgtaatttgggtgatttggctgggcagttgagttttaggaccaaggtcaatatctttaggtctcttcttttggtctcatcagatatcctacagaagaatcttctaattgctctctgagtaaagaaggtgagaatatagaagtctctatatacagtatataaacctttgcttaagctcctgtttccagtgtagaatccatgtccactgtgcttatattccccagttcagggaccatctctttcaccctccaaagaataaatatctgaacctatagtagaatgagtagaggccagagacaggaagttggtggcgggggtgggggtggggaatctaattgtttttcgaaaaactcttactggaacctacttattttagctcccctttcctccctacttccaggtgtgcatggagctgctaacccctgagtcttttggggatgtttgggtgcaaatattttattttgtgcttctctcacagctgccataagattttgctttttctcagctttgaagagatcattgtggttgtctcctctctttgttattgtaggttaaaaacattcttttagtgtcatttcagtggagttttgggagatagccagggtaaatggatgtgttcaatccgtcatctttaactggaagtcctttatatctttatctctacatcagatggtactaattaaatacccagttgattgtgagtgattgaatagagcatctaaaacagcaatagtcgggctattctaataaatattggtacccagttttcaatttttaaaaagcttttggatttcaagggaagtgttctaagttggaacagacttactaagacacatcctctgtaaggtcgtctggtcatcagcgactggacaaatggaaatgaagctctgaaggttgctgctgctttttctgcccctcttatttcttcccaccagatgaagtcccatgtgtcttctgacctaattcggaccttgctggattaatttagtgtttatagtgtggtgtgtgtgttggggagaggaccttgatgttaaactgattattgcttggctgtttttcttttactacagtgataacccttcatggttattatgggacttgtacattataatctggagttttttcttattttatcaacttaatttactatacgcaatatacagttaggatgtgtgaactaccttttataacatttggggaacattaagtctttttcacttagtcgttgcttagaaattagctgaattttggtctaaatagaatgaaatactcttctccattctaatcacaactagagttcttgatttgaccttattgtgagttgcattacttattcagtgattgttctttatatactgctttaagtaagtacctcagaaggtgctgaaaattgaaagtcattgtgactgtgtttctttgtttaaacatgttaaactcttgacatagatgactaatgcactgctaaacccatttgaaacacactttaaaaatatattcttatgtatttttctcctttagttccattacagcagcttccaatctgagttacctcctcattgcaagcagatttttggaatgctgctcttaaatttcttattttggctgttattccccttgccatgacagaatgattttcattcttggctgaacatttttttcatcttactgcagaaccccactattcatcaagaaaaggatgtagaggaaaaaggagagggttttctttgttttgtttttccttttggttatttgatcagttaaacaggtaagcattttatttatttgtttattgccttttgaaacatttattattttatagatttagggaatacaagtgcagttttgttacatatatatattgcatagtggtgaagtctgggcttttagtgtaaagcatttaaaatagtttaaacatcacattttgactctggaagattttctttggtgctttctgcaagatatagtgggattttcccatcatcatctgtttctaggagaaattccaggtgccttatactagaggatgatgagatgagtcagacacaggtactggtgaacagacataggtactagatcagtgattctcaccctgtttgcccatagaattgcctaaggggccctaaagaagatacttagaccccatcctaagagattctgattcaactggtctggacagagtgccagaattgatatgctaaaatatgctcccaggtgattcagctgtgcaattaggattgagaaacattgatccagggagaactcagtagataatagtaggcttggttcacttgagcctcctggatctgcaggtagctacggagtatctaacctagtactggcaatattaatttggtcttcgttgcctgagagtctggaaccaggcctgcagtgtctttcagtaaaccaaaatggccttgcactcttaggagaccatgctaatcattcctgactaaagcaatgtgtatcagaatcaccaaggacatttaaaaacacagattctcagccctatctcatagagtttaagttttaattgatatgaagagaaacctgggtgtgtgagttaaaaaaaaaaaatcccaaggtgattctgattcctgggatgtagctctatggggctgtgatgccatttgatataaatgagttcttacctcatgaatgctttcctatgatatgatctgtggtaccataaagctgaattgaggagagtattccagaaaacaagatgtagtcaatgtagcatttttcttacccacttaattggtctttggcaagggtcttcaagtgaactcttggagtttggagtagtttccattccttagggggaatctattttttttcacagttattctgagaagttagggaaaagtcttggtttgtcaaagacaaacctctgtcaaagagagaccataatccaacatgtaaaacaaaacccagaattcattacttaccaaagtaagagacagctgtgttaagcatagtctgtgagtgaagcagattactgatctttttgggaaacatagtggtgttttggttacagaggcatgagtggttgaacttgaccttagaagcatggctatttgagtgagactgttgttgattgagaagcatgttcactgcagtgtgtctgctgctgatttgctgaccttgaatcgtgtgaagctcattgtaattggcttccagaagtgtgttcctgaagcaagttgagttgtcattgatgattagtctgaggtgaattgccctcaatcaaacaggtttaaaagttggtgctggtggttactagttaccatggctattgaataatcaatctttttctcaccagtaatacagagacttttattcttacctcagactgctattcttcttagtgaaatgaagttgcttctgcacctcaattcccattcattcttcaaacatcatcatgatgatgtgtagaactcctggatcagttcattgttctaatcactccataaatacttgattgtttatgatttccagggattagactaggacttcccaaaggtagacccctttggggttgaaaaggaacccaaagcttgataagactgtggaaaatgttgctaaacatcccttctacatccccatctctatttgagttaaagttctgtttctggtgaagcttttgcggacttctagctcctccagatttctgtttcatattttgaactgtatcactcacttgatattcttttaaccattgcattctattgcagaggatttaaaattagacttaatgtgaagtctcggctagtacctttgctgtgtgaccttaggcaaatcacttattctctctgagccccagtttcctctttagaattgaggatatctatgattacccacctcagtcaagtgttgagggtcaaataacattcaagtgcattataaactaaagtgtgatacatatatattttggaaacattattccttagggtgtaaagtgtttctttcctagtttcttgtacatgggaggtactgtatcaatacttgttaaatgaataaattggtcagaatatgccctatcctggaaattaagaatgattcactttcagggttttatagtttgctaccaaagagagctgagttaacagagtggtttgaacaggaaccaaaaataggactcactgagtttggtcctgtcattgggataaaggtattcctatttaggatgaataaatataagtctgacacttacagtcaaatgaggaattggtgacttccattattctttttaaaataagcttttctttttggaacagctttaagtttacagaaaaattatagagatagtgcatagagttcccatatatcataccaccatttttccctattactaacagcttacattaatatgatacatttgttatagttaatcagtattgataaatttttattatcagaagtccatacttcattcctatttcattagtttttacctaatatcctttttctattacaggctaccccatattacatttagtagtcatgtctccttaggctccccttggctgtgacaatttctcagacttttcttgtttttgactgttaatagttttgaggactactgctgatgcattttgtagaatgtccctcaatttggatttgcctgatgtttttttcatgattacaatgtagttatgtgctctggggaagaagaccacagaggtaaagtgctatttcaatcatatcatattaaggatacataccaccaacattatttatcactgttgatattgactttgatcaccggggtgagataatttgtcaggtttctccaccgtaaagttgctctttcctcgcttctcatacggtactctttcaaagaaaatcacaatgcacagttcacacttatgtgaagagttatgttctacctccttaagggtggagtatctaccgttatctttattaacaaagatgattttcattcaacaaatgttaaaaccaacagtaagtatttgtttaaacaagtagtaaaatactaaaattatttgagccgatcagaaactggacagagattcttgtttaccattattatttatgacttggtttatctagcaaatgcagtaagaaaaaattaacattggagaaagagataaaattatctttttacagatgtagttgttgtaaactaaataacccaagagatgttaggaaaaaactactaagagaatttgataagatggatggatgtaagagaaatatacaataattaatttctttttattattttagcataagccttaggaaagagaggaaggcatttcattcacagcagcaacagaaatcataattacttcagaataaagttaataagaaaggcaaggctcttatatgaagaacaataaaatcctatcttgggtcataaaatgagatctgaacagattaaatgataccagatgttcttgggtggggagatttagtatcataaaaatatcagttttctaaaaatgtttttaatgtatttcccaatagaatactgacaggatttgggggagggggaggagatggtacttgataaaactgtattgtttacgtagaagaaaaaatacctgagaaatcaagagatattttcgggagggaaaggaagtatatgccttattatcagaatatactattgtggcaggtagactataagatgtcccccataatctcacctcctgatattcatgcccttgtttaatcccctctgcttgggtgtgggtgagacctgagactgtcgtctaattaatagaatataatgaagtgatcacatgcatatgactatgtgtgcatgattttattacataagattgtaaagtctatcttgctgaaagactctgttcctttctggctttgaagaatcaaacttttatgttatgaactgccctgtagagagggccacatgacaaggaactcagggcaatctctggctgacagctaccaagaaactaaggccctcagtaaccagcaagcaactgaatgctgccaatagtcaaatgatctgggaggcagattcttccccatttgtacctcagatgagactacagccctgtctgatgctttgatcgaagctttgcaaggccctgaaacagaagactcagctaagctgtgcccagatttttgacccacagaaactatgagataataaatgtgttttgttttgagcttctacatttgtggtaatattgttatggagcaatacaaaattaatacaactctaaaatcaattcaatatgatgtttgcttagaaatacataggtcggtggaacaataaagaatccagaaataaattctagtgaatatgatttaataaatgaaaaggagcattcatttcagtgagagaaactagatttaaacgatcctgatactacgggatatctatatgtgagaaaataaaattggagccctcacttagatgatatgaaaacttccaattagtttaaatgctcaaatataaaaataaaatcctatgagaaaatgtacataccatatgtacaaattaggagagagactgccttatgtaagctggaaatttggaagcaattaaataaaaaataaatgtggttataaaatttttaaaaattatgtgacaaaaggtacaataaagtcaaacagttgtagtgggataaaaagcttgtcagactattaattaatatactgcttccttcattcagaaagctttgtttaaaaaaaagtctgtttactttctggtacaaacttcttctcaatgtggactgacaacagtttgctgaccagacactggtttgtccactaaccacactttgggaattattgctctagagaagtggtaggcaaacgttttctgtaaagggccagatagcaaatattttattttatttatattgtgggccatatagtctctgttgcaactagtcacctttgccattgtagtgtgaaagcagcatagacaatatgtaaatgaatgagtaaggctatagtccaataaaactttatttgcagccagatttgacccatgggctacaatttgctgattcctgttctaggggatacaactagaaggaaagtccgatccttaccctcaagaattaaaatctaaagtttaatatgggcctattggagtgggaatgaagaaaggctcatgatttttatcttgaaagagctggtaacgcactgtctaataaattaaccgcctgagcacttcaaatgtggatagtccaaacttgggatgtctctatgtgtaaataccagactttaaagagttagtatgaacactgtaaaatatctcattttttacattaattgcatgttgaaatggtaatattttggatatagtggtttaaatatactagtaagattaatttcaccagtttctttttactttgaatgtgatttttgattgaagctttgtaatatgctaatttaaagttagatatgtgcctcttggacagcaatgaactgtaagagagagagcttgtggggctggggaatttggaaaggtcacgtggacagagttcacttggagaatgacaggattttgacaagtggttcttggagaggataatgaaggctatcagcagaatggtttctgtgtttaggacaggaataagtttagctgtaataaaaagtgaggcatgcagcaagtctaggtaagtagacataagccttattgtgggttgattgcatgagttagggttttgggcctgctttggccagtaggtgaagactagtccatacttttgagcagggagcagtaactttgggagctacactttgcaggccttatctggaagtagtaagttggttgggttgaaataggaaaagcaagaagtggtgaaaccaggttaactaggtaagaatgaaggtctaatatagggtgacaatgggaatgaagaatggaggacaggggacagctacttcatgatgtggcaagaatatttgtgagagagaaccccagtattctgtgcttaaagagcatggatgatggtgatactctcatgaaaatgcagaccttagaaaaagcgggtttgagactaatatgatgtgttccattttgcatgtgtttagtttgagacaaaggtagatttaaaagataggctggttctcagaagcttgtttgcctatatttttcattgatagaggtggccctaggaaattatttatttttgaccatctctatacttcctcaccctccccaccatctgccatggtcacagttgattgacctggagagcagatctgacctttaaatatttgtttgttgggtgttcagtggaacttgagataatcagccttgtaagatgtgaatggagaagttcttttttaggcattcaaactcaagatattcatgtcctttgtagggacatggatgaagctggaaaccatcattctcagcaaactatcgcaaggacaaaaaaccaaacaccgcatgctctcactcataggtgggaattgaacaatgagaacaatggacataggaaggggaacatcacacaccggggcctgttgtggggtggggggaggggggagggatagcattaggagatatacctaatgctaaatgatgagttaatgggtgcagcacactaacatggcacatgtatacatatgtaacaaacctgcacgttgtgcacatgtaccctaaaacttaaagtataaaaaaaaaaaagagacgtggttggtgtaggggcagaaggagaaagtgacccagagaagtagcagagacatgtgagcggtgaacagctggagttggaccagtgaactcctggtcactagactgtgtaggcccctggacagctctactgtagcccatgcttttcccttctggcctgaagagtggcttttcatagttgggatgaggcctggctgagtgggtatgattcctagccacctcatttcctcctctcttaaacccccttggctaaccaaaatgggtgatcaggtagatgtttgaagtggctagaaaggcaggattggaattaaaggagggggttggggtggagatacaaagttgtgaaaggccatatgttcatttaagaggcataagatagtaaatggtattcttttcaactgcacagtaagcccagagttctaaatgcagttaatgctgagttgcttgctgataataggtgtaataggtacagcaaagcatttggccggcagcattaatggatgcctacgattccagtagagacttgtctaagggataaaggttctcctacagggtaagagcaagttacttattaatctccttaacagctgctgctgtatttgggaagggaggctgcaggttgttttagtttatatccttcagagatgttttgaggacaaacaagtaactgcttggtatgttgtgtttttcaaaagatagccctggtatacagaggtggtagctagcctgagggttatgtaaatgacttagaacaggccgctctttgagtggtgcctcaatgagcactttggggggcttttttctcatctagatgacaaatggaggaaaggtacacttctccacatcactggaaattcagtcttttaaactaagatgttagaagtgaactctgagatatagcatgctaataattttgagagaaaaaaatacaggaaaagaaaggtacataagtgaatattgtactaaaaacgctgttcaaatgagctatctacaaattacatatataagcatatgtgtacatgtatacatatacacatatgtatgggtgtacatatgtgtatatgtattatgtacatatatgtatacatatgtgggtgtatatgtacacacatatacataaatatatggcaagccatttttgtaaagaaaacaatgcatgtaacaaatcctgagggggatccacatcaaatgttaacagctgtggttgggtgataagacaattaatatactacttctttctgtgtgcttttcttttccaaggtgttttccttcttttatatataacatgaactactttcataatgaagagaaccgttaattcttttttaaaaaatcagaattactctggacattttctagtatataattttatgtctcaaaggtagagtgcctttattttttaccacatcatctcatttgtaatgtagttcattaacccagtgcattttatggatttgattaaattaatgcaaggccgggcatggtggctcacacctgtaatcccagcactttgggaggctgaggcgggcagatcacatgaggtcaggagtttgagaccagcctggccaacatggtaaaaccccgtctctactaaaaaaaaaaatacaaatattagccaggtgtggtagcatgcgcctataatcccagctactcaggaggctgaggcaggagaatcacttgaaccttggaggcagaggttgcagtgagccaagattgtgccagcctgggtgacagagcgagactgtgtctcaaaaaataataataataataatgcaaagcaaaaatgcattaacttgatttttaagccttgtctcttcaaaataaagaattttattttgttcctattaggcatttaaattttttggtgatgtatttcaaatgtaatcctaaaacagagaacgatatgataattttctgtgtatctactaactaaattgtgtatctactactacacctactagatagtagattttggcattatgccttatttgcctcaggtattcagtttttaaagaaatatgaaaaatttacagttgatgcccctacatctcctcctctctgtcataaattcagagtttatcagttgggcttatttttatacacatattaacatttacatatctataatgattatacagtattttcatattttaaaactataaatgaatcatgccatgcatattgttttgaaacttacatttttgctcaacattgtttaatatgtttccatgtcgacagacctggctttagtttagaggctggcaaactttggcctgtgagctaaatctagccagccacctctttttgtaaataaactttatgtattgtctatggctgctttcacaccaaaacagcagagttgaatagctacaacagagactgtatgacccagaaagcctaaaatatttactatctggccctttgcagaagaagtttgccaacccctagtctagttcattctttgtgagagggtctccagtgtagcctattgaacattaaacaatttggcttttatatattttgtccccgttttccatacttagcaaaaaaataaataaacttaaggcagctatgggctctgttcctagatgttttatttagtggttttggagagagaagatacttttattcttgatttagtttttctcaaagtggattattattgcttgaagagagaaaagggctgtgtggtccatgtggagcaaaatgagagttatgaatttttctgtcagcaacaaaggagtaaccactgcatgcagttaactgtcttaggttattgtgatgttgttactacaattaatagctactactatgatcactgagcatttagtaaaggtcaaggatagtactaagcactccacatgcattatcttgtttattccttgtaacagtctattgaggaagtaattactcctcattttgagaggaggcagctgaggtccagagtgtgccccaaggtcgtgtttaaagtgaggtttcaacttggacctctccagccccactgagcccagtgcacgattccaggagtacagttctctggggtaaacctttgaagagatgggttagagggtactctgagaatccctgctgccccaagggataaattctcactgactccagccttggcttctaaaatctggccaaggcttgatgcacaagggagaagcctctgttttccgcaaaggtcaaagtttacaactgtagtggggatagttattccacatggctcctttgtagaaaacttaggccaggtccatcttgtcacattttttgctatcgtcccagctcaaaactttagtttctcaaggtttacatatagtggatgctggagatggtccaagggaccttaatgtcaggcccagtgctcttgcgagcaacttagcaactgctcattcactttcaaaggtttgactcttgtgttagtcggttctcacactgctaataaagacatacccgagactgggtaatttatgaagaaaaagatgtttaatggactcacggttccacatggctggggaagcctcacaatcatggcggaaggcaaaagaggagaaagacacatcttacatgcggcaggcaagagagagagcatgtgtaggagaactccctttataaaaccatcagatcttgtgagacttattcactatcacaagaacagcacgggaaagacccccccctcatgattcaattacctcccactgggtccctcccacgacaagtgggaattataggagctacaattcaagatttgggtggggacatggccaaaccatatcaaatctataaatatttcttctcccctttagtttatggctgctgtgggtaagacataagaaatcttgaagactttcatggggatagatagtcttttcactctgtcatttaaaacaaaattaccttgtgcctaaaactctccaaattgctggctcagacacctgggtattatttctcctgctgctgtgaaatatagtaagaatgtgaacttgcctcctatggctataagcccccaaccactttgaacaagacagaagccaaggcattaaaagctgctggagatgcagggtttacttttgctttgctttaaagaaacaaagctgaaagcaatgggaatcttcaggcattttcccatgagctgacactagctagacacagtaatctgcacacggacacacaggtaaggctcattggcacatggccaagtaaaagtttgtcagctgggatgatcttgcctcctctacctgaacctgctttcagaaaataatttgaccagtcacgtatactgcctatgaatggtaacaggaattcctgcctgtatcaggataattagctatattacctctggtgagaatttaaggtattagcattggagaaagtctcgttttaaaaaagaaattcctcccaggctgttaaaattacatcctatagatggacctctttttctgcttgtaagaccagctacacgccaacatcaatgacaataatttatcatatgttacaaatacaaagctcaacacaaaatgtttcttaagttatattagttaatgcacatgtattctacttctattactaccatcacaccaaactgagataccattctcctgtcccagatctatcaagtggcagaaggaagtgttatagaccctggggtctaactttaacagacctggcttaaatcgagtgttcatttgtaaccatgtcaatatttttccaaccctgctttggggcctctgacctccctttgcacgaggtctctatgattgtaaaggtttgactaataaggattttggaggatttgtattttaaaaacaatctatttgtaagatggggcattgatcagatagactgagaaagctgcattcagattaagtctaaatttagcagaatgtgtaaagttgtgttaccttttgtgtgaaaagtaaccccctacacctgctccagcaattaaagaatggagtttgtctttcttctctcactcctgcctctcacaaatcttttcttgtgtctattgtatccagttgcctcaactataaatcctaggttttttctttcagcctcattgacatcccatgaatcaccaagccgtggtgaatttcattcttagattaaattagtagctcttgcatccctttccttcttttcatctcaccactgttttttcattcacttggacctttacagcagtttcctggttttcctacctctagcctcattttatcccatccattctgttgaaatagttattttaaaacaatctcataaagccagtgtgataaaattggtagtttcatgttatctacaagactaagttcaaaattccatgcatgtgctgataaaagacccattatggtcctcactgtacttcctccccattttttagctttcattctggtcaccagctctagttcctctgcttagcgaatctcgcttgtcttcaagatttcattcaaatgtcacattttgtgggaagccttgccttttttgacacgctctccctgccactctagagtcattttctttcctttataccttctttgaactttgcccatccatcatagtactcatgttgtatcgtaatcatttgcttacctgtcagccttcctcaattactcatcgcatttattcaagaaatatgctaggaatattgagtgcctgttcaaatccagatgctgagatttaattgtgaataaaatgaacaagatgatctgtcaggaagggaggaaaatagacaataaacaagaaaataaatatgttaacttcaagcattgataagtgttccaaaggaaagagttcacgaggtgctggtgtgggagcctacttgatagagtcatcacagaaggcctctctgaggagttgacatttgagctgagtactgaaggataagaaggtccataatctacaattcagatgatgcagaattcagtgttttttgctatttgctgaccattgttaacctgatcgttctagttattgatatctgctgaagcacgtaacttagaagtcagtttatggttttggtttgctgtcactctccctgcgttgacagcatcgccagatttacctttctaatcaattattttagcatgaagaaacataaacctgatttttttttcttttttttcttttcttttttttttttttttttttttgagatagagtcttgctctgtcgcccaggctggagtgcagtggcacaatctcatctcactgcaagctccacctcccggattcatgccattctcctgcctcagccttctgagtagctgggactacaggcgcccacccccatgcccagctaattttttgtatttttagtagagacggggtttcaccgtgttagccaggatggtctcgatttcctgacctcatgatccactcgcctcggcctcccaaagtgctaggattatgggcatgagccacagcgcctggcaaacctgattttttttaagggagatatataaataatgtagtagaaatggaaaaggactgttttagataacgtccacatgggcattattaaaagatggccatgatttaaagcacttcattgttgatgcaattgtgattgggatgaactaatgaaattagggtgggccattctgccatttcctgaaactcacatgatcctttatttctctcttctttttccttatatctaaacttgaaaatttctccactcatttctcttatccaaattgatctctcaaatcatctcaaacgtgtggagttctgcttttcctagttaatgttattcaggtgtggacttgcatatgtataaatggttgtgtgtcttttttgtgtttgaaagactctttatgttgtgagagatgtgtaaaaggctgcaaaaatatttatgtacagtttagagaataatttaattaaaaatcacatactcacacagttaatctcccaggttaagaaagagaacattgtcagtactcccagaagccacttcagttcccctctccctctctatcatgttctcctcattcccctcttccctttcctgagaaactccatacaaacttatttaccatctccttgattttctttatagttgtaccacctatgaatgaactcttaagtggccaaattcttttctcttttttggtgtatttttgaacattatataaattgaataatactctttgtattttgtaacttctttcacttaacgttgtttgagatccatccatgttgctgcttggaggtatatttattctttttcattgctgtagagtatttagttatatgactataccataaattatctgttccattatcggacatttgggtggtcctcaatttgcttttatgaataatgctgctacgagcactcttttctttcctgttgaacgtgtgtgaagatatagatgcatctttaacttaatatgtaactgttaaactggttttttaaatggttgtatattggtgataattctagttgtctgcatcttcttcagcacttcctcttattaaacttctcaatatttttccaatctggtagatgtgctttcaatttgcattctctgggtaataatgaggaagtacatatttttgtttgttgcccattcttatatcagtttctgggccatatttcattttcccataagaggcatcttatttttcccctaacttctataagttgaaagatttttgattaataaattacatttttaagaaaattttttatttctataattcttggaatttttatataatatgtataaaatatttgtatacagataataattttaatacaatacaaaatatgtaattattcaatggatgtgatatagtttggagatttttcccctccaagcttcatgttgaatatgattcctcatgttggaggtgggatgtagtgggaggtgtttcgatcacggaggcagatccctcattaatggcttggtgccatcctggtaatgagtaagttcttgctctgttaggttcctgagagttcctgcaagaactggtgaaaaaagcgtggaacctttctcccctctctgttgctccctcttcttgctatgtgacatgggggctccccactgccttccaccatgtgtggaagtagcctgagtccctcaccagaagcagatgctggtaccatgtggtaccatgtacagcctgcagaaccgtgagccaaataaacctctttataaatcacagagtcttaggtattcctttatagcaatgcaatgcaaatgaatgaatacaggatcactcatagtgttctgactgatcttgtttctttgcttctctgaatcttgcagcttatcaccaccaactggaatcttggcctaggcattttcttttaagtcctaaaaatgcccagtgagccttctttactaccttcaagtcccctcagtggctcagagacctggcattggactagatggattactcagatttctttcaaccatcatttatgtgtctgataaagtattgtgtcttttgcttcacctcagtttgcagaattgggagtttttcaatatttgatatcaggaaggctttgaatatttttcatctaatttcttttgggggttatttccttggaatatattcccaaatgtggaattataaaacaatgtatttcttttaacctggtatgtcatatgttaggagatgaaaagattaaatgacctatttgcccagagtctgtcccacacaggggcttatttaaactgcattttgttagtttaatgagtagtatagatttttcttttaatttgactaaatgttgaactcagggacttgaatttttaaaaagccgatttcttgaaaaatcatttattgaaagtctaatgcatattttcattatgtcctcagagtatatgatcaattctttaattcttctgtgttctactggaacaaatgaccaatttatgaagttgttgagagacttggtcaatggcaatgatttatggctacaaaacttgagacatgagtataatgatgactcctggaaaaatgtacttgagatgtttccagattagcatgtgctctttagctatggaggaaggcattgatcatattgattacctatatttgaaagtgtcctaaataacccctcagccatgaatattcttcattttttccctctctgccagtttgttacctttcaccaccagccttagctgactttacataataggttttgtaataagtgtctaatgcaaaagttttcaactgggggtggttttcccttccccacaggggatatttgacaatgtctggaaagatctttggatgtcacaactgaagaggaaaggtgcaactggcatctagtgggtaaaagccagggatgttggttaagtatcctacaatgctcaggatggccctgcacgacaaagaattatgtggcccaaaatgtcagtagggctgagactgagaaaccctgttttagtggaaataagtttttatctttccttacattttctccccattcactgttattttcatgttttgtcagtgaattatcagttcacatttatgatctgtggagctctaatatgattgtttaatctgctttgttgtggagagtctatatatgtacacatatacacaataaaatttgccaattttaagtgtataatttgatgagtgttgacaaatgcatacagttgtgtgaccaccatcataacagtgtttgatatgtttaaatttcatgtagtttccaatatgcattcattaaataatattatattctaggacagaaggaaacctgaagtaattcaggtactgacaggtagcttgtgactgataggtagaatatacatggtaattaatgaaggataacacccttgaactgacttctgaattttaccatattttaatattaatctaaagattcttaattttacttggacatgatttgacccctggatgattggctgagaggagtttctatattgtgaaacaggaaatctatattaacatctctcataaaatactgagttttatgtccacaaattcctagattctctttgcatcttctaggtcttttttattcctgcaggtataaaacaagactgagtgtttgaagggaaaaacagaatatatacttctttcctaaaggataatttccagaatgttggttgctttggtagttgaatttaaccttggtaagtagtagcagttgtctgcagtaaagtggatggaaacccttgattccattgctgaaccaccttcttagagtgagaggtttgtcttgaccactaattgctataattggagcttgagagatggtttgagatgagtcttgaaatgataagtgtgtctatctgcttggcaggtgttttctctttccttttaattccctttccaaatcaaggtggtatttgtagtcaaggtttcatagggagtttgctaatgcgtctctaggagaaacatagaaaagctagatagaagggtggtctaacttgatttgtgtcctcatcattgtggtgtaatgagaatataccaatttttgcatgatggcaaaaaatgaggtaagcactggagcactgaaacatttagaggtatttaactacatcttaatactataggctatggctcagaataaccataggaatcttgctgtttttatttgtgggtttattttaggcaaactatcaacagtgctgaaatgatactctgtgaaaaggaagaaagaatgtacccacaaatttaaaatgctgtgcttgctggttttcttctcttagccttatccatcaatcaagaattgttggagaaaagtcacgttgaataattctgccagttccactatgtaatcttgggatgaattgtgtcgctctgcatggtaacctcagtatttcataactgaggatgaaaatggtttttcaacttgagaaaaatcaggactcttttggaacaatatttcaaattccaataaaagactattttttgtttggatgttcatcctctgtcccttcttccttagcctcttagcccaaggtgctatttttatgtactggcagtcgagttccagaagtgagtgtcttatcctgaagtgctattttgaaatggccttattctattttttgaaagaaatgactaataaaatgatcccagtttatcattgtaatggactagaatatgaacaaaaacctcaggcatttaaattcccatttgtctctactcttcttcactgcgtactcttctactgtttactttcagcatgcttcttgacatggaagccattttgctaatggatctgtggctatttcaccccaggtcgcagccaggttagcattagaaggatggattggattttctgagttcagaatttctatttggtattgctcaagcctttagttgcttagccacttcaggccacaatttggtgaaagagcttaaagagcagtgcaaaactttcaaaacctggggtgtgagacagatttggaatcttgctgtaccagatttgtgtcctgatatttattcgatcagaattttctcgtgtctttaaaaatcctttaacaataccattaaatggccatgtattttttcatcctgaggttcatttatttagcaatttccctactgttgcatatgtaggtgtttccacttttttactaatataagattatgattagtagcacttaaatctttgtcttcgcatttcattatgtgtttaaactaatttccttgtggtagaattaagcatgaatatttttaaatattgaaaatttttgctagaagagctttctcaaaggatgcttaccaatatgcccattaattgtataagaaaatgtgaatcacaacacactcttgccattgacaaagatttttaaaaatttggaatgtatagatttaaagatggtaaatgatatataccttttatattataaggtgaaacttaaatatttgtattttatgaattttctgttcttttgctctttttctaccttctgttagtggtatttgattgtttcattagaatgtttatacattaaagctaccaatccattgtttttgttgcagaaaaccagatttatcattccccccttaatttatgaggtagacgctaaatacattatgcgtttgataaaacataaattcatatatagctatgatgctatagagtaggttgacgttaatttccatttacttctctataaagacctaactggtgataattctaaggtattgtgactacaaatttctggtctgatctggattctacttttctccaacattcttatgacataaccccttgcatttctgcaaaataatatttggtcataatgtattatcctttttatgttgttggattcgatttgctaaaaattttttttgtgacttttttttgtgacattctgttgcccaggctggagtacagtggcatgatcatggcttactgcagccctgacctcctaggctcaggcagtccttccacctcagcctcctgactagctgggagtacaggtgtgcactactatgcctggctaattttttattttttgtagagatggagtctcattgtgttgcccaaactggtaattttgctaaaattttaattagaatttatgcatcaattttcatgggggttgttggtgcatagttttcttataatgttgttgctttttgtaataacagaatgctggcctcataaactgaattggtaagtgttcctttttattctgttttctggaagtgattacatagaattggtactggtcttccttaaatgtttcagagatttcaccagtgaagccatctgggcctggagttttctttgtgggaaagtttttatctatgatttcaacttctttagtagatatagatcaattcaggttgtctggggttttttgagggagctgtggtagtttgtgtctttcaaggaatcagtccatttcatctaggttattaaattttttcagcttttgtatatctgaaaaaatttttacctttgtttttgaaagctatcttttgctagtatagattctaggttgatagttgttttcatttttgtattttgtattaaatgtattggcataacatttttaataatattctttgattatgcttacagtatctgtagaagctgtagtgttgttacctttctcagtacttacattggtaattcatgtcttccctctgctttttcaaatcagtccaactagagatttatcaagtttgattttctcaataagcaagttttttatttcattaatttttctttcttgttctttcattgtcttattgtattgattttagctctgatctcattttgttccttctacttgctttggaatcagttttctcttttttttctgatttctgaaggtagaagctgaagtcattgattggagacctttcttcttttcccatatagccattcaatgctataaatttttccctaagtactgttttagctgcatcccaaaatttttgatatgttgtcttttcattttccttcagttcaaaattatttttaatttctcttttgatttttttctttaatccgtggatgacttggaagtgtattatttcattttcaaatggagatttttccagagatctttcttttattaatttctaaattaatttatttgtgggaagaacatactttgtatgacttgaatcctttacagatttattgggttttgtttaatagccaagaatgtagcctatcttggcagatattccatttgtgctagaaaagattgtgtattctactgttgttgggtggaatgtcatgtcaacattgataatgtttaaacctttcatatccttaactaattttctcaatacttgttctatcaataaagagagtctttttgaaatctccagttataattgcggatatgtctgtttctcctgacagttctgtaagttttgctttatgtgttttgaagctgttctgaagcataatgtttaaatgtttaggattgttatgtccttgtgataaatggagccctttatcattatgaaataagcttctttatccatgttaatattctttcctctgaaatgtattttgtctgatattaacataacaacataaccactccagttcttttttgaatagtgttagtatgtgtattaatctgttatcgcactgctataaagaactacctgagactgagtaattgataaagaaaagaggtttaattagctcatgtttccacaggctgcataggaagcatggctggcggaggcctcaggaaacttacaagcatggtggaaggcaaaggggaagccagcatgttctacatggctggagcaggaggaagagagtgaagggggaagtgctacacacttttaaacaaccagatctcatgagaactcactcgctatcatgagaacagcaagggggaaatccgccttatgatccagtcaccccctgtcaggcccctcccacaacactggagattacaattcaacatgagatttgggtggggacacagagccaaaccatatctcttcccactccaaatttaaacctatttgtacctttatatgtaaagtgtctttcttgtagccagcatgtagttgacccttgctttttaatttaatctgacaatctctgccttttaattgggatgtttagtctacttacacttaatataattgtttatatttttaggttcagatctattatcttgccatgttttctatttgtcccatcacttctttatttcctttatctcctttattttttatttttatgattctattttatcttacctgttagcttattagctataattctttattttgtgcttttatttgttgctttatggttcatagtatacatatttaacttatcaaagtctaccttcaagtgatagtataccaccttgcttatagtctatgaaccctgtgatagtataaaatacagccatttctccattcctagcctttttttctattgtttaatacattttatttttatttctttttaatttttgtgggtacattgtaggtgtatgtacttatggggtaccaccacactccattgttatttttgtgtagtcagttatattttagatatttaaataagaaaaaataattttatattttcccaagcagttatttcagtgcccttcattcctttacatagacccatatttatatctaatatcattttctttcttcttgaacaacttattttaacatattttatgattcactgataattttttcagcttttatatatctgaaaaaatctttacctttgtttttgaaagatatttttgctagtatagattctaggttgatagttgtttttatttttgtattttaaagatgtttctcctagatttttttgcttatattgtttctaatgagaagtatgtcatccttatctttgttcttccatatgtaactttttttcccctctggtggtttttaattttttttcttaatgatttttagcaattttttaataatatatcttggtatagttcatgttttgcttggggtttgttgagcttcttgaatatgtgggcttattgtttgcataaaatttagaaaattctgaccattaattctataaatattttttctatcccacccttttgtggttccttttatggaaggatggtatttagaaactaggggctgggtgctaggtatgtttgttgccactggagtgtcattgcttcttggccctagcaacagctaggaaatatacttgagtgtaataactgtgcaaacacacgtctatatttatctgctatgttttaaaagtttgtcccctccgaaactcatgttgaaatttaattgtcattcagtattaagaagtgggacccttaagaggtgattaggctatgagagctctgcccccataaatggattaatgctgttattgcaagaatgggtttgttatttcaaaagtgggtttcttacaagaggatgggtgttgcttccttttggctctctcttgccttctctttgccctttgccatgggatgacacagcaagaaggcccttgccagattccagcaccttaatcttggatttcccagcctccagaaatgtgagaaaataagtttatgttttttataaattatacagtctcaggttttctgctatagcagcacaaaatgaactaaaacattttctgagtttctctttttctatccatctatttatctgtccatctattcattcatctataaaaactatgagttcatactgaaacctctgattctaatctaataccacatggttcattatagccttctttctctgatagtgagaaacctggttttcattatctacaatatatgtaaacatgtgtctgtatttctttaatccttgtagacatggagtattttcagaactgctaacctgtacccttgtaagaaacacatttactaactagagtagttctgggtactgtttttttgtttgtttgttttttgtttttttgtttttgtttttgtcttaaaatgcagtagccagtagccagtcatgatgctgttttatacagttaataaggttagttcttttcttccccactctcttcattatggttacattattcacttgtgatataattaggttctttgttagtgtttatattccattttgtccccttcccccaaacacactgggtgattttattactgacttatattttcagtacattaaacatgacaatgcttctcagagtcagggctatacaaaacagtatacacagaagtgacatttcctttttgttcttagcaccccttcccatccccttgctttttcatccctttctctattgccttagataccaatatctttagtttctggtttattcttaatgtatttattttgcacaaatgagaagatacatgaatgttttcattcttaaatgaagggtagcatactacagatacttttttgcactttgctttttaaaaatgtttacacatttatagaaatacaataaaatttgtttttatgcaagtaaaaattgtctatattcgaagcaaacaatgtgatgatttcatatctgtgtcattgtataatgattgccatggtcaaattaattaacatatccattatcgctcagagttaccattttgtgcatgcatggagtgggtggcggtgaggacacttaaagtctgtattttgccttttttacttctaacagtttatcctacaaatcatttcatatcagtttatagagatcttcctcttccttttttttatagcagcttggtactccatcatgtaactgtatcatagttaaccattctcctatttatggacatttaggttgcttccaatattttgtaattgcaaactatttttaacgaataatcttgtacatatgtatttttttattgggggtgctttcttagtgcagattcctaaaagtgggattcctgggacaaatagttctttttgtccctccatttgcttgaagaatttctgatgtgtatcagaaaataacaacttttctttgcatttcttttctcctatggttttgagcaaagcaaaaacaaatttgtacaggaatatagatgaggacattttccaatgtgtctattgtttcaagtacactcctcctaatatctaacttttatcccttgagcattacatttttactatcatctctgctctttctttaatcatttcttttcatataactcattacatatgttctgaaatgttctcaattcatagcttgagctaagatgtgatgtcctcatttgaagtataattatctgcattttgcctttttgttgtcagatttaaaaatacaacaaaaacaaggttacattagtgagaagaagtcaaatgaagacagttattttttctccttaattgcaactggtaccatgtgtactgaaataaaattggtataaggaaaataaaacagctatgaacagtcctcaagtagcatggaaaatcagacttgctcaagtggtgaagaaccctatgtttggtttcaaatggaactttgaattgttaaatttaaattattaaacacaaactatcaagttggaatcagtggcctgaaagaatcagtcttgagtgtcccagaggcctttcttactttctgccttctacaattgtctgcccctctgcagtagtagtgaacacagtcttctttttatctggtttgtggttatttttgtagctctacaaatctttgtgggagactaacgttcctctgaattatatcttaaaaatcaaatttccactggggcatttgcatcaaactgctcttcttgctggctctttagtgccagatttccttccaaaatgacaggttgtgtgatctgtgcttctactgccctttatttcacaaagtagtctttgatgtattctgtgtatctgggggtaagagcatagaggcaatgagaagcaaatgcctttatctgcagataacagcttcccttatctgcatgttaaaatggacaagtggtactttgcccacttgtgtgtcagttgcctgcaagtgaagcattctgtatctttcagatgactgtttctttacttccttaatgctgctaatggtcagttgagagaagagaaaaatactcccaaacctgagattctatttggaaagcagtattgagatcctaattactttgttttattttccatacaacactaatagacttaggcagtaaaatcaatggcattgtcacttctagactgctttatatgtggaactgttgatattctgaaagtttacttactttttagtatctaatatataaccttaaactgaagtgctttttaaaatctaagtaattatcatctattggacgtaggtctatattgaggctgataaatttcttgggggagcttgtgatctacacccttgctacccgaagtctgtgcaacatcagcatcatctgggtgctagttagaaatgcagaatcctcaggtctcacctcagaccttctgaaccagaagttacattattcacaagttcccaggggattcacgggcacactaaagtttgagaagcactaccacagaagatgggacatttgtttaggtgtttaggaatcaggccatctagaattcattcctggtccttttcattctttttttctgaaataagaacttgctgctcaatttttcaaagctttggtcttcttatatttaaaacctgatttaaaactgagctttttccaggctcatggaagatgagcaaaggggtcatcttgatatgaagtctgagagacacttttgaactcattctggaaaagaacataactaaaagtttggcattgttactgactttctctgtccacctacgaaagtgctttttgaggcctcaaggtaggacatgatctcttggaaatatagtcaattctcataatttgtggattctatatttgcaaatttgctgacttgctagaatctattactatttgtaacccccaaatcggtacttctggtgcttttgctgtcactcacagacatgcacagagaagtgaaaaaatttgagtcacctgacatgcacattccctgttaaagtcaaacaaggcaatgctctactttcttatttcagctctcatactataaacaagtatttttttttgtaatctatttagtgctgtgtttttcctgatttttgtgctttatgttgttgattttggtgtttaaggtggtctttaactatagtgctgaagggctgttcagtgttcctaagcacaagaagcctgcgatgtgccttacagagaaaatttgtgtattagatgagcttcctttgggtatgagttagagcagtgttggctgcgagttaatgataatgaaccaaaaatatatgttaagtacagtgtctttaaacaaacacatataaaacaaggttatgtattgattaggtaacaaaaatgttgtgaccagaggcttgtaggaacttactcctgtatttcccctaggagcaatggttcagtatttgttaattcagtctttgtggtgacttcataaaacataagtgctgtgaatattgagaatgaactatatgtttaaaacacaattagactaagatttcaactgggtgtcacattttctcttctgtgggtgataacaagattagcttgttataagaaattttggggttgtattctgtgagtataatttcaaataataataactggtaatttatgaaaacatacttcagtatttggaaggtttcttgggatggaagcgatattccagagaggcttttctcttcctatgggcaactttttattcttttaggcatggcacttgaaacaattgtactgcagttacttttagaccaccaatgtgtatgttaagctcattttttgttgagtctgtgtcttctttttggtcaactttgctgcataaatatcacagaaatctgtgtcctcctctcctgtatccatgatccatgcagctgcttcagtccaggtccacatcacgtattgcttggatcatagactagtattctaactgttcttacccatagcccactctctagtgccacccattttgtagtatagtaaatctgatcctatccctcctctctgtgaaatctctatgtggctccctgggataaagttgctttgggacaaagttcaagatgctctaagttttaactcttgattttcttaccaccgtgcttggagacctctgatcacttgataactctcccacctctgtgcctttgcataatgtccctctgtttagtataccctttttttcttcttcttctaccaggaagttgattcctgggctaagactctgcaattacctcttgtattattgtagatttttaaaattattatttcccccctccattaggcagtgagaactttgaggaaaaggaatggttttgttcagcttggtgtcactaatgccttatatcttttataggagtttctggccatgagatcactggaaatgttgaataaattagaatttgggggtgagtctaatttgactactgttataacaaactgactttggattggcagccctaatctgcaccagttctaatatcactaatctttaagaaaacccagtatagaacccataatgagcattcaattttggaaaatatgaaaaaaggaaagtgaagaaattagttataaagtacaataaacacagtagcaacttgttatatatggtcaattgttttaaaacaagtgatgcttcatataacatttgtctgcttaagaagtaacaaaggtaaaataaattaatgcaatgaagtattcatactctaaattttactttctgctttccctgattcatacaatgagtagtatacagcagtagaaatgaatgaattattgcaatacacaacactgcggatgaatcttattaagttaaagtaagtcacccaggattgcatgacaggaatatatcaaagatcaacacaacacatggttcttaatagtggctatcctgggatgagggaggcaggggaaggaaatggagatcactacatagggagatgtaagttattatccatgttctagtctcttttgggtagtgggttcatgtgtgtatgtgcatattaatataataaacacaagaatgccatgatgagtcctcatgaatcaaggattttgattaataggatttatctaattctcttcacccaagttccacacttatttaaaaaaaaatcttatttggaaattttaggggagcctccacccctttatcctctcttgaatgtgaattaagcacatatgtaagaattgtacatattttgtatgggaaagaaggggaacaaaatgaccaaatataaaatgtaatattaatggtgaattcaaagacaataggcattatgaaaatgagaaaataatgggaaaatcacacaaatagccagccttttttgagtcaatcaagtactggggatgtggagatgaattgcaatcaggtttaatggagtcccccattttgcagtgcttgtattagcttgccctacattttcttggcagcaggaagcaagcaaagggcattattcaaagaaaagcaactgtgcgagacttgtgagaaaaatatgcatcctgtttcttccatgttgcatatcatagaaagaaagctttgccttccaattttgtgagaaatacccttcatttgaaaatgattttgttttacatttctcccaatagcactcccatgctcaatttcttgtcaatcctctcttttctgctagaatccttgaaatctctttctagtagcagttggtgcaagacaatgtgcatttattttggtggcagcattttctagttttcctgccagaatgtctgccttcacaatgaactagttttaaggcactttagatttcagctgattcccagtatcagatgtgaacagacaaaattctatctgagaagaaaatctctttttaggcagaaactttagttaccctcttggcagagtccagagagaggaatcaagggttgcttggattctcaagtcattttaaaaaccatatcatgagtatcttcctgtctccttggtgatatgtgaccgttttcctcctggaagagctgttccatatatttttagtaacagcaggagaggatagatatttgggtgagctgtgtacccagctggaaagcctaaacatacaaagggtcttaagtttcccttgatcttgtttttctccccaaccccctacattctttttttgtaaagcacagaaatggaaggcccacttgtgaaaagcatctcacttcgggcttactgactgccattcacttctttggccctttgttctgtttcttctatcagcaagggaagcacgtaagctctgccagctgtttgtcacttccagagatatgctgtttctgtctcatctgtccagcccagctaagagtggaatcttacaatttgacaacctataaataggagggatgagagggtataatttagcaatgttttttgttttccaagcctcatttctcttgcctacatagctagcaagtgtcatagacttattgcttgattgaatttgggcagtttctaacaaaaagtgatgttcttttcttccaataagcaggaaggctgctttatattctttctaatagcaatgggcattacattagcacctctctttcaaaatcacatacccagggctttgaatgaactgtggctttagaacaagattttttgagaaggtgggagtggtgttttcatgaaataggctaatttgtctgtttaagccaaactgtgacctcatgaacaccatcatccaaggaatcagccagcattatgtacacattagattgaattctataaatttcccttcatatagggaagtcccttgagtagacgttggtctgcccttcccaagtctcttttgcagaaggtatcccttcatgaatacctcagcacagggatcaatactacaaggtagagtatagaagaccatgatattctgaaacaggcgtggaaactggatgtgaaaatatgcagttgttaattagtaagcagggatacttcgctttctggaagtacatatcatgtagggtatatcatacagataggatgatattattttgagacttagataatcacataaaactgctcaaacaagagtcaagggagtaatttctaagaacacaatggtagagactgtggtccctgccatggggtaagtatagttgtgggagaagacccagaatagatactctacagatggatcttaaaggctgttttactaaaagaatttccatttaaaaccttgtaaaatttacatgaaataaatataaatgcaatcagtaattatggaaattggcataaaccatctaccatttaatttatccccattgacacaaatatttatcctccatgtttttcctctaacccagcataaaaatgttttatgtttttgtgtgtgttttgaaagatatactggccacatagcacttcattgaactgaattataagatacatctactggtaagggaatgattagctattgttgtataaaaatccatccccaaacttcgcagctgaagacaataatttatttgttcacaattaggcaagttggtagtatgggcttgactcagctgggatggcccatctctgttccacatggtgtcatctagccctcctcatgcatttggaccttagctggggtggcacactacattctctcccatcttccaggaggccagcctaagcttttcacatcatagcagatgagttctcaggaataatgaacaagcagtcttgatgcttctgtctacataacattggcccatgtctcactgaccaaagcaagtcacatcaccaagcccagtgtcattgtgggagggaagactacacaagggcttagatatggggaagtgtgacttactggggttgttaatgtagtcatctcccacagtggaccttttagttgctaaatgcttttaatataatgaaagcaactctactagttgctgtgatgaggtatgagagctgagcatgaaggaaaaccaagtttctgcagtagtatgatgtatgtgctttctgaatgagaaatcatagggcagtatgacaaagggattgttatgataagtgttttaagtataatacctaatcactttttttattcctggaaaaagaatgcatcaaaggcaatgaataaatataaatagactagtctccataaaaatgaactctcatatggcaaacagcatgaataaacaaggaaaacacaagctgggaaaattattgataatagacaaaggcatagtattcctaacaattaacaagaaagacaaatatgccaatagaaaaatcaacaaaggtcatgaatgggatatttacaaagaagaaatataaatatgcacatggctgccaataaacatccaagaaaacattcaatttaaccagtagtcaaagaaaggcaaacaaaagtttctgacaaatctcaattcttgatatattttctttgcacttacataatataaaagcagggtaagagaatggagaggtgggcgggaggagttgcaattttagagaaaacgggcagggaaggtctctcaaaggtggtaacattgaagcaaggcttcaatgcagtgagagcacaggccatgtgctccagaagtgttccaggctgagggaagagtaatgacaaggtccttaggtgggactaagcagtgagaaagccagctagtgtgtgactgcaaccccttgagctgagtattcgggaataagtggatattctgtactaccgaactattcagacagacacattctgtgtgataagcaaaaaagtggatgttacaacccacaaaatgggaaaaacttttgcaaatcatatatctgaaaaggggcttgtatcaacaatatatgaagaattcttacaagtcaatatttaaaaggcaaataattaaaaaatgggcaaagaatctaaatagacatttctctaaagcaagtatacaaaaggtcaataaacacatgaaaaacgcatgatattaaccattaggaaaatgcaaatcaaaactacaatgaaataccacttaatgctcactagaatgtctataataaaaaagaagtgttggcaaggatgtagaaaagttggaaccctaatacatcgctggtgggaatgtaaaatgctgcagacactttgggaaacagtctgacatttccttaagtggttaaacatagagttaccatgtgatccagtaatttcactcctaagtatatacccaatagagttgaaaacatatttccttacaaacacttgtgtataaatgggcatttaggcacattattcataatagctcagaagtggaaacaacccaaatgtccatcaactgataaatggataaataaaatgtgatatatccatacaatggaatattatttggaaattaaaagggatgaagtactgattcatgctatatcatggatgagccagtcacaaaagatcacatattatatgattccatttgtataaaatgatccagaataagcaaatctgtagagccagaaagtaaattagtatttgcctaggactggaggatatggagtgatttgggagcaacagttaaggtatgtagggtttctttaatgttacataaaaatagtgtcttatgaatttaatattttatttatttttttgttgtttttcttttgtatttttatttatttatttatttattttttattttattattattatactttaagttttagggtacatgtgcacaatttgcgggttagttacatatgtatacctgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactaagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatatatagtcctttgggtatatacccagtaatgggatggctgggtcaaatggtatttctagttctagatccctgaggaatcgccacactgacttccacaagggttgaactagtttacagtcccaccaacagtgtaaaagtgttcctatttctccacatcctctctagcacctgtttcctgactttttaatgattgccattctaactggtgtgagatggtatctcattgtggttttgatttgcatttctctgatggccagtgatggtgagcattttttcatgtgttttttggctgcgtaaatggatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacccttcatgctaaaaattctcaataaattaggtattgatgggacgtatctcaaaataataagagctatctatgacaaacccgcagccaatatcatactgaatgggcaaaaactggatgcattccctttgaaaactggcacaagacaaggatgccctctctcaccactcctattcaacatagtgttggaagttctggccggggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcttatacaccgataacagacaaacagagagccaaatcatgagtgaactcccattcacaattgcttcaaagagaataaaatacctaggaatccaacttacaagggatgtgaaggacctcttcaaggagaactacaaaccactgctcaaggaagtaaaagaggatacaaacaaatggaagaacattatatgctcatgtgtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactagtaccaaaacagagatatagatcaatggaacagaacagagccctcagaaataacgccgcatatctacaactatctgatctttgacaaacctgacaaaaacaagcaatgtggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaaagggatctaattaaactaaagagcttctgcacagcaaaagaaactaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttcttaaatgaatttaatattttaaaagggagtagaaattagactaattcctttgaaaaatattaaattcttaagacattaatatattttatgtaacattaagtggagactagagttacaaagaggcaggacctagcccaacttggggggtgaaagagttggaaaatgtaaaagataataaaaacaagacatcagttgactttggtcttggtgcccagacgagccagagctacagccttctttaaggtattaggtcagagttttctaggatagtagctgatgtagtaagtgtgatctttttgtcttgggatcctgaatcttaagtccataatattggtgatttacaacctggaagtgatgaatgcaacaccagacacccacccccaacatttctgcatcaccagaagctactgctgtgatccccatgcctaatggggccccctttgtgaagttacacctaaattggagcttgaacttttttccagaggaagtatttttaaatgattagattttttataatgccaatttcattgtaaatctattttgattggacatttaagaccacttataacattgtttaatgaggaaatgtgtccagctttcaaacaaaggatttagaaatgatcttttggaaatgtaaattattttgtgagctagaactccctacatttcagagctcctctctgagtcttggtgtggatgtggagaaggacagcctgagaaaataagataagggactctagttcttcttttacattaatatatagtcaagttcctattctggcatttgctgctctgattttctgggaactactttagaagtctgcgcttagcttgttagatatgatttgcatgcagtcgacaccccagaactcgcatgtatgatgaatttcattaatctagtgatttgtaaaaagagtttgaattaaatgctccttcatgctccagagactgcactgggctgctctgtaatggttgccacagtttctccaagggtagtgatgtaaaaacgaaaagacaactagaaatgaaagataatccagagacctgcaggtacagcattgcagatcttgaaacagaaaaatagtgtagctttatttagatgtctcactgcttttttttcctctctctcgttttgtgaagataaatgatactctcactgtgcttcagcttcttactctataatagtagttttcacttaggtgagcctcaagcacctggagagctagtaaacatgcaggtacccggaccccacacgcagagctgctgattgagtggacttgtggtgggactggagaatctgcaattctaacaagcacccaagcagtactgctgctggtagaccagtgagcacacttttcgtagcattcatctataatatttagaaagccactttcaactctaattttctataattctgtgatttcatattctgacatctgaggcatctgtgtgagaccaaaggtgagcactgacgattgaacttgcccaaccatttttaggactcaccttcttcctgattctgcagaaaccaaaacatggctatgtttagtgtctgcagaaagactggtctcgggtctagttttagccttgaggaaaaaaaaaaaaaaaaggtgggaaagagaagaaacaattctgagttagaattaagattaccaaatgagtattgaatggcttcaaagctgtttcccgggcacccccaaaccctagattcccttgaatctttcctgattcagcctggtccctggtagggaaggaccccagcctttaggaaatatgggagaactggagaaataaagcaaaggggagggcggtggcagtgtggtaagaaataagtcgaagtaaattggggacacttaagctttcagttcctttaaacatctgtttcctttgggcaattcacacttccagaagagttcttgagatgccgtttaaagataaaaaaaagtaatgttacagctcttttagaatttgtctagcaggctttccggtttttaccagaaagcccccccaccaaaaaatatatatatatatttttaaagaaaaatggtgaggtaactgaactgttagcatgtgccaaagttagggtcttgagaacctaaagttttaaaacacttgactgctgactccaatccaatatgggtagccctcacttcagaagacagtatttggttttaaaatgttcagttccactgcctttgttttctggccatttcttagtggataagaactatgtggtaacttggtgccattactgaacttattttagacaactcttgagaaatatgggaaagttgaaaagtggtctgttccccttctttattttatatacatagtattatttaatatatctttattacattttatttttaaaattgtagctattttattcattttattgtgccagccatacataattgaataattaaaaattactgcctgaaagaaaatgtcccacaatcccattaatcaaagataacttcctttaacattttgctgtgcatcattccatacattttttcagtgattaatatccttatttcccacaaaaatggagtcctgctatccaaataacttaaccaccttttcctgataacattatcgcagatattttcccatttcactcaatattttgctatgctacaggaccccattgtatgaatataccaccctctaggtaatcagtgctcttttttgctattaagcaatgttatgatgacctttcttgcacgtgcatttttcacatgagtgtccattacttcctaaggataaatccgtgttagaggataaacactgtaaatgcttttaatatgcagtaccaaattgccctgtagaaatgagcctgtttacacactctctcagcagtgtctgatgagtaatctgcatgtttcaaaatgagctttcattatttttaagaagcgattttgtggcattagagaatttaagtgttggtttttgaatgaaagcattggcaagctgaatgaatttgaagtggtgttgggcaatattatttggagctgtctctcttcacacaacctttctgcagcatttttgcactgccttgataataaatcagttctattattagtggaagacagagagactctgaaatgtttaccatcagccttcctctgtgtttaggagctacgtgtatgaaactatttttcctcaaatactattttatatttatctgtgtagttgaaaagcttgtgcagccaagtgtctgttctcacattttaggactgcattcagttttgatctcctgttttaaatattttttgaatcaataaatttctgtgcatggtgcttggcatgcagcatatatacatatacatatgtatatgtgtatatacatgtgtgtgtgtatatatatacatatatatatgtatataattaaagtaagaaaaatccaaggacctctatctcctacaaggctacagagaactctttgaaaaaatactcctttatcttctaggtgagacagttacatactcatttgaaaataaaaaacttggaattctaaagccgttcttgccaattcctgcaaatatagtgctcagatttcacaccaggttattaacaatgacatggatgtctgaaatgctggagagagggttggacccagcaataaagaaatgtcgctaggttatgttaaattttcctcttggacctcaaaaaatgcccctttggccagagctggataaagttccattataaaaataagaggtagtacaaaaaatctgagagatttttgtactaaaaatgtacgattggcattccaaagaaagtcgtatctgattctgtattatttggggttcttgacagaaactggcttgacagtttatccagcaaacattactaagacatgttctgtgtcatatccattgttttaagcattctataaatatcaactaattaaataccattttgtgatctatgggtattcatattaacccatttcacagataaggaaactgaggcacagagcagttatataagttgtccaagatcactcagccagtgagtggcaaagccagcagtcaaacccaggtagcctaactcaagattctgtgctcttaattacttagctatgctgcatggcatatgtaaacatacacactgttaaagcagtgatggtttttaggaaatgttagcttatattttcgacaggaggaaactggtcactattattctctaatagaccatatttcttacctttgactgcgcattagaatcacctggggagctttccaaactcaacccagaccacatccctgacctagtagctcattcttggaaggtgagacccaagcaccagtagtttttaaagctccccaggtgattccagtgtgcagccatggttgagaagctctaatctgggagaagagtcattattgatggccaatattttatcagaaacatctgatgaaaaagagtactgtggccatgtcttgatacacttcactgagttttctcagaggtgagcctattcacaatggagcaatcttcttcaagtggaggcagtttaagtctgagaaaaattattctttctgaagatgctgtttccagtgatattttagaaaagtcaaggtataaatccattggtgttaatgtaacgtagccagctgtttcactttattagtcaggtgagtggaatataatgctcttactcaaatcagtgcccagttgctttcgattgtctgcctctgaattttgagttgaattccaaaagaggtaagagaaaatcggtgggtagggaaggcaggccgcatctcagccagatggctaaacagcatgagacttgggctgcatcttcagtcctctgtgaatgctgtagaatgacttctttctttctttgactacacacgtaaggaaaatattcagcacatgagaatttggaaagagtttttctgttggagcagcttagtgaaatcgaatagcaagatgcctttcaagaaaagtgacttttagtcatggtggtatgcgcatagcatacatagtgtttaaggaaattgaccaaacatgggtcagtagttaacaataaacatttctgctgcttcatctgaatcatgctgggaaagtgaacctgttgtctggggtatttattttggaattgccagtttgttcaaacaagactaagtcacgttggggaaatggtgagaacaatctcttttggctagacacttcggtttcagaagcctgtcagcttgcaggaatccccactagttgaggtgcattagggcatttctcatggctgtatatgaaagctaattacagagggtcttgtttctgtttgttcctgccataaagtgtcttctagaattgctgttctgtgactgctgtcttgggccatattaaaggatcgtgatggtgggaacagactgtccactgctgttatggggaacaacagagacaaatggtatagattcttgtactctttgtaacataatctgtgacccaaatcatcttataaattgcaaaatgtattgtaaatacaaaagaatgtttagtagatataggtacaatataaagaataattttaaaattctaacgggcccacacccccagtttaagaaatgggaaaatagcagctccttaaagacctttcctctgttccctttcccagttgcataacctccagagataaccactaccctgacttgtcactcattttcttccttatctttttagcatccagagttatgtatgtatccctaaacaatatattgtatggttttgaaaaccaagcagcaagcacaaacctagctgtgcaaggaaagagagacattggttttgtttgatgaaagcccaccaagtctctgggagaaatctggcttctgctttcagagcttattgtggggaagttggtgggtaaagccttgagtgaatctgaggaaaaatgggtctcctgataggcaggacatttgacaacacttagtgtggaactggtactgagcgcccagcaggaatgtggtgggggcacaggctgctctgcgtttcctactcttcagctctttgatgcctgcctccagttctcagaagcctgccttggagtgaaatgagagtcctttgctggttcaggcagtggagaagaacaggaatctcctcagcccacgccaggaaaagcaaaacagaagaagcctcatccagctcaccccatcattgttttcaggtttaacggcagcaggcatcttgtgatgaaagttctcagtgtgcccctctcttgagtcacattgcaccaatctggactggttgtcttcttttagtacacagctgtcatccggagcttcccttggcctctctcctgagtcagagcttcttttctttttatatcttctgttttgcttgctggttttagtggagcacttccagtaactttgtgagaaagggtacaagggaggtaagtttttcgaggccttgcatacctgaaaatgtctattctactatcatacgtggtgggagtttgggagtagaattcaaagctctaaaggaaaattaatacgttgatctgttgtcttctgtttctactattgctgtagagaagtatgaagccattctgattcctgacaggatacttaggacctgatttctttttctctctgcaagtttataaagtctttttgtccccaaggatctgaaatgtcacactaatgggccatgacatgggtttgttttcatccactatgctgggcattctatgacatactatgtgccatttcattctgacacctcaattcttcagttttgggaaattatttttgaaacatttattctccatttttcttttcattctgcaactaacactcaggagctggaatctccataacagttatctgattttctgttttctcctatttttcgtctcttcgtatttgctctaattttggagtaatatcttctaacacttctcttatttttgatttctcataataattttcaattccaaaagtgtttgtttcggttctttagtttcctgggttaaaaaaatcattttcttattttatggatgtagtatcttatgtctccaaggatatcattggtatatatttgcttaatttttctcctaggtgtatagtttctgttcccagtgctcttttgtttgcttattttgatctgtcttccttggtagaggcttttctcagatgtctggtaatccttggtttcttgggaactagaaagctgctctgaagctaagcaggttggtggagcttgttgaattttttttcactatagagtgatctgggttgggcatttgttgggaaatacctatgacaatatatctttagatctttcaccttgggttattagatgccctagagaagccttcaagtctcctgcaggaagggtaggtctagtgcttagtctgggagcttcttggggaaagaggacttgagggcagtctctctgcattcaggcttcagtgtgtatttggtcacttaatgaccctattttcattagaatactcatgacctgactatgcctcccaggataggtaccctatgttttaccctctttaggaaataatcctttggatattttcctggctggggaaagtgcagtccctctgtggaatggaaaggggagctagacataacagcttctcagatgccttcctttccagcctctgcacgtttgagacccccttatcccccagtttcagaggagccctgtgcccattttcagctttggtcactgctggtttgaggttttttttttttctttttttttttcatctttttcccttgcctgctgagttggttaccactcatctgtctgctttggagcttccaaaatgttgttcctattgtcccatctcctgttctcctgagtttgtcttttaaaaaacaattcctttacgtgttttttatggggtttcaagagagtgaaattagatgcatgtatttccaccgacttaacctgaagggtagaactgttgtttcttttttacattattgaatccagtacatttttgactatccaaagcccaaggcttctgaccatttatggaacacctttgtgccaggtactgttgttgagttcttttcatgtgtagagatgcaagtaagaatggatattatccttagtttacaaaagacaaattgaaactcagattaagcagtgcatccaaggtcactgctaaaaagtggcagtactgggatctgaatgcagtccaagatttgtgttttgaaaccctgtgaaggtttttaccaagtccagttcttcccatacaccaggggccgagttgaaataatgcttgtgaatcctattaagatctctatgagttaactggactttgaaggagaaaactattctgacatgttttgagttgtgtaaccttgatttacaaagtgaatggggcacccacaaagtgtgagaagcacctgctttccccagctgcagggactcttgcctccctgctagcttgatgtgtggctgaaggtcattcatgggcactgttgtgccgtctatctggagaacaaagcatgcatggttttctggcccacccagtagaatgtgtgtcttatgggtgatattgtgcagtaatgaaggacttattttctatatggccacaaggctaggtaactcattacccattcagtgtcatgagcaccagcatcacatttccctattgagagttttgctttttttgcaactgtatggagtcactgatttgcaaaatgaatacagccataaatgggagctgtagagtctttacagatttattctttttttttttgtaaacctttgtcaaaccaaattgttcagaccaaattatgtatcaaaaactgtttgttttcagcactaaagagctgcctatagccttaagtatggactgggtggatttgaatattagagtattagaaatattgctaaacaatgaaatcttttttcccctcgagtgttgaggggtgttatcattcttgtaacaggtttcagcttcagtgagctttctaagcatggctgcttagttaagtacaagattctgtttatattctttttcataactatagctagcccttttcctataagaatgtaatataaaatactgacacatagctgaaaataagcttttttttcccccaatgcaaagtaatatcaacctgcctctgcctatgaaaccttgaaatgagctggggttccattttcatacagtgtgtcaagccaaattatttttagtttatttagagagaacccttttcatttaaagggattgaaagagcactggaccaatttcagctgctttaaaatgtgcattcggggtcttttaatgtcctctccagttttttgttttttgtttttaaaagaacattacaaggacactctataaactgcattactgtattggttttcaaatttaactagaccttttacctagagaagaaaatgatgggtaacatatcccatgagtattttatttgagaggaataaaatgcttaaagtattaaaatattttatttttaacactttttcatcatggggatatcatctcttccattcttgcctaaagagaaatatttaggtgtctcattgtagaaaaatctgctattccaaagccagatttcaaatcccgtgagaaatgtagaagaccttgtgaaggcagacttgtgattttggggtcaccatcactctagacaacctcgcacaagggagaatgactggaaagaaaactggacttcagagtcagatctaggtttcaatcctgtctctaccttgcattcttggaaaagtcatttgacctctctgggcctgtttctgcatcattaaatggggataatttgcagcttgagtagctattgtaaggtttagagagaatgtacatcagaggcctactgtggcaactggtgtgtaattgtgggttctgatcatagtcatagccctaattgacagcgtttagtacttgttagcttctgttctaagagttttatgtgtattaactcaccaaagcctcacaacaactctgtaaggtaggtactatattaatatctccactttacagatgagaaaactgaggcacagagagtcttcccagggttatacagctagtaagtggtggagctgggctttaaacccacaaagactggctccagagcctctctctcaacggctataccttaaccactatacagggatggctgataatgatgttctgaatcgtggtcatctgcagggcagagttcctgcctcattcatctatggcaggggtgtccaagggcaagaatacagtcatggattcttagtttctgttttggttggccagcaaagccccttcctcatccctcttttccgcttattactaaagacagaaacttaaaaaccatggcttcaggctgctaaaagcctaaaaacaaaacagaacaacaacaaaataaggtgggttggacaagcttgatctatggagtacccgttgcctgctataggtggtggtagattctccataagtgcttgctgaatggatgtatgaagcactttccatagcttactgaggtgggctactcttgctacacaaagtgtatttttcctcagagccactctatgcaatttccttgagcccctatgaacctcctctcacctttgagtgctggtaccatactcagtgtcagtattttcactgagctttccatggcatggccagcctgtccacaatcaccttccagtgactctaaaagatttccttgataaatatcgactttgaaagctattccactaaagcaggggttggcagaatttttctttaaaggaccagatagtattttaggttttgcagggcacagggtctctgtcacaactactccactgcggctcaaaagcagccacagtgtccgtggctgtgttccaagaaaactttatctacaaagagcctggctggttgcattcggcccgagagtgctggttttcccactttctcgtgctgaagaatcatctttttcaagtagagattcctgggcctacctctgttaaaagataatattcagaaaaggcaaaatcattactttcatacagataaggatgaacatgttttaaagatttcattttacccacatgagggagcctggcagaagttataagcagttcaaagggaaaaagtcaaaaagcacaaatttatattgagtaaaggaatagaattgcaaatggaagcaaaactgattttttcccctaaagggggagggaagtcaggcaaaaccagacaacgacagagtttttaatattttccagttgcctgcaacttatgaagttgcaaaatagctcaaactcagtgagagcttagaacctgataacctagagggatgtgctctatagacaatacagagttttgcattttatgcaccctggagagactggttcggtaggtctcatgttgtacttagaaatctgcattttgaacagactcccaaagcattggtcaggcaggaagacttcatgccacactttgagcaacactggttcattatttgtatgctattctctttatttagaatactccttctgctctgtgagcctctcttctgatttagggaaatcagccctcatcttgtgaggcttacccatccatttgatcagatgggtgatagttttctttgttgtggggattggaagggacagggaaagattgactactgggaaaaacagcctcatcttacatttttactatttgtttgttcacatcggagagaaggacaaaatgatggagacttaagcgatacgatgatttaaaaatattttgggtggattaaggaaggtgtttgtaatggaggaagaatgaaccttggaagtcgttggtgcagtgaacatcaggaaggtggaggaaggaagatggagagaatcaggccatcactgggaaggaccatagggtggtacagactaggagaacaggaagcatgaattctaaataatcaggagtacagagacttcaataagcatgttagggaagtcagaactcgttaagttcacaatccattgtacatttactttcttactgatctttaactgtcagccactgttcatctccatcaaatgctgttcctctctggatagaacagcagacctggcttgtgcatttccggagaatggggaagttcagaaagcccccagactgtcagccagctgacttcctttttactgggctttttctctgtgcgaataagcaaaggaatcacacacggacagatggttgggtgggtgttcttgatagcgtgtatttggaagttactgtcaagtcagggtgcatgaggcataattccccctctgatttgctttccagtgggaacttttgtgtctgagagagagtgggagagtaaggagggttcatttccccacaaatcttttactcaaactgtctggcttctcagactatacctctagtcgctgagctaccttgagagtggtaccatttcatactagctaggagagtcttcatgttaattcctttgctcagtgagttcagcagtttacagggcagacattttccttcatttgattctctgtgagatgctgtgttaggtctaggggcttcattggacaatgggcacaaatcctggctgtatggggttgggagttggtggtctctctgcgggtggtggtaggtggtaggtggggaggcatctgggtggcacagactgtggaacaaagtagttgtgttatagtggaagctgggtggcttttcttcttggcggtgaaactgtgtctttgaagacattgcactttggcacctgtgccttgctaaggatttcatccctatcttgtctttgtcctgagattatatctcaggacctgccaattttgccagaaatgtcaagttaccatgcactgaaaaatctcagacagccaagaaatgtactatttttgctagcatcaagagcctaagtgataagagtgtccaggtggtggccactgctgcccctgggatatctcaggcctcctgcttgactgggaggcagcagccacgccagctgtttgggccccactcacaccagggcccccattgcattggagtctgccctactgtggaatttgggatgctgcccttgttgcattcgctctgctttgagtacttggtgcttcctaaaagagcacagcaagtgttctttgcaggtgatattgttcatgccctcaccttgtttagactctaaatggtacctgaaatggcataggttatcagtgtttattagctaaggcatggctcagccttgagtccctctcaagagctacaggaaaggcctttgcattgtctctaaatgatcctttgctgcttattttaatcacagaagccttaaggggactgatagttgtatgaagggtaggagcttgtttagcaggcaggacatattgtcattttagattcataacccttcattcctaaattagattgaaaatctgagcagctctgtgacatctacagtattgacattctcggttttgtgttcatgggttgccaacacagagcatactccgacaaaactgtaaaattgtatataacttaagaatgaatttttatgattggaggctctcctgtattgtacaagtcatcttattttggggttgcagatagtaataaatacagaagttttataaacttacatttggaaattaaataaagaaaaatcactaaggaagtatatgcttcaaaccaaaaatgaagctactcagattttcctaatttaaacataatgtattttcccattcttttccctaagacaatggtatctatcccctgtgctagagaaagtagtgtgatgtggttattgttatttagacccacttggaagttcctgagggacatggcgagggtggatggacttgtctgcctgtgtagcagtgtggaagccatgttttaggaaagaagtggtgggacatggagagaaagcaggtaagagagttgtgaatggggtagggtgacttctacaagtacacagttctgacgttctccttgcctttcagttgcaactctaactcatcagtgatgataggccgtcaggaaaatcctctttgtggatgttataaaccctaaataccaccctgtaaagaattcgcctcctcatgggagcagatgggatggccatacctaacacttgtctcttattgttaagcaaagccccatcttggtctttaaatcatttcctgtgagataggctctgaacatgtggcttttgaaaatccctttcttagggcccttggtttagaaattgcttgccttttctgtttgagattgggagccaggtttatcttaattcattctgtgtcacaaatgagacagaggacttgttactgcagacctacaatttttgtctggagaaaaggtatgaaagggatcagaatctcccctcctcaactccagcagtggcctgatctggcccctagagacctgactacaaggtgtggacagttcctctgttgtctactgtccaccttcaagggatcaaacccagttctgaaacccacaacctgtcagagcagagaagaacccaccatcaggcaaaaggactagacatagggcaggtggaatctaagaatatcttggcactacattgggtgaggaatatagaatgtggggagacttctgattggtctctgccccttggcacgctgaaattcctgactcatgaagggcaggacatgtgtttttcctcactctgttcccaacgtttagcacaatgcctggcacatagcagaagcccagtaaatatgtacttaaagcccgttagaattagtggtgctttccgttctgaatagattgggacagcctatggatcttgaaaggcataagcaaccaagggtgttagactctgtagctattaattaccaaacaaaattatagtcttgtactctaagaagcagccatgtcttgagtgagaaggcttaggatatgaggactagatatcagcaaggataccataggtttggaaagacattttaatttacccttagaatacacaactttactgatttttaaggatgatcagcccatcatatagcactttattttttcttttaaagacaatcctgtttcatttaccttcacttgacacaggagtttgagaagtcctgggcaggtatacctggttattttgtcattggtagtctttttaacttttagaaaataatcctagtaaactaaacctgagcctctgaataagatgttgtctgcctttgtagctatatgagaagagtggcagaccacagcttttgacggggatttttgaataaaataactaaaaccaacaatacagcaaaagctcatctgggaaaaggacaaagagtaaactagtaaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcgtgatctttcagaaataaataaataaaaatgcagtagcttcctgatcagaaagagggaataattgctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttctgagctgcagtgagctgtggttgcactactgagctgtgattgcactcaaggctgggccacagggtgagaccctgtatttaaagaaaagaaaaaagaaaagaaaagaagctgtaactttagttaggattctgactggtatgtgatgtcttgcattagatcagaattgggtcctacttgggaaggtggagagattgagtgccatgttggcagtttaccttcagtagaatgtaaagtaagcccatggtgaggcaaagaaaagcagtcctagttctcatgcctgtctttaatcttggtttctatgacttgtttagtccagacttggttctttcccctctttttctgatgttgatcacgcactagtgtgatctgcaaaatgatatgcaaatattagttgtgtgtatatttctgtttgtttgggatagccttgcctactgaagagaataagaagctgggtttctcctcatttacataacaagtaatatggtatggaagatggaaccgaagatttgaggtcagaagacctaagttctatggcttttctacaacctagatggtaggtcttaaatcttggttgatttgtagtttgttgttttatctgtacagttgaagctaacccttctcacctcacagggaagttgtggagatccaagagagcccatgtgaggcagcactttgtaaaccctgaagtgtgatcattgtcagatttatttactcctatttgtaagcattactagcagacccttcggtttctgagaaatttggctttctttttgaatgatgaggcaagcactgaagttaatgccatgtggtaagatcaaagaccttcctggaactcagcttccattcctcccaataatcatgaagaggattcaacttcaatcactgagaagttgaaagctcactgtgttctgggagtttctcttcacctggcttccaaagcaccaccttctcttggctatccttctatctcactggttgctctttctcagcgtcctttacaagttcttgttctctccccattcccttaatgcagggtgggttccaggtctcagtctgtggctctttcctctatactcatttggtgacctcatgccatctcatgactttatacattattaggttggtgcaaaagtgagtgagggttttttttgccattaaagtaatggcaagaacttcactcacttttgcaccaacctaatagctcaatcctgaaaactcgtagactttctcctgaaatctggactcatattccatagcatctctatattgatatcccaaactcaatgtgtccccaaactgaacagatttttcttccctcaaaacaaaacgaaaaccagttctgcccacagctgtacccttccttaaacccccacttctttatttcctaaattatgctctagatacttctccatggaccccaccccccacccctcagtgcctttggtagagtcacaaggaggagaaataagtgtatctcagtgttagaactgaaacacaacccacattgtcatccactgtgcttattttaaggatgaggaaacagacccaaggtcacacttgggatgcatggattcttattctcttggcagacaactctgagagcttttgagtgtttttttgttttgttttcatttgtttcagatccatacagtgtagtcatttataaagatggatagcctaggctggctccaggcaagaggcacaaccaaataatgtatgagacataatttgcctttcagcattgctgttatatacctagtaagctatggcccccccaccagccatcaaaatgttgttatttaaagcttcacattgtaaagctgtattatgcctaccagctggaggaaatattgctgccagattggttctgaccacacacatctcttgagaccctgaaaaccaggttcatgatgaaaggtactatgcaaggacaattattgtatttatttttaggttgttaaattatttatgttaacagtcgagagacttctctgttttttaactaatgaatgttgacttctctaagtaaggttagtagtgctcagtaaccttacaggtcactgaagaaataggtttcagttattaatgttctctaagctaagaaacattgcctagaaatagtaactagagcctaaagatttaagtcaagaagaaacaaataatcaaggcagaattgtctcgcccaattataagtagtgtttttaatctttctgtatcttgctcccttgaattagaaagcaaaaagacaatattgaatattccttcctctaaagtggtagttctcaaacttggctgtacgttggtatcacctgggttttaaggaatattcatgcctgggtttcacccccagataatctaatttagttggtttggggtgtgtcccaggaatcaggattttttaaagctccccagatgatttttaatatacaactaaggtttgagagtttctacaatgaagtcttgaaagcagtttgcagaggtctgtcctaattttttgttttctggaagagaccagacacccttggaattttccatatcttttactcatttatggaagatataaagatgaaaaatagttcccccttgcctgtaaacagtatacttttccagacccctgagaactagcaacatgtatctagccagttaccaaggcatggagcagatacatttcccaccctgttgagcttaggagattcttattattgtctcccttaatctgtctaaatcctaagatcagctcaccaccacccaccgagtaattgcaggcctgagatttgaaccctggtctttctgaatttaaaaccccttttcttaactactgaggcaaagtctagtaggattcaccaaatcccattccatcttcttcctaggcacacagctagactacctttctcagcctccctcagagttaggtgtggtcaggtggctgggttctagttgataatgaaagcagaagtaacgtatgccacctccaagccttgcctccccaggtgatcttccattctttcctcatctgtcggctacaactgaggaccatctttggatggctcccttccaaatactcacagtgcaattctatgtgaacaagaaaaatatgttaagggagagacttgagggtttatctgtttgagcagctagtcctacctgaagataactactgtgtagtaatgacccaatggagaggggaaaataatagagtagagatcccaggagatgagatccagagcacaggtgaaagcattagttttgaacaggacacatctttgattttgagaattgggaaggaggatgaagcaagtgtggatacatgaaaattttagacgtatgaggcaattttctttctgatagcttcaattttctttgtgatgtataagatataagtcatctgtgggaacttcgtgggaccaagtaggtagtctgaggagatagtgttttggaaaacattatcttatggagagtggaaaagagatccaaaggagaaaattgcagacagtgtcaggaatctgttgaggatgggaatcacgtgaatttgtcaccgtaaagactgtttcttgttcactgctatttcttcagtgcttggcattgtgcctgggacagggcaagctttgaataaatgattgaaaaataaatatagtggtactaaagaagtgagagctggaaaaatgagagggctgtggtcagagagtgggattttaaatgtactattctggaggtactttcaggttctgacaaattttatgttctggctatgggagtaggtggcagacatggaatgaaggtgaagatcattgccattgggaatacttcaggactgagatgctaaaggcaagaagtcaccctggatgatagggcatggaataaagtataaccatcaaccagctgttaatctttaaaaatataaaaagattggtacttgacattaataggaagtgatagagtgtggtatatggtatagccagatggtctgagcatcaggagagcaggatgactattcgggagtgaaagtgcagtgatccggaagttgcactggggcatgagaaagatgttaaccgtgcctcctggcaatgagtgtgttgggtgtaggagaaagggccacaaaagatgcagtacgctcagaggagatctaggttccagagagggctgggaagtgaaaggcacattcagaagagaggagtttatttctcaacaaaataactgagtaacaatgggaagactttgggtaggtgtgtaggggtgctgcagtgagtaccagttatcccttgccacattaatgctgcatagcaaccataaatcctagagagcattcaataattactttattttgcatgtttctggagtcagatttggtgggggggtgcctaggtggctctaatggtcttggttgaacttacatgtctgggagttacctagctgtcagctaatctatactggctttggctggggtaatttggctctgcttcgtgtgtatctcatctttcttctgggatcaatggactagcctgggtatggccttatcatagtaaagacagagacaagaatgaaagcaagcagaattgcttaagtgctcttcaagcttctgcttgagtcgcctttgctaacatctaattagtccaagaaagtcacatagctaagtttcaaagtcacaaaattatgtagcaaagggtagggatgtaagaagaggtgcagaattggggcattttttgcaatttatcacacattgggaaagtgggtaaagagagaaattgaagagactatggctggaagaatttgcactgagggatgagcaaggatgacttgtaagttaagccagtgtgatggttggctggcagaagcattaggttccagtaggcatctgatggattggcagtgggcactccgagcctcctcagaggaaactgatccacttaccctcttggccttagtttctgcatatgtaaatggagatgctaacacttttcagattgttacgtcagtgaggtaatactttctaaagcattttgtaaacaacttaaaatatgggggtaggtgtgaatgtgtgtactagtccaatacccttttccagcatagataaactgccaggtagctagtccccaggcatgtgagtaagcccagtcaagatcatgagagccacagtgaggaatgttggggccagattaccatgtaaagtctgtgtagttgtctcaaacccctgccaaagctaaagtgactcaaaccctatggtttaaaaaaaagtctcttaaaaattattttatctctagtatactttcaaactgagtggtttttgccccttgtggggggatggcacagatatacatatgtatctggcatatgatggcacagagtacagacactaaactggtaataatgcatgcttcctctagagggcagtgccctccacccagcccttgctaagtcctctggtggccacagtaggactctatagctctttctttcagatcacctgctgagagccctctggacttgaatatgggaagcaagtctgcctaacttcaagtggcttgcactgggctgtctctctgaactcccttggatgaaggtgaacttccctactgtctagaacaggcttttcagatgcagagttctagatcctattgttttctcctgagcaatgtccagaaataggggtccattggcattaatgccaagtactctttttatacccccctccacaatgcccgctgtggggcatgggagctgtgttggtaagtggactcccaggagcatcctgtaagtcccaagcaaggtatgcaaatgactccgggagtgatcctggtcacatctatgaatgaggacctatttatggatgtggctttggaaagactttggcaaatatgtttttttttgtttttgtttttgttttgttttttgtcttaggaacacttacggtggcaattctgttaaaaataaaaagagaaaaaaacaactccagtcctcttttactgagcagggaaagagtccttaccggtgcatagtgggcagagtatagtacccctctgtggaggctttcaaatgaatgtcgtgcattttgacttaagtagcacaataaatatctctgcatgcaagattgtactatctgccttattcttctgtttcatctcaggtcaatattggagttgaatgtcaaagctccttatgttatattcagctgtcaactaggtattctgatggtttttaacacctctgacctcttgaccattccttggtggatttggaaaactgagttatttatcaatttatttacttgattctcatttcacatttaccaggtatttgtttttgggggatttgatgacatcatcattaaaaggaatgccattcactggagtatattaaggtttgtgcaatgcaggtggctttgcatttttatagctatttttaatggccagtaagttttaggccttggatggtctttgggcctgtcctaagtaacacagatataatcaagaaccatgttgtgtatttcaaatgtttttctcccttgatatttttgttttctttttaaagaaaatctatggcagttttgttcaatagaaacaatatgtgagccttgtgagtgattttaaattatctagtacccacattaaaaagtaaaaagaaataagtaatatgcatgaaatgttctgtattctttgtttttcatattctttgcaatctggtgtggatttcacacttagagcacatctcagtttgcactagccacgtttcgagtgctcagtagccactggctagtgcaatgaatcacacagacctgtagcattaagacggtgatgtgatacaatgtggagaatcttccaccacggtttgtgtactttgttgttgttgtaagcagcagcatcttgattaaatttgggacaatacacttgaattacttaaattgcatccctaattatcacacggttcacttgattaccctttagcaccttgttgctttttgagtagcactggaagaaaacgtgttgagaaccactatactgtttccgaaaaagctttagaatagcaaagctaagcagaaatattgagcctagctgctctgagagacagtatttatgtggatgcatacacacgataaaagactcaccactttagagcactcctcttaggaaaaagggacgggaggtgtgatgcttaggaccaaatatctaagagcactacagcttgttccaccttaatgttccactgacctgagggcctccagtgctccttaagtatggctaacattgcatgtatatgtaggacttacaggcatttggccttctcctgggctttttagaaaaaaagtctggggaaactcagacttgtatcaatttaagtctctgctcaatttagtatttcctgttctacaatgatagagtgcctttagaatcttgtctatagactctggaaaccagtccattctcatttaaaaggtattgacttttatttttttcctttgggctctaaaattggcctaattgtatagttgcagccagaatgagtttggcttccagtttacaatcttgtactatggaaggtttaggattcttatggttatgcttgagaagaatgagatgttttcaaaatttagaatgttgttaaggagaaatgaacaaaaggggataacttaaatttccccattttaatttagctattttatgccaagtttcaatccaaaatgtccagatcagtttagaaaatgattgtgtccttcatgtagtctaaaaagtgttaccatgccctgttaagtttatgattttgatttattgccaaatgtgtaattgtttctagaagaaaatatataatggatatattgctctgttctgtagccatctttatattcatgatttttagaaatcaacaacccacatgcttaaagggtggtaaatacacagatatttcctaacaaatattaatctaaaaggttttttttagtttgtttctacctcttatagtaggactgaatttacctccatctaacctcaaagttaggcctgatggtggggactatgtcacattggtaagtccaggtaaagactgtttatgagtatagcagtatcctcagtataatgtaattttaaatccacacatacaaatggggaccaaatacgtgtaatatggtagttatgtatacatctctactattctgatgtaatgattatgtcatgttcacggtatacctttaggccatttggggagccagcatgtctttttaaatccctctcattttttcttttaacctttagaactctctttttaatgtgatctgggatagatccagatgatctctttgtactcccaagttgccttgagaagatcccagtgatcagcaccacaattggtcagaaataccccatctgtgatgacaagtgaacagtgctcatttctacctctgcgctatgtgagaacagaaatacagcaccaagaactagataaatcttgaatactaaccttttcatctgtgctgtccatttatacatttctttgagtcaaagagggatggatatatttttcccctttaaattggatagcaaatgatcagtgggctagaattcttcattattcatagatgtaataatttaaaaaatacaagtggcttattttcttaatttttgaaaactccaaacatgaaagtaaatatttaccatctgagtctttaaacattgtttataaatgttttaattctggcatttttatagtggtggtctcggtgcattttatggcaggaagtttgagaaaaatgtaaagaactggtgaggattggggtggatgtgtttttgaattgccacagttcttttgagaatttcagtgccccatcaatttgcatagacaccatttgaataaacatggcctctgccaacaaatacactgaaaataattttcttttttaaaaaaaggaaagagaaaattccagtgaacagtttgcaaacttgagaaatgcagccttcggtataaaacaaaggtgtgctcagatagaacaaaaagaggagttgtcttttatatagaaagttcccactctgatcctcttatgcaaattaggaatgcaaacttgcttacttctgattggttgatgcaggccacagactattggttaattcaaacaatgtaaacagaaacagacagctatggaagtcccagaattaagtgaatttaggggttttctgggaatgcacatgtatgatgtgcctctattttggatttaggtcgttagccactcaggatccatcttgaaggattggctctttcaggattcacatttcattccttgttttgatgtttttccagaatcccaggtttaaatggagtaattgctacactttcaagacatctgtctgttgctttcctaatgtgagggatgtggattaaagaaacagcagttgcttcttgctatatgatccattgtaccttatgcaaagttaaacatacctaaactcttggctttcatattgtgaccataccccactaggacaatgctttcaataggtgtaaaacttccaaaggctttttcagctctggcacatctttgatatatcttttgcaattttttttttaggtctgatgactgtgttaaactatggagaagacacatcatttagagaacattctctagtggattgattctaaaattagacttgtcttaattggcgtaaactctcaccttctaattatgctaatgccattaagatttcaacagcacagcatcctgaagttgctgcagacaattgatctgtgttttctaccagtagcaatgatgacgctaattggtaaaattctcctggacaatattataggattctgaactagtatattattcatttagtttgcataaaactctccttctacactcaaatgctccaaaatcagtggctttttaccctttatacaaaattttatttctaagcaacactgttataagatattctaaaaaattgaatcactaaaatgctaagtttgagctgggggcatagagaatcgtgttaacaagaaccaccagagttaatttcagctactaattctgttgagctactttcactttacaagttcacttctgtttgcctgccggcagccagaaaggaagatttgaaatggttgtccttatgacatcgaattaatcttggaaaaagttgaaatctggttcaatttcataatttaatgttttaacattcattgactttcatttgccaccattatactgtcaggaagatgtctctaccaagtgttacacatgtgtatatctacaaaatggctgttaccaggagggaacactataaggcttcagtattacttgttgtcatcactattagtgagatttttttgcttcagtactcaagaatacaaaccagatcattaactgatagagaggaagaaagataatctgtaggaggataaattggaggaggatatttaaccatacaatgatagaagaccagaggttatctggtccagttcatgaactacagaagtctcttctgccatttcctggatcaaggagcatccaagctccagagatggggagcatacgacctcacccagtagtctgaggcagtgtgtgccataggtttacttactgggaatttttcttaagtatgtcttgttgaaacttctttttggtcttggttttgttttaggtaacaaagcagaataaatctatttgtacttgcatgtgatagatttttaggatatttaaagatatccataatacttttgtgatgctgaagccaactcaatttaaactatttctcagagagaagatttattttagtttttctattaaggagctgattctcctaattgatttagccgtcaagtagttgttgagcacatactttgattaaggccttacaaagttaagtaatgcctaaatttggccttaagggagcttgtccaataatagaagctatatacacaaatgaaggttacaaactgggccaatactcttatatacatgatgatataaagacatccttaattgattattttagcaaaataaatgttaggtttaaaaattttatgttaactatttagtgtatttataacactgagtgtgatagtaatatagctacttctccaagtaaatctaactagttaacttaactatgagcattttcttcaacatacacatgacaaagcaagcacttattttgaccttccatctttttttgtagaatttgaaattttgatactttattcatgtcaacatggacttcttatcgggtttcacagctaactgagcatttcttatttatagattagtgtcatttggtctcttaaatttttttctgtttacatttgcaagtcctttgtcaatttgaataaagtagaccataaaaggaataatattttaatacctatagattatattgctgcttgtctaagaaaatgcttaagcgacctcttatactgtgttcttagatgatattcactaacttgtttattcttgctaaaattttctttaagattttgttaagtacagccttcaaatttatacatgagatgattgctagatgcctgtcagaactatttcattcatattagtaaaagattgatgtaagatagcactgttattctagttcatggtggctggtgcttgaaaggatgtaaataaaaatttttaggaccagtcattgtcacttttaattcgaatcggaataattaaattggaattaatttaaatatgtatacagatggtcttagtgcaaagaaataactgacaagaaagtccttgaagttgggtgcctgataggagagactactgaggtattcgaagatttgggggagaggaaaagtcaaattggaacacatccttaagaatctaaaatctccagtagacctgcataaggctttaaaaggtaaacaccatcaagtacttattcctgtatcattccacaactcatgcatatatgtgaagaattgcagaattttgtaaaacgtttgtccatatcctgttagagatctgtcctgcagctaatttaaaactgaaccatgttcctcgtttctgggacttggcacttgactcattctcctgttaggactgtgaccttgctggtctgtgtttcaccccacagatctacatccagttgttttggctaggcccctgattctacctcatctgtctctgagatgggctgagttttataagtgggctggagaaaaccaccatggtagcagcagaccaatttctccatctacttagggactttattcccagcatccagattttcttttccttcttgctccttttccttcatgagggacctcacatttattgatacaactctctgcagcctccaggggtcctcataaaacttctttccagcctctcaggggtatgagaaaattgagactcaagaggtgcaaggatgagcacttgaacctcagccagatggtatttctgaactactgccgctcatgtgcataacctgataagaagccatggtcaggagggatccaggaagtgagcccctcccccaagcacaagcatgaagacatttatctagggcaaaggccacaaggggagaaggatgtggcccctgggtcggggtgggagaacaagcatagccctggttctgactccatggtgatcttccaggcagtgaacttgaatacctgctgcctggactcttgctgtctcttcagattatccttcctctctctctctctctttaatctgccttatatagatgtgtacttgggaatacttctatgacataacttccttccatgaaaataaattatacctttacttggaaccctgaagtttggaagagaaaggagctaattagtccagtcaattaagtcaattttaagttaattttaaatgaaacacacccctagatctagtttgaattttttaccttgggtgcaaggattttctagttgaggccaagatgccctcaaaggtagaaaaatactatgaaatacctcttctgttaggctttggcaagacttttgggggcagaggtggtgtcataaagggatcttctatactatttccatttcctgaggaagatgatgtaggtctctggttacatttcttaagaaattcacaccatttcccatctcagttgatgaaaattaatgctcttttgttcttagaaacatccttgccggaaagagaggaaaagtaaattctggaataatctaaaatgatgatgatgatacttaatgtctattgaacacttactatatgccccatgctatgtgttaacctcattcagtccttagtataaccttgtgaaaaaagtatgaatattatcttcatttgtagatgaggaaattgaagcagaaataacttgtcccaagttctacagcaataaattgcagagtaggactcaaacgcaactctgtctcaccccaaagcccattttctaaaacactgttaccactagctatgtgggcccttccagttgaggtaggccatggttctgagtggccctgtgctgtgcaggcctttatgagtagtaccccatgaagttcatcacaaacttcccatttctggcaaaggattctattattcattttcaggtgaaacttttaaaagtccttctttgtagccccattaattttatgcatttgctaattagggttttttttcattttgttatttatttatttatttatttatttattttgcaaaacataagggggctataccccagaatcaggccacatttgagtgcaataaacctctcactgttgatcagaacagctaagtatacctgccctgtccactgtttaataagtcaacctacttaacagcaggacagaagccattttcttttattgttttcttttcccttgctcatacaaaattctttcataactatcaccctgactttgagtgaataaccgttactcattctcttctcgtagagaaacatttaaaattgcaagttactttctgttcaaacagttgtccctgttcaaaatcaaatttcttgcacttaggatcagtgagactgctaagcaaatccccaagataagttttggatgagaatgaactcaaagatcagagcatcatggaaaatggtggaactccagccccaaggctatcatattgagcagaagtgaaagacaacaccagcagtagaggacagtgctgagtcacctggtgggaggcaggcccacagaggccaagactgtataccctgtgacagaatcagcatgaggggtagggcagggatttctttctttcttttttcttttttttttagtcagacagagtctcactctgtcacccaggctggagtgcaatcgcgcgatcttggctcactgcaacctccgcctcccgggttcaagcaattctcctgcctcagcctccggagtagctgggattacaggcatctgccaccactcccagctgatttttgtatttttagtacaaaaaggaggtctcgaactcctgacctcaggtgatccgccagccgtgggctcccaaagtgctgggattataggcgtgagccaccacgcctggccggatttctttttgtccataatttctctaataaaactacagtcctgttgaagaaacatcacgggacaaatagccaagatgttacaaagcacacgactatgtaagaaataaccccttcataattgaggctcattgttacatcctgactttctgggaggtgtttccttagctagcaaccctggaagttcctgtgtcctggttaggatttcagcttactgctgctgttggtgtcttgcaaattggcctttgggtattctagtgggcagatttccttcctgtaaaattccaaaaatactgtttttaattcatatgacctgtatgttcccatgaatacagttattctgatgttgctttaaccttgtgcaccatggcaaatatttgcttcctctaaaactccctccccagtttgcttccgttttacacgctcaaggccagtctattctaaaagagatatataatcttgtgtccttgctcctagacttagaaatgtcatggctatcattgcttcagttcaaccccagatcccttgggtggcccagctcagcagagcttgttttccttcatgtgctgcttagttattgttgaggctgctgaactcactttttccttcccagtgcctcttgaaacccagccatctttccccacaggagagtaagcccctgctgataggaatcttcccatgtgccacatgcacacagcagtttgccaacgtggatggctgccaatggttttctcctagttgcaagtttattttccctggatggcagtgctgtgccacacgggtggtccgtgacacactaggcttcccattgatagaagcttctttgtggagaagtgcctctggtgtacttggggttcccacagacatatgtgacagttgaataagtgaaaaaatattttcatattttagtgatttttagcttattttgcagcagaaggatgtgtcaatattagtgtacgctataggcccctcaagaggtaacagattgctccagccccgggggacttcactgactgttacatcagacctggagccaccagagagcaccctataggcagccacccatgattggcctattaatgaaagtgttaaggattccacactatgtacccctactttgtagggcatggcatgggtccctggctaactctgcaaagcagggagaatgagcaccttcctacaactgcacgttagggagctatacctctctccccgctaacttcccacttctggtaaaatgctacagtctttaatcttctgcccatttttaaaaaattgaaattgtattgacttacctccttcaccctatgtgactttctctctccaaaatcacagggcaggccccctatggtacaatctgagtgctacctataaaaaggtttttcacactgtgggttacaaagatcatcttagtgagtcatgatcaacattttaaaatattgaatacaatggagtagaaaatagaatacatgctcatagtgagggtaagtattgttttgagaaagccatgtttaagctgtatatgtgtacgtatatggatattcagcataaatctgattttttatgtagatcgtggtcaagtctggaagcccctgattgtagagccctatcttctaccttagtctcaaagtacctaccattcccatcagcttgcctttaaagttgggccagctcctgctctgcaaagcctcaattgtgtggaaccttccttaattatatgggccttgggcactccaggtcttaaatcattaaagacagattaaattatggccacactgcatgttctaaggcaaggggtgtactcatgggcttcagatttttttgaattaagacaaattggtcttctattaattcttggttaataagaaaattcaatttagcccagtatgatgctctgtaagcattttggatattcaaggcttttctctggaatgcaggggtttaagacatacagcaagcagggactttgctggggaaagacgaagtgtcttttcttttcatgctttaataggtagaaagaagcctcctagtgtacatggagaaatatatttagctatctttacgacaccctttgcctctgactgattatatggataaggaattgttttagcaagctctccccagccacatctagaaagtctcctcaaaggcatgtttatttagtctttagaagggacttctcgtgtgataatgagataagaatagcagcaactctgggttattgggcatttagtgttagtcacagacctaagtgatttactttacattatttcatctgatccttgtaacagcccccctgaggtgtctgttgtcatcccccttttacagagaaaaaaaataaactgggtactaaggaagttatgtaacttgtccaaggtcacatacctgtgagtggtggagaggggattccactgagcgtagcacacaagtccagcattcatatgccatgtgagatggccactttacatcgtctgatttggttcttatattttcccttctgcctggaatattctctcttgttcatccccagccatcagaatccattctatctcgtaggccctagtttgaatcccaccttttgtgaaatctttttttgcttttcctggtgagaagtgatttcctgctctctgtactcttgtggcacatggttgtctctctcttggcacatcacattctgccacatactgggttactgttagatgtaaatatgacccgttcttgggttgcggttcttatgggatggttctattgcttcttctttggtttgggtgagaatgtatgcactgtcttcatcagtggggtctgctttggcaacttcaagttcaggcttagtctttccctcatctctgagcaatgattcatgtcctaaagggatgagagtattttttttctcactttcattgtaattgccacatttcatatgaggaccacttattttctaattgtgattctatttaccagaattcttctagatttttctagattcttctttctggattcttctagaaaactcagccatgaatgagataggattttaaaaaatatatacccaagtaaaaatggacagttttgtactacaatggatctgtcccatattttactgtcatgtgccttcatgggttttgaaatggagcaaggaggatgccaggagaaggagaagtaggtttaaaacatgatggtgtgaaaactgaattttcattgcattttagaagcctgaaggtaattgaaatttagtttttcaggattgaatgtttagggtgcctttcttttaggggaagggaaactaccatttctttagccccttctctgtgctggactccacatttaacatgtttctgcttctcctggcttcttcctcacccgctttcaaaactcataaatagcataatagcgaaatatgagaacaaaagggcaactcccaagattgcatcttattgtgtttacagatatggaaactgaggctcagtgagattgtactcaaatcagctaggtacttattacctatctgataaagcctgaaatggaacccaggccaactttaccccaaagctctttgtccacagcatttactgttcaaggagaagcctggaaattttctgtttgtgatgagagagagactttcagtggacatctcctcaacaagcaagcccttccttcccttgccaaagctgacttgattaaatcacatattctttaagaagagtcactattttattgccttttaaaggtattttctctcttaaaatgctaacatttaactacagaatatgcatttaaaattaaattataagaagtctggcatttactgtgtaggaaggaaagattggagaaagatctatctcacacttctcaaatcacattaagtaggagacatcttcctaagagctgaggctgattctgctttggaggttgaataacagtggttagaagtacatttcttaagcacttgtatgtttcaggcacaatactaagcactttagctatatttcatttaatacccactatacctctgtgagattggttatcctcatttacatgaggtaagggaggctttgcccaaggtcatctgttaggtattcatgggagctgggttttgtgcctggtcagattaaaagccaaagcgtgtgctcagtctttctgctagaggatttgtgtgtagaatcttggccttggatacttggtacacaacctcccagtgggagatctcaagtatgtttgcagcatgattaatgcccagagtgcagccccctctccaagaatttctactgtctgcagttctgaagagaggctttgaactttcacaagtgaaggttttctcttccaggtgtgtgtttgtagttgaagaacaaagaaaactgtgcgatactagtaatgcaagttcccttgggaaggcatgtatgttgttcttaactgctgaacctattattgcttatctttaccttcagggtggcgttgacagagttaactatgacgaaaggagtccaaacccctctctgaaggaagtagctgtcctctgaccatctctacccgatagcggagttctctctgtgatgcccttctctggtataccctaaaactgaaatcttagaaaagaactatgtgcctctttcctcctccttcctttcactctcccctcttaattcaccttctgatcctttctttaaattttgttcatgtactccttcaaactctcaccaacaataaggtctgaattttgtctgatggtatgtaattttcacggtgctttcccattttgtccccatgatgcagacattatcttcattttgcagattggaggttgaggctcggaggtcttagccaagatcacagcaaaggtaggatgaaagagagagtaaataggtaccggaaaaggaaagaagaaatgcttttctcctggaatttcctccttctagtcttttggaaagtcctcttaccattttttctcaggccttatgaagcctttctccactagctgatgcctcatgctgctactgcctcttcattttcattacaaagtataaaatcattatttcacttaggtacaaagagctctcctccttttacagtagatacttgtcatgtttctcctgaaagccattaacaatttctgtttttctgtttccggcatgctctggggtgtgcgtttgtgttgccagagtgaatgtgcagcttctcttcaaccctgtctgcagtggttcccagagattaaagggagcacaccttgaggttatttgtatgattaaattgagcagctgtggctaggacatttcaagattggactggggattcagggtgactgtgactaattgaaaaactcaacaaaatgatgttgaataaggacaagtggacaataccatcatgagaggaaaaaagccacccaatctcccagtgggtatttataggacaattatgctttgctcattattgtgctgagtactgaggttgactcagaaaaagctgagaggttgtctctactctccaagagtttaaaatctagttggagagcaaagacctaaacacacgaaacaaataaggaaggaataaatggctataaacagtggcctttgtaatctatggtgctcagagaaatagacttaaatgccgcaaaatccagaggatgaaagattcaataagaaacaacctctgaccaaaccaaggctcctgctactgagaaggtgcacatgtaaatgattaagatagagtgtaatcacataatacaaacaactacaagagtaagcagctggagggcagtggttaaaagcatagactgcagtgatgctgcttgggttcaaatcctgtccctggcatttcctgatcatgtaatcttgggcagtttatttaaccactccttacctccatttcctcatctgtaaaatggggagtaataatcctacctcccatgaggtaggattattataagggttgaataagttgatacatgcttctgagagttcctagcccatggcagtgctttgtatgctgtggtgatagtgatgatgatgatgtcagtgaccagcagcccagaaaggggagagaacctctgctggggaagaatgggatggagagtggggaaacttgcacaatgggtccttagcaaagtttcttaaatgtccaggcagatgatgaggaaagacacaaaattacatgataggttggtaagggggctgcagcttgttgggtattgttgcagcgtcaggtttgagtataagggattcaaatcctgggagaagatataacccacattgggctataaaggatgggtagaacattagtagtggaggaggagggcttttcagtatgaacaaaggtatacagttgggctgtttgttcaaataaatataaaaaaggatgtgtaaataaagcaaaaaaagccacaagggggggaatgtgtctgcaatgtggttggtagctaagactcagcagaaagtacttaatactgaaacatcacattgagatttagcctatattaaactaaaatctccccaattttactaagaaaagcaaaattgttagaatggaagctgggtgtgacaggaaaaagatcagttccaaagggacaaagtataggttaaggagtgaaattttaaaaaatttaaaccagggccgggcacggtggctcatgcctgtaatcccagcactttgggaggctaaggcaggtggatcatgaggtcaggagatcaagaccatcctggctaacacaatgaaaccccgtctctaccaaaaaaaaaaaaaaaaaaaaaaattagccagatgtggtggcgggtgcctgtagtcccagctactcaggaggctgaggcaggagaatggcgtgaacccaggaggcggaacttgcagtgagccgagatcgcgccactgcactccagcctgggcgacagagcgagactccgtctcaaaaaataaaataaaataataaaacaaaataaaaataaaccagtttttgctttggtggtaatgaatgagagataatgggaaggaggggcagaaagggtggtatcttgcctgtaaaagaccaacaaggtaaatctctggggtttgtggaatcctgacaatgccctgtgcttctctcactctgacactatgaatgttgctttcagtgcaggatagatggctccagtgggtataataaaattaacggggcccaaactccctcttcttctcaaactgtgctgacctcagtaaactatgcacaggagagaggttttgtttcagtagggtgatgtataggctaaaattattctgagtcacctgtttgggggaacattttgctgagaagtgctgatgcttctgaccttgagcttaaggaatagctgcactgttgttctggtgacattctatgatgttaaatctttatttcaaccttgtgtgaccagacagtttactgggaatgaggagaaagcacactagtatcaaaataaatcttcatatagtctatcatagcttgttttttcagataatgagtgtccctttcgatttatatcttttgcatttccttaatgaattttgattttcagaataaattaagtattgtcactatatacagtcctgataaggctgaccttgttccccagagactcttttacactgccctcaacccccgtctgtaatagaagttgtttagaggcctttaaaggtgacattttgaagcaatctgtagggatgaataaatgacgtggattctagtcctggctctgcctccaactcactgtgtgatcttaggcaaatattttgcctctccaagcctcaatcttctcatttgtaaaattgtgagggttggactagagatgatattgatgaagatagtagctaacattgattgaatgcttctgatgtacaaggtgttattccaagcactttataaatatcaatttgtttaatcctcccatcagccttgtcaggcaggtactcgatcatcattgactccctcttacagatgagggaatgcacacacacaggtcacttgccaaaggtctcccggccggtaagtggtgtggaacaggattattctaacccaggaagacaacccctaagcctgctctcatggccactgtggcctcctgcccctcactgtcttgctgctgacagtgatgtctaatgtggtatccagtgagggtttagaaaatgtcatgacatccgtatttgcagtgaagtcaccccacccatctgcactcatacaccaacaccagtttgatcctactcaggctgctcattgctactgtgatgtttggcatcacttcagttggctggagtagggacaggggcagccttggagcccttgctaattcccaggagcttctaattctgctgctctgtgagcccattgcttcctggatgggtctgtccaccttgacagggtccccacagtaatcctatggtagacctgcaaacaaaggagttgacaaattttatgcctcttccaagagctcaatttaaaacagctgctattgctgatttgcaaatgaatgacaaagctgtgcacctgtagtcccagctacttggaaggctgagatgggaagatggcgagctcaagcccagcctgggcaaaatagcaagactcccgtctccaaattaattaaacttgtattcaagggatgatttgaaggaaaaaaaaaaaagaaaatgaatgacagcaaactttctcttgaacagtgagcataggaggggctgtgcagaaagtaaggagatgactattttctagctgcaaaacaacgcttatttttcccaaaagccagagcaaacctctggatttataactgtctagaagcttaacagaatgaaagattctctcaggaggcaattcagaacataaaaggattctggacggtacagattcttggtagcgtgcatggctgtggaaatacttggaagcactcaataataacataaataataataaaaatagcaatgggaaaattactgcttttgtttgacatttcctgtttaccagacctgaatgcctggttagtatattagagaaattatctgtttaaacctttcatcagcacaacagtttacatatgaagaacctgaaagtatagggttgttttttgggtgcctgcacaatttatgtttaagttaaggtacttcttgtcaattacctggcagtgaattactgacctgataaattccagacttattggtcaaacagacttaaaactctggtttttaaactagtaatagttggtgtactttctataaaaaaaaaacctgtaaatacattaaaactctggaaaaagtaatctggcaaaaagtatagatccaataccatagagcttttctataatatcttttgtattacatgttcataaaagaaagaaaaggctgcaggattttgtggcagacaggatgtggctatggctttggtaagtaaattttgttgcagggttggctcctacaaatattaatgtgtgtagctgtgggattttgtgaaggtagtgtttgtttttactctccctgaagtggcagtggaatagagtagaaatattaggagcagtgaatgcacgtaaaacaggggttcttagcaggggcatgtcagaaaccaaaggagggaggtgtatgtagttggagaaagtgcgttcgcaattaccattgcttggaagaacttgtgaaatgccagataatcttaaaggagggcatcaggtattttatgcttaccaaaagttgagaagctctaattacttccttgttcaagtgaatgatgatgtgtaatttacatgctgtaattatatgcattcatgtggagtggaatgtccccaaatttcaaaaattgcattaaggtgatagaatttggggataatatttattttaaaattctgcctttaagaacgagaatgtgcaagcacaggtgcaattatgtacttcattgcttttatctgtacttctgggacatttgtgtcttcatattgccagagaccagtggccacgggaaaacagattgtctcagttcacggtccctcactgaggtcagagcttaaatttcccagtgttccacttaggaagaacagtgctaatgtgtatcttttaagataactcagcctgaaagccatctgactttcagtgagaatgaggggtacactaggggagaaaataggcatcaaagtttggagagggctgtgctgcctatagattttcttctaattacattcacccagaaatgcatactttaaaaaaattatgcttactactcttttaacacagaagcttctactggttggttttgctagttaaaatccttcagttaagctctgtaaaattattcccccacttggattaaagggatagaacacatgcagttaatacataaaccctcatggtacatttgtcctgagttttactgaaatatttttggtagagatggggctttaccatgttggccaggctggtctcgaactcctgacctcaggtcatccgcctgcctcggcctcccaaagtcctgggattacaggcataagccaccgtgcccagccttgtctgtgatacaaaattttgtgtcacagaattctatttttaacactattactttctagaaggtaccaaacatactataaaataagcatttattgagtgtgtactaaatttaggacaccatattgggtgctcctggaaatgtaaaacacaatgatttggtccctaacctcaattgtttgcatgctattaagaggacaagatggacatttgtgaagtttcaagacaaattgaaactgtaatctgcaaagcaacataattgtggcagcattgactgaacaggctttcttttagccctttgatgtttagtccttattctcatggtttgattatggaagagtccaagatgctgaatgttagtcacagattgagtcctgtggttccggcagcttgtcaactctggttgctatacgtttggataatgttaataaattcattgttcaggagagcttacagtgtagagaaccaggttgagcacaagtcagatacacaaaatacaattaactataccaagtaaccaagaaaactaacttataaaagttcctggcatggtgtagtcaaaatgacttggcctatgattaaggacattgggtttttgctttgtcttggtccctaacagactgtgggacatggggcactacttagctttctctgagcctgcattcttatcttgaaatgggtatgctgattatgtgagcctcatgggattattatgaatactaaatggaattttatgaatgaatatactttataaactgtaaagcagcttacaaatgttagaggatattttaatttcacttgttgcataaaatccaagagccatttttcttcctcctactgtctctaatgattatataataacattttttcacttattctttttctgcttgtgttttgaggttctccctcacaatacactccaatcaaaataaagattatttgcatcactacatgtgtcccctcctattattcctgaccccttcatggacagtcacttttaggatttctattgctgtagcttagttgagccatttacattttatttattacttatagttgggatcttgctctgttgcccaggctggagtgccatggcacaattatggctcactgtagcctcaaactcctgggctcaagtgattctcctgcctcacccttggagtagctaggactacaggtgtgggccaccatgcctggctaattttttaaatttttgtcatcgtgacagggtctcgctgtgttgtccaggctggtctcaaactcctggccttaaacagtcctcccacctcaacctcccaaagtgctgggattacaggcgggagtcaccacacccagccaggcatctgcattttaactttagccaggcatggtggcataagcctgtaatcccagctactctggaggatgaggcaggagactcacttgagcccgggaggtggaggttgcagtaagctgagatcacaccattgtactccagcctgggcaagagcaaaactctgtctcaaaaaaaaaaaaaaaaagaagtaacagatgccaatattatgttattcctgttaggtaaggagggtccctggtgtaatcccaaatgtgcttgcttttttatttactatattatttactttttaaacatttatttttattataccctctagcattttggaaggcacttattttatatatgcttggtccttaggccctttcttcaccccaaatgagtatgttaacagattgtgacacagtgtgacacctcttcgtatgctgtattgtccacactgacacatttctgatgaccgccaagccctcattcttgcatgggaagagtccctgctgcagtaatgttagccacttgctgagctcacaagtcagaaggggggtggtggttcaagaggtgtggtgagaggctcagtgatggtgaaaggatatccaaaggatcctgccaatgccattggatcatttaagagagacctactttgaatggtccatagagtatggtgagtttggcaacaagccaattccttcaagatagtgtcttcatttatttgaagtcacttggcatgtagccttatgtggtcaaggacctaagccacacttttgggaggagctgagggaagggcctggcctcctgagaattgccagtattgcaccctccttgtaggccccctggttagccaaccagggattctgttctctcgctggtacaggctgcttgtggctacccgagttgggtttccccagggtccgttcagggcaaagggttgtgctgttaataggtctatcaccacagttttctgatgctgtacaggatgcagtgtttaaagtcaggctgaacacataggctgcttcacagtccctatcctttatttcaggaggaaagggatagccaagtctcgcagtgacaggcatgttaatctgtgggttgcccggctcacagccttttctgaccatctgttctcctagcacttgctgataagatggggcattgggacatggccttgccctcatcacagctgatggcttccgggaggtcacctgacctgagacaggcccctcagattctctcttccatgaatttgaaatttgtgttcaaggctgctcatcagtctctgttggatgtttgaattgggaatgctctaatgggaggcttttggacagagagagccagtgtgcatagatagagaagaatgcagctgatgtgcaagagaagtacatcccagagccctgactatagggaagggtagctcctttggcttcctgtcccaggaagtgccagcggcttgtgcttccctacaggatgcccatggccctcaggaagccccttgctcaaggtggcttgtatcatctcttgctagtagccacatgatttgtggttaagatactttacgtttgaataatgcgaggcaaaatgagttgagagaatggtttactaaaaataatatcaattgatgtaagaggtcagaatatagccatggtgcctgctggtccatcctgccagcaagccagtgcagtccttggtcacagtcactcacagtgtgtgccagggcttcagacagcccttggctgtgagtgaagacatgtggtaagagccaggggctttcctgtgcccaggaaagcatgtccttggccataacttgtgtggagcacaggtaggactcaaccattctggcccttcaatgcagctttaaagagtggtcactgggccagtcactttcagctgacactgtcaaaggggaaggatttctgcttcttgctgagaagccttagctttctaaaataagttgttttggtgactcttggggaaggaagaggcttatatcactggtctttgagttgagggacctgattaccaggttatacttttctggacttctcatttgtctaagaccacaacagtcatatttatttctaagcacaacatggaaggaatgcaacagcttctgatgctgtttccagacttgactattgcatctctctagccgtttttacatgtaaggatccctgcccaacctctcccatctcatgccctcttagcaacctcagaaaccaaagaaaaatgccctgttaatgtgtccttgatgagagctatttgcaaacaaagcactctttctagtcatatttcattatcagaaatgtgattacatatatatatatatatatatatagttaataacaatcccatgagggactcatctctttttcagggagcagatgactggggatgcagataaggtgtacccaaagtcttagaatacaaggtaaaaatgtcagtaatggccggatgcggtggctcacgcctgtaatcccagcactttgggaggccgaggcgggtggatcatgaggtcaggagatcgagaccggcctggccaacatggtgaaactccgtctctactaaaaatacaaaaaattagccgggcgtggtggcgggcgcctataatcccagctactcgggaggctgaggcaggagaatggcatgaacccgggagccgaagcttgcagtgagctgagatcacaccactgcactccagcctgggcgacagagcgagactccatccccccaaaaagaagtcagtcataagaggtatgtggaaaatcttaagcacatttagaagaggatgaaatgattattgtctttgagtgtcaggaaaggcctcttggtgaaaggacatcttcgttgtgctttgaaaggcaggtaggacctggctgagcagcgatggggcaggagggctgagcaggtagagccctgcatgtatcctgcaggagcaagcttgatggttgtgttgcctcagggtccaaagtgtagttgtatttgcccccatagccatgtaacgagctatgtaattttctataggaatagatctctggtgcaatataccattactaatagcaccttattagatacttcctctttttagttccaatatatgtcaggtttttgacagaatccttgtctatatgtgaaaagtatgaaggttgcaactatagtttttgtaaatttatctttaaccagcttcactgattcttaaagtcatccaggatttctgactctaagtgatgtagagtgtatttgcttatggaaaatagaagaattaaaataataaggcaaatactccttccagtgccatatcctcttttaaagaacacagctcattttcattgcagccccattacactgaacaggcttttctcttgctcttaatgtgtcaaaattgtatgacctatcgcttcctttgaagatcaaaggaaatgaaactccagatctgggaaaatggtttccccaattcctgtgctgttaatgctcctattcatccatgtatgaaaatccagggagataattggctagcaaaggctagccaattagctagcacaagtcttctgggacaatagtcagaatgagaacaggttttgagaaacagtgtaacttaggccttcctgctgggttcccagtcataggacttctgtcccatggttgcatccagagtctctatggggctgcccagaaagctgtttaccttctgttgtaacacctcccaaggcaacccactccattttgggcagtgcctattattagaaagttcttccttgtaatgagccaaaaatctgtttccctataactttccctaatactggcttaaatatagatttttgaggactggcctagaaacaagccaccaggtataacatggtttctcaaagaaaatacattttgagtttcaaacaagtaatgtataaataatccagaacacagcccagttcataaaatggagtatgcccaataaggggcacgggaggcccgtcccaggaaaggagaagggaaaaggccagtgcccccagggtcagtctgtagagtccgtttcttcccactctgtgtttacccatgtttcctggctattgacaattagaaactgcccaagaaacctcgctgtggaaattggttcagggtactggtttcctcacagctcactcgtaggaagcccttaggcagtataaagaaaaccaggcttctctttagcgttcacctacctagacgagagggtcagtgactgggtaatattggacagaggaactcagcccttggccttgactgctgttacttacactgccgcaagaggcagaatataataatggccaagaaaactgccttcgagttggacagaaattgattggactccgggctataccacttatttgctttgtgactttgagcacgttgctgaaagtcaacaaccgaaagcctcaggttttcatctgcaaaacagagattaagaataaatgtgatgaagcgtataaggagcacggtactgctcaataaatgtcgtttatcacacacatacatggttaactctgtttccagactgtgcccttcgttcatgaacagccaatcaaatccccctcccaggctgtggggtgagcagatacgatgcggttgccttatctcgtgactcagcccatcacttttggttagagctactttgaaaggcaattccacagtttcagagtgggttcttctcatatatgttgcacctgtggcctcttgtttctcttctcagggccaaaaccagagtacttaagtttcttaagctttcgttctagaatgtgcttggtggaaaaccaatactcaagacactacagttttccatgtgtttgtcaagctttattgattcttcagatcagtcctcccataggtttgttcctggtgctaatgatattgaacatttctggttcacgtcgacatacacatgaagatatttatttcccatactggcttttaaagtatcaaactatagcttggagtggaacatgctttcatttctatagatttacctgcttgaaggaggggaataatgcatagccttttattattttttttattatactttaagttctagggtacatgtgcacaacgtgcaggtttgttacatatgtatacatgtgccatgttggtgtgctgcacccattaactcgtcatttacattaggtatatctcctaatgctaatggatagccttttaaaataaatgaattattggccatgcctatagatcttatttatttttaattatggcagccaaattctcagggttgattcaaggaaaaatcagtgccaggatggacgatgctggcttatgaactcctcttatggaagagttaggagtaaagggttgaggagaaagaaccttctacagacaggctaaagaggacattaaaggaaagcagtagtggagggtcagggctttgagtaactgttctgccatttagtggcgatgaccttgggcacgtttcatagggttattaagaagattgagccagataaagcattaaagcacttagcatagtacagggcacacagatagtaagcacctcagttgtacattttttaagagacagggaaatcttacttaaatgctgttcattatcttggctcctaaccatcagctacagacctcatagagttataggatattagagcttcaaattacttttctattagtggtgatggattagaaggaactattcccatgctttctcatttagtcccccttgtggccaaaagcagacatttatgaagcaatgtgctggattagaagcaattggctaaagcacaggtttttatctgagtgcaactgccagggccttacagtagtcaggcccaccatttagcctccttgatgcagtgctagtgagaatagactttatgcctccaaagctcatacttacttacctgcctgctgtcttgtatttggtcagttagcaaatatttaactaagcccctcctgtgagccggcatttgtattggccctggggatacacccatgaataggatgaataggacaaaaatcctgccctcacagaacttaacattcattttggtagacagacaaagtgagtaaggtaaatagtatacaaaggtgataggtgcagtggcgaaagataaagcaggagccccgtgggggagtggaattctggtttcaaatacggtcatcagggaagggctcatggaggagcagagacctgaaatgagagatcttggaattccaggcagaaggaagagcaagtgtgaaatctctgaggcaagagcatgccaagagttttgagggtgaacacagaggcctgtgaggctgcagcagagtgaaccagtgggggctgcaggtcaagtaggaccttgcaggccaggataagaacattgactttctctctgagagatgaaatgttgtgggaggattttgagcaaagtcacgtattattggacttaggtttcagcaggatcatctcaactgctgtgttgaatagagaatgggggcaagggtggatgcaaggggagatggaggcttggcctagggtggtagtggtagaagtggtgaagtgtcctctttgtgcttttccaaaatgtctgatttttaggggggccaaaaacatattactattaccttaaagttatttttttcatagtactctgtcaatattagacatctgaattttccctgtacattgcatttagtagcagtaccatatatatatatgcagtgtggacatatgagtgttgaaaggaaagctaattaagtcactaataccagtttttaagttttttttttccttaaatcacctcaggagaaagttaggatcattgaaaggagaatcctaccttactatttatatgagaatcttgctcttgaacactgcatacatgctttcttttccaggtttttccacatttaatagtaggtcctcttctaacattatgtcttattggctccagtttcacctgaaaggaggcatgagttcttcagaccaacccacctcatcacaccccatcaatgcatagccacataaagcgtgggaattcagtgacttttttgccatctgagttctagcttcttcctgtgtataaagtatttattaggactatggttttggtttcagtattttgaagatgataatcctatatataaattatgcaaagaagattctcccttttgaaaataatggaactccaggaaagccaaatatgttcaacataattatgagaaagaagtgtgccactgtcagattggcatttatggaaaaattgttacgattcgtttttccagattcattcccatccaaaattcacgaggacacagccaataaaagggagctgaatttgaagaagagctcgtcactaagattcattctgtatttattgagctgattctgtttgatggatattaggacagaatatttgaacagcatgttgtcttggaaaatcaggtacgaggtatggctgaggctttggtggatataaaggaggaaaggatttattccttccccacatgactcttaaaatcttgatgtattaatacaattaatacagggcagaacaaatgtgtagtcagtacaaacattctgtcaacacacattaatatgtggctcttgtttataagcttattctgacatgatctttttaaaaagtatcttattagtgtagaatttgatccgtcttttcacagtgctggttacctgaggaatggaagcaagggaaggggtttcttgccgtaactcttctttcactggtggttggctatctgctaatggcgctaagactgttagtgctcctggcactcacacggccttagtgtgtattcaactgtgccaaaagataaaggaggtggggcatacagggaatcccccaaacattaagcttctgtcactttagccactacagctggtgcagatttctaagtacataaatctcctggtaagtggctttgctggccccaattcctaataggcatttacctatatgatgtctatttatatatctgggtcatcatgaaaccagaggtatgagctatattcatatagtcttaacctctggtttgcttgcttcttcctttcacatgctcttggactctcaaagttgaaataagaccttcactattagtatagatcaaaaacctaagtcctgttttaaacatttgctaggagaactcaacaatgcttataaagaaaaaataatgccaagaggctcagaataagctacccttaacattcttctctgatgtaatagaacatttctcaatgtacggatatgtgtgcagttaaattctttcttttctttttgcttctgggcctttttggggaatttagtttttaagggagaagaaacctaagtctgtaagcttttagggtaatataaaagaaatgagaaaccaattcaatagggctgaccatttttttctcttttcccagtgtgatatacagagtacctaataacatgttcaggaattttctgtgactctatttgttgaataatgcaattaagtataaggtagagctgtgtgggcctcatttgaaggagtttagttattcaagtagtaaaaggctctcttaacaaggtggcatttattattattttagcagctgtatagccctgattttctgtgacaggccaatttcaaagatctttaccgtgttcagattctgtttttaattctgaaaatactgtcaccatatgggtccatttttaccacttcatgggcccacaggacattagagagtattcagtctctagccagccacctccttgagccaccctccagctaaactccccaggatgagtacagagcccagcaggtgcagccccttggtgaatgctgttgaccagtctttggcatctgagctaacagttgaatttgatatttgcccctctgaggaccactgggcaattcaaagaaacaagtaactctagcactggaagggccctggggctagtcctgccactttgtagatgatgaactaagacacagatatgcaacatgactggtgtaagctagtggttgcaacttagagaaggaagtattgtttgctggacttacagcatgcctggagccatttcctatgaaatgattagttgtttcactacacatatgaagagactgtaatagacccacagtcaaagctagaatttctgacttttcatagtgctattcaaagccattttcatattttcaaaagcatctgtgatttgttataccttgttagacaatctgcattttagactctggctatctgatccctgataaaatccaaatagaagctagagtttgtgacaaatcactctagcttcatgacctagctcctgaaacttgaagtctatgaattggatctaggatgtaataatattaaaatacaaaatgtaatctcagtgggctgtactgggtacaaaaataaagagtaccctgtctggtcattagtgtatgcaggatcaatgaattgtgctggtgttttgtttcccataagtctttttttaaaaaaataagatcttgctctgtcacccaggctggagtgtggtggtacaatcttagctcactgcagcctcgacctcctgggctcaggtgatcctcccacctcagcctcccaagtagctgggactacaggcatgtgctgacacacctggctaatttttttttttttttagagatggggtctcactatgttgcccaggctggtcttgaactcctggcctcaagtgatcctcccgccttggcctcccaaagtgctgggattataggcacaagccactgtgcttggccttgtttccaataaatctttaaaggagaaaatgtctctttcttccatgtcctacttctcatattggcagccacctttatagacttgtccactctgttttgcgtctctttgctgtcccctgtcttccagcattgtcctctcatgttctagtgacagtcttcctcaagccttagtccttgaacttcccaccatcttctgcttctgtttcccaagattcgttgttcccgcttagctgtcacttctggcctcagccctcacctgcagctctgacttactcctaaattcaagccccacattcacaactgccttctgaacatgttgcctctgtgacctttggtcaccccaaacccaatagaaaacagagcctggaccagacggtctctggatttcttattggttctcagattcaattttaacaagtcagcacttaagattatctcactcctctcccgcttcttaacttccctgtctccttttaatgataccaccaacctgtcagccatataacatgtattatcttccatacacacacacacacacacacacacacacacacacacacccacagacgtacacatgtatacatgtacacgagacaaaaatggagtaaaaaggttgaattggtcaaaatacttgcctagagagagttcaaagcacatgtcttgataacagtgggatcttcttataaaaagtaaagcttttgttatgctagtgagcttataaatttttgcgtgtctgtgtaaaactacaaacgcatgtcctgctgggcattcttcctaccctttcttacccaggagcctctcgccacctgggaaagctgacagaacagtgggcttcaggtccagaaatgagccaactttcctacccctgctgctggtggtttatcagatacagggagaatcttagaaactctcttttgtttgcttaaaggcacagctataaatatatttcagcgtgactgagtgtgtcaagtttgagattctgatttgttgtatcagaatgttagagctgggagggaagcactggcaatcaggtttctctacttcctgattttattgaagagtgagctgaggcccagaaatatcaggtgatctgcccaaagtcacacagctcattaatgacaaaactacaactgaagccctggtcttctaaaccccagccaagagctctaacatttttaattctaattttttttttttttttgagatggaggtcttgctatgctgccaagtctggcctcgaactcctgggctcaagtgatcctcctgtctcagtctcctgagcagctgggattacaggcgtgagccaccacattcagctaacattctttttttctttttctttttctttttttttttttttttttgagacagagtaaagctctgtcacccaggctggagtacagtggcatgatcttggctcactgcaacctctgccctgtgggttcaagtgattctcccgcctcagcctcccaagtagctgggattacaggcacgcaccaccacagccggctaatttttgtatttttagtagagatggggtttcaccatgttggccaggctggtctcgaactcctggcctcaagtgatccgcccacctctgcctctgccttccaaagtgctaggattacaggcatgagtcaccacgtctggccccagctaatgttcttttaaatatattgagtccctttctgccactcatctggaatgggttctcaagcccagtgaggaatcccaataaattctggttcttagtctattttaaaaacactaagtatacatacaatttgtaataaaattttaagttataaatataatggatgcacactgttacttcttaaaataagaccataacattatacaagctgctggtttctttgcttttctggtcactttctccacctctacctaatcaggtcccaacattgtgcaaagacttctcctcctctttgtccccttggcacacacactcacataagaatcagctaagagaatagtttgtcaggtacttttcctcttaaaacctaacatctgaggaacgtggattttaattattgatgatgtgtgtggagtttcagtgtcacgcattttcttctgagttacagaatcctctgggggatatttcacaatacctttgtgtgtagttgctatgaaggaattaacctgtaaacctctgggatgattgaattgtgggtcaactaaaatgcaatctagctaagacttctgcctacgatctcgcctgtgtgtttctttttgttggtttttagatacagtgctttctattccatatggctatttagtaagcagtctctttttgatagcttgtacctctgtgattcaatttctgttgtcttttttttctttaattgaatgatatagtaaatatgaacttgtgccatcattagaataatgtgcatatattcacatagaaggtggggcttatgaaccttgtattaaggatttagtgagaggaaataaggactttgccctctcagacctggcacagcagctgcagcagtttcatcataaggtctgtggtctgcacgcacaaaacagcgtgggctcaagtaaaatgcctctggacaggtgagaaggatggaagcctctatttctggcacctctctgaagatcaggatgctacaagatccacagagagacttatcagtattagccaggttgacctggcaagagcaaggggaattgtttatgttggctactcgttcccctaatggccattttaggatgaaaataaaccttagtaagtctgtttcagagcattttggataccccttggcatattgccaaacctatctgtaagttttctttgagtataattttaaagtaatatgtatcatcacacagaagccttttcagttctgatctaacttttctgatgccatgattatagctttactctgtctcatcaccaagcctaaattaatagtagctagtggtactttgctacccataaaatttgagctgtgttgtaagcacacagaaaatgagatgccaggaataagcaagaaagggagagcctcagcctggttacttctgatggaaggctgggcctgccatcctggcttgtggttgatttgggagcatataaggtggtgctggtccttcaccaggccagtcatgtagtttatccacggtctcctatctctctcctccccgaaccacagcgttggctgcttgctggtcaattcttctgagaaagaagcaaaacctccatgagaaaggtaacatatgctgatgattgatttagggatttgaggtctctgaggagctcagacacacaattgctttggtgaactccgaacttactcattgcacctcacagcaggagagagatgttttaaaaaaaaaagtcccttgcttttcagttcgaaagtcatgtttgagacatgactttcctgtgggtgcttgcaaaagtacatgtgtggagtgaatgtgtgttgatgagagccaagaaaaaatttatacatatgatagtggcttttgtcttgggcttatctttgtatggtttttatccttagtgagaaacatttttatagcaagaagaatgtgataaaatgccagttagagtgttttatggatctttagccctttgcttgtaggtgagttttttccttcaactacctggcaatttctttgaacacccgccgcacgtccaccaccaaccactactaccaccacatatggtcttagtcacctaagggtatgccgcagcctaaccattttctcccttgtctgtttaatcttttcttctttgtctttagccttgttatttccccagattactggccctttctggtccagagtggcattcttatcatttctgatagttcttcacagaggttcagagggtatagcaaatagatggctaacatgaaacttcttctcctttcttaactctacaattggttgcttattcatttgttaaatggacaggtacagaacattgactgtgtgcaaggtacacagctcccaccctcaagaggttgtgctcctggatatgcacaggaggatgggtagggtacagaaggaccatggtatactgcagagtgactttgaggaggctgagaggagtgagtacagtgtgtaccataagaatttaggatatagagtgataggatggataggtaagaagataggatggatagaattctaggtaagaggatcatcatgaacaaaggttgggaactgcccagagaatagctgttttcctggaaccatatagagtggagttcaagcttctgaacagagctggttcatcaggagtgtttgagtatgacaatagcaatattggagaaggccttcctcttctggttattcttagattcctagcacatgagtgctggaaggggcgtgtctaacccagtttccacgttattgagaggaacatgagtccctctaaggcttaaccttgacttggtcaaggttagaatgttggatgttttctctcccatgcaatatggtgttcatagtattgtgtttgtttgcacccactggcaaacttataaagaccaccaaggtctttataaggagtctttctctgagaagtcattatacaaaaaagaaacacgtttatagcagcacgattcgcaattgcaaaaatatagaaccagtccaaatgcccatcaatcaatgagtggataaagaaaatgtggtgtatacacacacacacacacacacacacacagacacacacacacacacaccatggaatgctactaagccataaaaaggaatgaagtaatggcatttgcagcaacctggatggaattggagaccattattctaagtgaagtaactcagaaatggaaaaccaaacatcgtatgttctcactcataagtgggagctaatctgtgagaatgcaaaaagcataggaatgatacaatgcactttggggactggggagaaaggatgggagcaggatgagtgataaaagactacacattgggtacagtgtacactgctcaggtgatgagtgcaccaaaatctcagaaatcaccgctaaagaatttattcatctaaccaaacaccacttgttccccaaaaacctattgaaattaaaaagtctttttctgaaaatggagtatttgtgtaatttacattttatgaccattttaacaaactggtataggttttgcacttacatgaggagagggttcatatacaaagcaatgattgcattaggataaattatgttatgaaagaaaaggcattaaaatgatcttggtactgtttgccttaaaatcaggatttgtgttaactttgacatactgcatgtaagatttgtttctggtagtaactgaacttcatgaaatcactggtcacagaaatgtaagttatcagactctcatacttgattagcagtatacattttcattaaagcaatcacattccaataaggaccagcaatagcagttcacggaatgcagctgctcagtttgtatttgaagtgttcgtgtatctttgggagcaataccatgaagtcacaagtttccgaatgaggcatatattcagcctaaacaccgactagcttaactgaatttttgcttttgttcaatacatttacattgtgatgtttacagcttaggctgataatgctacagtggaaagtatgggggaaatttctctttggtcccattttaaatcacctcgcagtatttaccagatgtagaagttgtgtacgtatgtggtatctgataagctctgttttataaaatacaggttctaagacccagagaaatgaaaaaaatatattttttttctcaatggaatagtaagcatttactctgtgcctggcactgtgctaggcattagtaaaagatggcacaggcactgtccttttctacatagtgtccattgcatttttacccctaatgacttgacagttgattcttaaaatttgattttagcaggtaaaaggcattttatgtttccgtgttggggagtatggcagaagaggctgctcaaggaaagtacttttttaaacaaccaccgggtgtcagcagaggacttagaactcttggcaacatctgtgttcttggttttcttggatttaatttgctaggccatctccattggaatttttgaaaggcagtcaacctccacggggccactttctcccaaatattagtgtcaaacactttcaccgcaacactgcatcacgattgtttatctttgcctaataaaactagcactagttcctcaatctttttctgatttaaaacctttaattctgtctttcatggtgaaggttctacaaagtagacaggctgccagggtggggaagtgtcaccaaactctagttgtttttactgacctctccccccatacaggtaaagctcacacttaccttatgcagtgaaaagtacagggaccattcttcgtcctgcacacacacacaaaaatctgataatggagcttgatggttccaaattacagaaagtattttcagagtataaaggagagaggtctaagcatcttcactggcccagccatttggttcatggtatagcatatatttggtggtggtcacagatattaggaactgtgtattgattgacaagggaaaccttggcaaggtgggtatggatttgtatcatgccaattctctccagttttctcaccttgactcctcacttgagtgagcaaactagacagggatccaaggcatttggtatgagacattaggctctagggtggggccaaactggagatggtctttcttggacacccaggtttctttcaagcttcatgcggtatcagaagtggtagcagttacaaggctgtcagtttgagttgctaagctattggtgacctgaaagaccagcttgggagatggttagagacataaagcaaccccagtggctttagcagctaaagctgccagggcgtgtggcctgcagggggtggggtgttaggcatagtatgcaccctggaatctatcccataaagtaaaggcctgattgatgcagggttctagtttagacatgctatagggatttcctttggactgatcagtgggatttggcaaatcgcattacagctaattccaggaactatgcagattcttctgttgttttatattgaataaaatattaagacagcacatcaatagggattcaaaaatatttggaatattttgtttttgtggaaatttctgcaataatagtcaaagggaatcactgtgttcctgaaaacattgtgcaggatgtccataaaatatactgtgtacacacatgccatcaaagagggcagctgtcattcttcatggggttatacccagcttggtgtcaggcagcagctgggggaaggctctcagacctgtcgtatgatgtgctttgtaaactgctttttaaaaaagaagttctttattgttggcttgacttctaattaacacaataattgcatatgggattgtgtaaggggcacgtttattggggaaaataaatgaagtgtctttatgatgattttagttaacactctctgacatttctcgttgctcagggaatcctacagcaagtaccgtcttattcacggaaacttgagtcttcaaatttggccacattgctctgtgctgattctcacctctcttggcaatagcttcacactctcctctccctctttcagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactggtgagtatgtcacaacataatactgctttctcaactatatttttgtaaaaatataaattacatggaggtgaagtggttcgtcttgaggtcacagacaagaccttaacaatttcagtccagactctttcctaatccatcctttaatcccctagaggtaaaaacaaccccaaacacagcctggcacactaaatctagtcccagtccctctgggtagatgatgacaaagcagtggccagtgattgcagtagtccatttgtatcctcatgacaagatgccctgtttcttttcttttttttttttttcttttgagatggagtctcgctctgttgcccaggctggagttcaatggcgcaatctctgctcactgcaagctccaccccctgggttcatgccattctcctgcctcagcctcccaagtagctgggactacaggcgcccgccaccacgcccagctaattttttttgtatttttagtagagacggggtttcaccatgttggccaggatggtcttgatctcctgacctcgtgatccacctgcctcggcctcccaaagtgctgggattacaggcttgagccatcgtgcccggcctcgccctgtttcaattttgaactatatcttagaagtctccttaagcatgtgatatgcagctttggtggcaaggcagcatcctgaacataagcagactttcacctccaagttcctattggagaaatactttccacctccttgagcctggccatgcatggatgcatgtgtgtggtcttctctgaacctgtactccctgtctcagtgctatgagagttgagctaagccagagcctgccacccagaggacttatgcagtgtcaagcgttggctaccaggaccagtgcagggtgcatactctcatgggacagataaagcagtgatgcttcccagatgataagggcagactattgaaaggctattactgtgatttttaacttttaggtacagcagttaactaattctctattcactgttcatgttcttcactgatggggattaatggtaaaggattttatagataaaaattagcaaggacctgtcctcaaaataaaattttgtttaaaaatatttatttcaggcatcttactccgtgaagggagaagcaaagattccatcagggccatgttgcctgtccctgtgtagccctaggttgtagtaacatttaataccatctagtgatatatgtgggtgtgagagtggttcattccaaaggaaccatcttcccaactggcactgggcagtcagtctctgttgtcagcctcatagaagtggtgcttgactttgccattttctatcctgcagaccatacaggaggctgatgcctcagccgccactgattcttcaggttgatgggcaagccataatgaggcccatcctgattatgggccaggcttctgctgctgtcacctggcactctattctaacaccctgagtctaccttctagtacttctcataaacactagggtttcttttggtctagtgccatagtcctcaactccagatacatgattaaatcacctgggaagccatttgcaaaaacctttgccagcatcccaccactagctggttgaagtagactcctcagtggtggtgaggccctggcatcttattttctaaaaagctctccagaggattcaatcttgtagccagtattgagaaccttttgtttagcacaatgagtagcaaggggagaattaacttcaaaagcagagaaaagaaaaaattctaaaaaaccatccattcaaacaagaagggaagtgatgtggtgttgagacctgactgattccaactaactgtttaaagtctttagcggcaaggatgtaacctccttggacctttgtctccaattgtaacaaaatagaattggactaaatcaccaaagtttctcccggcccaaatactatgactggagaggggtgggagaggtgatatttttatgttctaattctcaatttgcttgtggggcagaagtatcccatagctgagtataatgtcataaaataggatatgtgtataaacaatggaatagttagttctggcctcttctggaggtggcttcacaccacactaccattttcttctcctaacacaagttcactggcaggtgagcattttgggaagtagagaagttttttggtttggggcttaatttgggtctttaaaaatgtcttttagatcaaattttagattctacatatgtgtaagatcaggcagttattagtcttttctttccctgacttatttcacttaatcctctagattcattcatgttgtcgcaagtgacaggatttcattcttgtttatggccaaatagtattccattgtgtatagacacattgtgtccagtgtgtatggacacttaggttggctattgtcaatagtgctgcaatatacatgggggcgtggctatctcctcaacatattgatttcattttctttgggtatataccccgcagtaggattgctggatcatatggtagttctacttttaattttttgaggaacctctactctgttatccatagtggttgtactaatttacattccaatcagcagtgtataagagttctcccttttccacatcctcatcagcatttatttttttttttgtctagagacaggggaggagggagaagcagaggttggccaatgggtacaaagtcacagctagataggaggaattatctggtgttttattgcatagtagggtaactatagttaatgtattacatatttagcaatagctagaagagaggatttagaatgttcccaccacaaagaaatattttaggtaatggatatgctaactactctgatttgatcattacacagagtatgcatgtatcaaaacatcatactgtaccccataaatatgtacaattattatatgttagttaaaaacaataaaatttttaaaatatgatttggtccttttatgtgatagaggctatactgggtgcgtatgatattttatttttctcctcactaccaccatgcagtgtaggttatattttcatataatgtgataggaacttgggggtttagataacccacccaaattcacacagctaatgtatggaaggctgggatttgaacccttgtatgtttccttccaaagctaggactatttcaactccaatgtttacatttgggaaaaaagctctaacccctactgacctgtatttagtacaagctcgtcccaataggcttttggcaaatgctttctgtaggtaaaacggccactctctgaaagctcctagaggcaggaaacttgccagacacagaaaactgctgattcggctgatgagagcggaagtcacttgattaactgtcagtctagaattttgcagtccttatataacctcattaattgcaaaacaactgaaaataactatgtctactttatggaagcccagagaggctgcctcctttctaagaggtagttcataacaagataggattcaaacctaggaggacttctgactacagagataaatgccctttcttccacctgcctgctaacagttattttcccacccaactttctggaagagtctaggcttatcccatcagcaaaatgggagagtctcacatcaaactctgctttgaattgcattttgtatgaagttgggaaagaagtcatgtacatggggcattctcataactacatgtttagtatttgagtggctgtgctttctagagaattttgttaatatttagaaagaaattaatattttaagccaacatttcctttttcgatatatgtgccactagatgagaaaaaaaaattatgactcagcatacatatgtatactttatgagacatgtgtatactttacaggtaagtaatgtggccacatgcaatctatccaaattccacagcattgtttagggccattgcaaatgttcaaaaccattatatttcattttgaaataagaagcagattgtaagacatgtgccttgtaggtaaggaatcaattcttgtttttatctgcctttcaaagttatccttaatgtttcgtaaataccatgtagtacccttgaatttaggcgtgcttgcatgtgcatgcacatgcaaaaaacttgagaagtatcagcagcatgagatgaaaagcactaaaggcgttagatgcttgcaaatgtcattagtagtatagtgcatttactttttgaaaggctttaaactccacgcagcatcccgaacaagaaaggcaggcaactccacaggaaagctgcagtggctactgtgtccagtgatgaccaccaatctgaagaggaacatcatcttgcacacgtttggcttcttgggcccagatgggagggatacaattccaaatgaagcagttttgtaactgtttcatctgagatgtggttgagactactggaggcgtttgcctaggcagcaggttctcatcctggccgtgttcacaaacatgatgggctagcgttagagaaaagacattgggctggttcttatttcttctgaaagcagcaccaatgccagtgagtggaagttagaagtaggcagacttgtggccaaagggaaaggaagtctttccaacaattggaacagtttcaaaatggaatgggccgcagggaattggcttgcagaccgtcgtgaggaagttggtaaaaaaggacccccagacagggcagaatgtgtcctgtgaccttcagagcagtttggtttttttctagctcaaagattctagtgtaacaaatagtggataccttagttgtgaaagttccttccagatttctccaggtgagccaagctgataggcacaatgccagtctctcagtgaattctccccagcctgtgtactccaaaatgcatatgcatattaaacacacattcctagattgaggcttatgtgggtaaatttagagacgaatgttttatatttttttctaaactttgtctagggagtgtgaggacttgtctaattcccgctgattgaaagtaacctaccctgaagaagccctcttcttaatcctgatgtatctgactttgtctttgtgtgcttaattttcagtatgccatgtttctgtccctggtgttcctggctgagctcgtagctggcatttcagggtttgtgtttcgtcatgaggtgagtatacacaaaatgcagaactcagttaaggggtgtttgggaggaggattcttgaaacctcttgaaatgtgtaaagggtgcatataggctagctgttttcctcagtggtgttgttgttttccaaagatcatgtcatatgacctgaaattttcatgaaattctaaatgtgggaattccaccaagcttgaaaccttcattgttgatcttcactgtttctctgtgtagccattgcataaaatgattctctcccgttataaagcagtgaccttcaatatggatttcatactccttaaaaatagctgcttcaggctgggcatggtggctcatatctgcaataccagagctttgcaaggcctggggcaggaggatctcttgaggccagaagttcaagagcagcctgggcaacatagtgagaaccccatctctaaaaaataaaaaaaataaattagctgggtgtggtggcttgcttctatagtcccagctacttaggaggctgaggagggaggatcacttgagcttgggaggtcgaggctgcagtgagctaatatcacactgctgtactccagcctgggcaagagagtgagatcctgtctctattttttgtttttaaaaatagctgcttcagtaaggcacaagtgtatatctgtataacaagatttctaagactataaaggcaagccaaactaattgtcttgctgcctcaaaattttatcattgactctccataaataatagtaaagccagaagtagatacacatgtgttaaaaagaaaaagaaaaaaaatatatacaggtggaaaacagagagtgttactgtgggtctcgaaaggctggcatcatctgttcccaggccctgtttttttttttaatttttttaaaaaatttttcattaacccatcttgctgcacacttaaagatcccactattgtgcttggccaagttcagttccccctgagcttgactgtatgctctctgctcccctactgccttgtttttcccctttaccaaagacagtatcccagatgccaaagctgattcccagaacccagtttgtatgggtgctgcatttggaattagaaccccattcatagtctctagtgaagtgagacctgatgaagtttcagcctcaacagccctaataagtgcccctcgtgcatgtatgaacaccaggagcagcctggcttgttcctacctgagcctcttgtttgttgctgggagtgcgctctgtggagaggtttttctcttaatggtgcttgctgcctagggcctggaaatcctcatgtacctaatctcttttggctgaaaccctgagggctgttgtgggaggaaggtacaatgccactctgaccaccagcgctggtcttgagtttggctagtcaaactcacatgatgacaataggtctcatttagtgccatttaacaaaagcagaaagatataacaaaggaagcacagtttgcctgctaggcagtagtgggcttgtttctccaccatgagtcctcaaaatagtctagtgcctattctgtgtacagtcccccatcctaagagacagcttaagtgtagcgaaatgagatgacacagctgggtgtggtagccaccttagcttagaagctgcatgtaactggtatctctatctcttgtaactgtcccatggacatagtttacagcattttagcaaagaatatgcctagttaggagagtcaccatacttagccctaagcttcccaccaagtagttattgtcatttgctgtcctcccaatctggaggcattttaccaattgggggtcagttttatcaataaactcagtggcctggtaacacattcgacattccaccttcatcaggtttccagggaaacagagcttgaaagttaccccaaagtcaaatgtggtaacagaaaaggttttgttaactttttttttttttttttttttgagacagagccttgctctgttgccaaggctggagtgctgtggcacaatctctgcttactgcaacctctgcctcctgggttcaagcgattctcttgactcagccacccaagtagctgggattactggcgcctgccaccatgcctgactaattttttttttgtatttttagtagagactgggttttgccatcttggccaggctggtcttgaactcctgacctcaagttatctgcccatgtcggcctcccaaagcactgggattacaggcatgagccactgcacctagccaacctttttaagttcttgtcctttattatcttttttttttaatttgcctcaataaagacaggtaagtgaaagttggttttgcctcactcctatggtaaaacagggatcagtttttgaccaaaacatcagtcatcctgtccacccaagtggtttgtcttttatgagcctcctgtgtaagggcagagaaagttatagaaagatgggtattaatcaattcaaagaaaataagtagaaagctcatgcctgaggtttggcagctcaccatcacaggcctttcagaaatggacaggcccctccagtaggtcattcagcaggtcaggctttctctggattgaggctgaggggaacaattttttaaattccggagcttaaaaaccccctggtgaattttctgagcttttccatctcagaaaatggggcattgcctccctggcctacatttatacagagactttcagaagaggctatgttagggtagaatttggtaagaattggagtcagtttgggctgtggtggactgcaatcacatccctccttgtcttccatagatcaaggacaccttcctgaggacttacacggacgctatgcagacttacaatggcaatgatgagaggagccgggcagtggaccatgtgcagcgcagcgtaagttccagaggagatgagggtgtgaactaactatgaagtctaggcttagacttatggactgcctgtaggttggcccagtagttgctatttgttcccgttcttcaactcttagtccagttccattgccaagagttgacacccagtccttgtccaggctccagttattcaggtaattaatgtcaaggaggaccactcccttgagtgtgccttgtatcagtaagggttgcaagtatggcaaggacagctcatttgctcttcagatctgaacccttgtgaaggagttaggcagtgagtgtgtgacaaccttgcttagagttggctcccggaggctggctttctggaatcgatgtcttcaggctgggtggagagctcaggcgagctgcattcactggctggggcagtggagtgggcatagagtggacctagaagaaactgaggctctgttaggtatgtgaaggtggtgagctgcctgatgctttgcggaggatatgggggaaatagaagagagatttcctgtctgggtggcaagtgctggcactcaagcataactgcccatcaggaatcactaagggggattttgctttggtttttcttggttttgtttacttcagaagaagtcttttttctaatttattttgataaaagttccaacatatacagaaaagtctcaggaatactacaaggaactgtatactcagatttaccaattaattatatttttgccccgtttgctttaatattctctacattggggttggcaaacttcttctgtaaaggatcaaatagtaaatattttaggctttgagggccataaactctgtcacaactactcatctctgccactgtagcacaaaagcagccacagacagtatgtgaacacatagttgtggctgtgtcccagtaaaactttatttacaaaaacaggtagctcctgggctatagattaccagctttggctctccctttctgtatgtgcatctttttttcttaagaactatttatttacttattagtagatatcccaggggagagttttttgaaaccatatttgcctcaactcaccaatcaatagtcctgatttagtggatgaatacatctatatcaataggtgattgtgagttggacacagacgcactgctttgctttgtggaggtaataagaaagccaatgtgatatataatttagaacttccttcttggagatcaaacaagcatcaatatgggtataattgttattggagcttccattcatcttgactcaccaaagctgcacatgttgtcttagggcttttgcctgtgtttctcttataaaagtcacaaggcagtgattgaggagaccacatttgatctgccatttttttattcttttcctttccctgttaatagctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaaggtacccgctttctcctggcccagatgggaccagtggtgaatgtttgggggggcttttttgtttccatgaaattatgacaaatagatttgaaatagtagtcaagggaaagagaatcttactttgtggttccttgattgcctgggagaggcacttgaggctgctcacttctaaaagagaaagctgtgactcagatcagccttgtctttctctcccacagcaaggatctaccaggcatagttaggaaggtttagcaagcagttcctgttaaccctgatgcttatgtcagacagcgagtgttggctttcttcttttggggtgtccgtcttctgcttaatataccatctaaacatgaaattgtttgcagctgggtgtcagtttttgacagcaagaggggagtagagttgacagacagcatctgcttctgctaggagggtggcctttattttagggagtttactgccataggaaaagaaatcagcaactctgattcaactcactgtcaacctcccgactcccaaagaaattagagaggggaaaaaagaggactaaacgaaatttaaaagttagtacatagtgaaaatgagggaaatgaagttttagtagtcagagaagaggaaaatcaattctgcattccattttacagagaatacgatgaagacatgatataactgcatgtgaagattatctacatcttaaatgtttagagaaataccatatataacatatattttggtaaacaaaagggaggaaaaaacctactattgtgtttacttcctgttattcagtcaaggggtaaatcttttcttgctaaggtaaaattctgttcatatgatgccttcaaaattctatgtgatctggaccagctactgaataattcagagaaaaaaagatagttcagtaagattcagtactgactgcttcttgtctaagttaaaaggacatctgtttctatttgaattttcttatgaacccaaacattgaggcttccttcatctcttattagttaataaggtaacttctggcttcctcatggacatccccactgagtacccatacgtgtcattatgcttccattttatgaagtgctaagcatacctggcatgtggtagatactccaatttatggaaggcaagaagtactctatggcagtgagatatttgatataacagagcttcagaaggttgttcatgaaagcagtacccaagtcttttttttccccccactcaagcttcctcttcttttgtgaaaattgaggatccagaagtcaggagcacagggtctagtgtcaggctccagtagaaattctgactgagccacttgttggttatgtgatctcggtcaagttacttaactttgtcagtcttgcttttcttgtctgtaaaatgcggataataatagtacatgttccttgtgcttgatttgaagatttaatgagataaagtgtcaaaagcacagtgcctggcacagattatgacacagatgtgatacatgttaactgtaatacaaatgatgatggtgaaatttgtcttctgtatcacatggagtcttttattaaaaatgatgcagcagtttcttatagggaggatcttttgttagtatgtaaaaacaagtttggagacgtatcttatagtgcatctataatccttacaattatttccagaaagagagatggggtcacattttttcatttcattgataaacctacacattgacctcactttccaccttcccactataatccaactttatattttcctggccacctcaaatacttagaagatctgcttaacttctctcttacttaccttatagcctccaacctggctccctcagaggagaaaaagtgaatgaaaactaaaatttgtctagcaagtttccttagacattcttatttaatgcccacctgaacttatgagacaaattacttttcctgactcaatgtcagacacctaatctatacaaggtggaagattggaatggggtaatagtagatgctcataaatgttacccttcctcccagtgactccttcccctaggaagcttaactactgccacattctagttatatggaatcctatgatttagaacaagtggatcatccctgtagatcctgtggtgtcttggaccctgtacttactctgatagcacagaaagatgattcttggctcttaccaggaagcttgagaaacctgtcttgtacagataactgggagagaacaggaggaaaatatgaacagttaaataggatatttattgtttggatttggggacaggttttattttgattttactagcaggatgatgaaatgtctgcacgttcagttggctaatagcattggctgaaatcctacttcatagggattctttgacagttcgtaagggcaagaggaacatagttactttgcttggcagttacagagatacctcttcccataacctgtctggaactagctttctacttctagtagttaaagtcggtcacttgcagatgttttccattggtgactattgatttagacgtgctgagagagtgagcaaatgaactgttctgagtgtttcctaggatacttagcaggtctgtgtagatttatctcacacctgacaaccgactttcatattaggaaattgagagagattgttgtgagtagataagatcatagtttaggggaaaatttaaggttgaatgtaaacatggcctgtggttgcagtattaaatcagctcttgcagtatgtggatctgtgctgagacatggaaaatgaacttcggggttcatgcagtaaataacggaaaaatccagagatggaaaacatttattttgacattggtctcttattgtttaaaaacaaaaaaactaagtcacttatatcttctcattttaattaatcctattactgatatgattcattaacttgctttcttatttggagtaaaaaataatgagaaaacatttcttatagaagagtgcttctcaccttttaatgggcatatgaagtgtcgggagatctggttaaaattcattaaaaatatgtcaaaagcaataacccatggatttggcagattctgattcagtaggtctggggtggagcctccaattctgcatttctaacaagctcctaggtgaagaaatactgctcattcaagatccatacattgaggaacaaggtttagagagaactatttcggctcagttgtactaatgccaggcagctatttcctttttctggtttctcctactggttggagtggccttaccaaaaataatgtgaccaagtctaaaatcttctagaatgaagtagaaatcatactttagaaaatatattcagcttaagtgtagaattgaagtgcccagaaaaaaatctatgccaaactgttttgcagaataagaaaatagctcattctgcttctctctcagttgtattatcaggcttgtgtttccaaattttgagcttacataacactggtgctgatctggacctcattctttagccccatcatcactgcagggagaagatatagtaatgatggccagcctggtaaactgctgtcttagctgctaccttttgggaaagtgttagaatatccacatctcttctcattttgtcttctttctaacacaaattcttctctcttctactaccttttgaaaaatagtgtgaggctgggcacggtggctcatgcctgtaatcccagcactttgggaagccgaagtgggtggatcacctgaggtcaggagtttgagactaacctggccaacatggtgaaaccccatctgtactaaaaatacaaaaattagccaggcatggtggcacacacctgtaatcccagctacagcctgagtgacagagtaagactctgtctcaaaaaaaaaagagaaaagaaaagaaaaaatgaaaaaaaaatgtgtgatatatagtctcactagtaaaagtgaaatcagtaagcttctactatggggaatcaaatttcaaaactccccatgagtgataatgtatttcctttcccactcctaccctggccttcaaatttgcatcagataactaaggagtatagtttgtcaattgcattgaaaacatgtgtcacacaaagggaccaacacacactggggcctataggagggtagagggtgggaggaggaagaagatcaggaaaaacaactatgggtactagccttaatacttgggtgacaaagttatctgtacaacaaaccccgacgacacaagtttacctatataacaaacttgcacatgtacccctgaacttaaaaaacgaaagaaaacatgtctcaaagcactactggtaagttaatgcaccatttttttttcctgcacacagactacaaatgtatatagataccacttaatagaagacacagcattgccagaatattttacaagctataagaaatgttaaattgttaaatttgaacttaaaaagggaaaacatggctggtttttttttttcttcaaatgttattaaaacttagtgtgccattcttggtaaacaagaaccagctttaatctgtttattaaattaatgtctttatttttcgcagactttatacattttagttgaagcccttttccagaaaactggaaaaagaccatgtcttcctagctgaataagtcagttcaggactctaggttgatttggccagtttcaaataaatatacttacaaattctctctctctctctctctctctctctctctctctctctctctctggaaaagatgaccctagaacataggttttccctatttaaaaaatcctaatggtctcattaggaagaaccctaaaactccataaagttggcagatattcaaacacttccctctagccagatgatttcggtttgtttattcaagatttcatcattcattgtcaaaatgctagtaactatgtttatgatcctgagatttcctgttcaaggatgcggaatgtcttttcaagtctacttctttgtctctatagtgtttgcttcatagatcttacagatttcttgctaaacttaatcctactacagaaacatttgtcaatgaaattgtgtctgggattggctttaaataggatgggatttggggaggttccaatgaagcaagattgaccaaatgttaatttgtgatgttaggggaagggtcatgtgtctctgtatttttgtgtatgtttgaaaccttttcttattgttttaagtttgaaaagaatgctaataaatccctagagtgagttgcaattgtatttgctgaattaaggttgaagtgtatgttgggagtgtttcgagtacacatagcccagcttggcctgagtgaaaacatgtctccaagacagtgtctttctctttccagggttgttatgatctggtaactagtttcatggagactaacatgggaatcatcgctggagtggcgtttggaatcgcattctcccaggtagcctacataattgtgcagaacctggtctaacctttcctctgcctccctccctggcctccagattctctgcctgccttcctgtgctttgggaaaagctgatagatggggtcaaagctccttgctcattagtcctcaggtgatctgtttattgatttttctttttcaactcaaatgaagttttgtcatcaagggaatatcagttacagttaaactaatgactagctccagaaaaacaactggctacttctgtaggtcaaatggaggttaactgaagaacgtgctggcataattggatcataaacaactcaaaacatcaaatggctgatctggatttgggggaagcttttttcctgattgacctaacccttttttgctctctcttagttcctatgtattacagatgagatctctccctttaaagaaagcctaaatttagcaaacttcaacttgtgatcattattttaatttctaagtttggctattcgtaacaggtttgactattcttatgtggtttcttaagaggaaatcaaattttgtgtattaaattttatatccctttatctgtacctaccctcaaaaaaaacaatgggagaagtactatgccaattaagtaaaccacacacactggaggatagaataagattaagctaaatctaaaatgtagcccacgtccaccaggcagggcatggtcccacaggcttctgatctctcagacaaatgatacatccttgctataatgttgctttgggtagaagaatcaacatgtatagttaacaagcaagagcaaactttgtttatgtttaactcagactttgttcagaccaacagatcatgtttcaaacaaagctcgattaatgttgtctgagtaatgtctccacagctctcattttttattatttttttatttctttttatttaggacctggtgtctacaacaaaccacaactctaatttctacataggctatctcagactctaattactttttccctagccatctgtatctctggccctcctgcttagcaatgcagatgcactttaattttattccagtttgttcctaaaactttctaattgaaatgtggaatatacagaaaggtgcataaattatgtttacagcttaataagttaccacaaaatgaacatagctgtgtaaccctcgctaagattaaggaatagaactttagcctgatggtttgttttttactagacagccttagagaagtagaagagcttttcttcttaagcagttacaaaacctgtgagacattttatctcacaagagaacgtgggctcagccaacacaaatatgtttcttgttgcaatttcaaaactatcttttaccatgctttgttattttttgtttttgttttgcagctcatgaagtgaattaaaccctcaaccctccaacacatagacaaaccagagtggggtcacaaacaatgcaaattaactcagtctccagagacatttgaaaagtcattgctactctgaaatttcttctagttgctataatatttcaataataatactcagcaacatcactctaatgactgagggacattttagaggatccccaaaccctggtgactgatgcaaatgtgcaagatgcacttgacagccttgaacatcctgtttacttaacatatgtatgtgtagcatcatattgttaacatcaaaagggcgtcttgtgtttggcatttgaggagacctgtcccattggaggaaaaaaaaatattgctgaagtctcccctaatagctatcgtagaaccataaagggagattatgctgatactgtacattaggagaagagagcctcaaagaacctggaatctcatgaatgaaacaccttatcatccaagaatattcccatgtggccatgagcatgagtgtgtgtgtggtattaagaggatcctattttcattaatgagatgaatcaaatcaaatggatccttctccaagtaatgaacctgattaatacctctcttccactcttctctcacacatcccaatgaagaaatgtatgattagacaaataattatctggcctgattaatctctctgtgctaccttaaagaaatctgtgatttgtgaattgttgaatatgcactgtgaccctctaggccagtaagagagcggctttggccttaaggaaccccaactctgaaactctctgcagtgagtttaagtctcatcaaggtgccacatagttgttggggtgataaaacacaaagcccagtggcatcataccatggtgcccatactgctcacccatgtggccaggcaggtccagcagggcagagacttgagacctgctcccaggttcaggcaggaagagaaatggctatggctggcttctgccagccagatgcaccaggaactgcagctatttatggtgctgtcagcctcaggggtcctgaaagctgaagttggcttccagacgtccatagatccagggcatccctgggacaatggtggccacttaccagatgcctgttcacaaagaaccagccctactgattctggtcagtgacctggaaccagacctttggctacatgtgttcagaaattttagagccaatgtcatagtaaaatttagcaaatgttggctgatattgatgaaccagttgtgttggcctatgccttagccttcctataataaagaaggctctactaagttagaggccacagagaggacaaagtaggtaggaaagaacagagctcgctctctctcttcctccctcccacttttgctctcctgccctcgacctttttcttgccctttgctttgcttgctcttgtgacctccgtgctatcatcttttggaagaaactggccatgcacatctattgtctcaaagattaaaggtggtataaagtattaggaaaactaagctgggtctagccttttaatagactgggcaagaactttgtcccctgttagctaacttagctaattgaaagctcctgagtgctgtttttgaacagcagcagggttgtgtcaagcattaaacacttctctctacaaacgtccattacctttgccctctcaaggtaaacctcatttgtctggacttgatgggcagggtctgctgccctataaatttatagcagaaggttgagtgtgtttagtagggtacctcttcgctgcatctttggcaactgctctttcactcgagggcttgtggggagagtgagagatggagcatgcacgcacatcacccctgtcctatccccacccccaaaatggcctggaagacaagagccatgggatgtctgggcatggacatgtttattgttcaatttgtgacattgtgtatatgtacatatgcatgtgtgtctgtggtggggtggtggggtgtcctctgggcttctgtatttagtacttctgtgtctaaatagacccagggctttgctagacttggaacctgttaggctggattaattccccatatcacgtaatattatagtcctgagtaaagacagtagagctgttttccagaaggggagggttgagtgactcgcttgaagttgggcagctactatagatccaggattataattctgacctcttcacctggcttgctgtattaacttttaaggccagagatcacccttgttcctgccactgatagcacctgaagggaattcattttgtgcttttataacaaaaagacttcagtctgtgaaattcaaaaggaaaaggtactcataagaaaacacagaccctattactacccatccattttctaaccctcaccctcctgtctggcctcctccagggtctaaatgctgctaaggtgattcattatgtgctggtcattcttttcttttggggggcccttgagaagacctgtttaccttttctatgtagagggcaggacagagctggggctattcttagataggacaagagggtacaaccttaagctctgagaattacctgtgtagcttggggtgtattctttaacctctcataaccctcagttttcttatctggaaaactgagattgtaatattgtacaggttgtggtaaatattcagtacaggctaggtacagtggctcatgcctgtaatcccagcactttgggaggctgaggcaggcacatcacttgagcccaggagttcaagaccagcccggtcaacatggcaaaaccccatctctactaaaaatacaaaaattagctgaatgtggtggcgcacaaatgtaatcccagctactcaggaggctgaggcaggagaatcacttcaacctggaaggtggaggttgtagtgagccgagattgcaccactgcactccagcctggatattcaatatagtcatcactccgtatctgcaggttctgtatccatggattcaaccaactatggattgaaaataacaatacaacaaaaaataatgcaaataaaagcaatatagtatagcaactatttacacagcatttacattgtattaggtattatgagtaatcttgagacgacttaaaatataaaggaggatgtgcatgggttatatgcaaatattacaccattttgtatcaaggacttgagcatcctaggattttgctatccttgggaagtcctggaaccaatctccaacagatactaagggatgactgtaatctgttctacctgaatgtgttatatacctctgacacttatttgatttttgacattatcaagtgtgttctggtgtttgttggttctggaaaatggaagttctaataaaaaagacaagctataaggttcaaggtcgttacactcatattttagtttctcatttggcagaatattctaaaggttacagccatggtatcttcagccacttggcagtaagtgcatgcgactatgtattttatggcaccaaatgatgttggccagagccttggtaggagatagaacgagtccaataagatgatgatgcctccttacctgaaagcggttatagtttgcatatttcacagcacaattttaatttgaaaaaggaagataagagatgagaactggaacctgcatggataggttaagagccaggagaatggagttcaggtgttgccctgaccaacagtgggacctgaagtggcagcaggtgtttcacctataagataagggtgactaggtggactggatgagcagttccctgccctggaagacttgttaaaacaccagttactgggccccaccccccagcatatctgattcagcaggtctggggcgagatctgagaatgtgcatttctaaaaagatcccaggcgatcgtgatgctcttggtcctggggtcacacttctagtgaaacagtttattcccacctctgatccagtaaaacatgcccagttatctaaggaggagggactacattggccaagagaaagcagcctgtagactcaagtgcacaattgggctcctctctaaagaatgctgatcctccagattcatgaatggaaattttcttttctaatgaacagaacaagatgtgcttaagggtgtcttgagagtatcacagtcatctttattagattcacttgtgccacagtttagatcaaggcacaaagacaagtggaggactagaatcttctgaggaggtggaggtactacatcactggtggtcctgaggcccctaaaaaaactgggaggtgggccctgggtgtagatgagcccacttaggcctaagatatctacatggccgagagacagaatataaagccccactttcccctagcccctcctaccttttcataagccttggctttcttacctcactggtgaatgtgcctgatcaagaatagtgtctctattcttgcctcaaggaaagaactattattttgtcagctgggtatggctgagacatcatagtatgctgagaaatcttccaaatgcatgtgctatagatgtgaattaaattttagccttctagttaatatatcactaaattctgtgttccttaatttttttattactctcataacatgaacaaattttaatactccttaagtgtcaaaagttgttcttaaatggccagagtgagctacagctgcaacatgatggccagtttgagaacttccagttggctctgcagttagactcccaacagctgagatcccatggttgaaatctggttttatcttttgctctagtgccctttccccatttacatacagaaacacttggttgttaaaaaattatgtctagtgatacgcatatgtcaaaaatcacataccccataaatatataaaattattaattaaatattaaaagggtgtggttcggtgacttgagattctcattttcgtttttctccctggcaacagttaattggcatgctgctggcctgctgtctgtcccggttcatcacggccaatcagtatgagatggtgtaaggagaaggtaggtgacagtggggagtgtttaattttgaggggtcccctttgggacacttactacccttcaaatgtgcaggagtactccctggccattgagctacctgatcttggtggcacttgtccatgttcagaaatctcatttctgtggttctgggaaggaagtataattggttcttttgtggaaaatgtggaaatgcttttttcagcttgttatctttcaagtccttattactggtgaatcactcacatgttctcatttctctcttagtctttcaagaatgacggaataagagacctgttttaaaaaggaactgcagcaatctttgaaagacttccaaagaatgttagagcacagtacataatacacttgccctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcggttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaagtaatgcctctgtctagcatgccaacaagaatgcattgatattgtgaacatttgtgatatatgtattaataaatagagcaattacaagcagctgtgttctggttctgttctttggttcttatgaaagttttaaaacacatttcttttccatcttgctcttcaggacatcgcaggcaggtggaccatctcacacactgacacacctctccatgtgtgctcccaccccactaaaatagcatcagcagcagagaagctaaagggttaggtttttttaattattgttatggacacttcagaaactttaaccatttatcatgaacagaatacattgttgtctgtggaaatagagccttcatatcatttcaggcctctgaaatccttgggcctgaaatccgtgaaataaatacaaagatttcagctgagtttttaaagtctggatttcattttgttaaaaaggaaatgagcctctattctttccttcatcgcttctaatgagcatgaattctcctctttcctctttcttttctgtgttggattgaaaaaacacgatctagagaagagattacatcctacgattcagccatcccaatgtcccagtttgtactgaagtatggaatgcttacacttgatttaaagagcattttaccaataggtgcagtgtattatttgcaatccatttcttcttgatgagtcatccaaaaaacaaaaacctagtaaaagcatcaattgatctgttaccaaaatgagtggatctaaaaggctccctcttctctatagcacagactgtaattagaatagagatgactttctaactgtatgcatttattagcctgatctctgcatagagtaaaccctactacaacattgacaaaggacactgcttaaacctttagtataccctcttcaaaaggtcagcatttttagtgaattaaggagagctcttctatggaaatatatgtagctcaaaattttttcacatttctgtttgtaatttctatttcattatatatcgaaatgaggcttttctgtaaaatcctaaatagagcccaacccatggtttatctttttgcaaactatgtgcttattggtatactttggtaagtaagaaatctatatactttctaaattaaattcagatctcagaataacatacttttaatgtgaaacatttggaccaaggttgattttactttaaaactatcaagtgttcatgtttcaactctgagtgacttgtgtgtaatgtcctttcttctttcaaaggaaacttaaaagacacaaattgaaatactttcttgttttcttttattatcttcccctgccctttttttgaaatataacatttacttatggtaaaaaacacaaaatgtgaagtgtgcaacttgaacttgcacatgtgtacaaaccagtgtaaacaactgcccagattatatacagagtatttcagcaccctcgaaggttccctggtgtcccttttcagtcagtaaccgcagccctctcacatcccctcgaccctgcccaggagtaccactaatctgaattatattcccatagattagttttgtctcttcttcaacttcatataaatagaatcacacagtgtggactgtttcgtgtaccttctttcactcaacattgtgtctgcaagagttagttacatggtgcatgtaaacatagtcttgtcttcattgtggtata

SEQ ID NO: 14206 - DNA, 107941 bp, Human
  misc_feature (1)...(107941): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctcgcgccagcgcccccagctccgtggcggcttcgcccgcgagtccagaggcaggcgagcagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggtgagtggagcccgccgctccccggcgccgccccctgccccacacccggtcacctcctcctatcccgccctcaccccgcgtgctgggagtgcgggaccccgtgttctgcccacctgttgctcgccgtcttcggtatgaccgacttgcttgtggaaagcactcttttccataacctattactcagctttgtcatataggtacctatgtatattaaatattgtacatatctatcaatgttaactaactcacttcaagatttcacccctttctttttctactccgccggtccgcgcccctcactggtgcggacttaatttgaaggttcagggagtctataaacaccttgagatgctatgcagaatttttggtgtgtacgatctttttctgggagaaggagcccttcaattttattagatttgttaaataattaatgacccccataaatatcttggggaaaaaaaccgacagcactggcgctcctacaacctataaattgggattgtgctgtcttatgcaagtacttcggggcgctccaccctgtgtgggaggcgagtggtggatctagggagtgaagaaaagtagttaggaggctttggtccagggaacaaacacgccgaggaggaggtaggggactttggccctgccggcaacagccgtgcccgcctagctgcgcttcctacccccaccagtgcgggcgtgatgcaagtctgatccctccaaaaaattaaacccgaaggtgaaaggggtgtaagcacacacatgcacactatgttcatgattgatagacgggggaggtggaagggaaagaagatggcaagccacttgtgaaaattagagatcatgatgtatccttttctcccctgctgaagtcaggtgatgggatcaactcagtgacccttgttttacttcttgttgctgtgtatgtgagtttgcattataaaagcactatgttggcttatagcaaaaagaagaggaaagaaattgagcaattaagttggaatatctgtttcctgcaacgttcagttgtttctgtatgaagtaacttgggcattggcgaatgtaggctaacccattctagtttctattaggaaaacagaaaaattctaacaggccagaccagagatttcaaacagcagagtctgggaggctgtactgtgtgtgtaaaagaatcctaaaggatgacgtagtcaatattaacatacttgaaaggtaaagagaagatgttcaatgatcgtagttaatataactgagtgcatactatgtgccaagaattgggcgatgtggtttgcattcatttgagatatatatatatatatgtatttaaaaacttgtgagttaggtattttcatcctcattttacagatgaggaaactaagcagttaagtaacactgaagctctaatagatggtaagtggcagaggtggtatttaaactcccaaacctgaattttaaacttatcagttttatcattaagttttaaaatgattaatacaaagtgggatttgttagatgctaagcctctccgtggccccctcccatttttctttaaataaaattgaggaagttctgaaaggctggggaggtctagaaaacacagaactgctgcaatacatggagggaaagaccttatatttatttagacttaggggtctgactaaagactgcgggatgagtgaggccagtctttgaaaagtggagccattacacccattcattctctgtgcccataggtccagtgctaaactgaaaccaaatcagcttcccctgcgtaggagacacaggaggcatattagatattctttcttatcctctgagaatggccagctaggaagagagcaagcagatacaactcttccataaatggagggaatggagccatgaacagaagaaaagggaatgttgctgagcatctactatgtgcctattccagaatcttcattatattcttgaaacaattgctgagatagatatgagaatccatctcacatatgaagtatgtgtctgtcagcaatggttggaaatttaatcccaactccacacataatctgttctttctacaaagtaatgcatcacctgtgtgatgaattcagcaagcatcaaatgagtatgttcttcatgccgggcgctgtgcaggtgctgaattaaacacaaagactctgcttgctttaaagcaaaaagtttgaagaaggaagccaaccgctagaaaaatacattaccaaataaaaagtagtaagtgacccaaaagaatggctaatatattatggagtttagaagtgtaaattggctgggcgcagtgactcatgcctgtaattgcagcactttgggaggccgaggcgggaggatcacctgaggtcgggagtttgagaccagcctgaccaacatggtaaaatcccatctctactaaaaatacaaaattagccgggcgtggtggcacatgccggtaatcccagctactcagctactcggaaggctgaggcaggagaatcgcttgaacccgggaggtagaagttgcagtgagcggagatctcgccattgcactccagcctgagcaacaagagcgaaacgccatctcaaaaaaaaaaaaaaaaaaaaaaaagtaagttactcctggtggcaggaaattttgaaaagcttcctggaggtagatctcaaaaattcagtaggactggacatagggaggtgactggagaaagatcattctaggagggaacagaatgaatatttcacagttcacagagttgatatggtagaacaaagggcactatcttggtccttctgctataatgcttgggtcaactacttgactggctgttccaactaaggaacaaagcgtttgaaatattttgattgcaacagcagctttccagtaagctgaaatacactctgcagcctacacagaagtacaaatcagacagagagataaggcagcaaacaacacctacttactttaaagcctcagctttctaagactcaaaaaggaaatcagcttcaaaggaatttaacattagcatgccatgaaacaattaccaggggtggttcgtatgtattgtttaattaaacttctttgaaaaggtctgggggctcgtggtggttctgagtataatttttattatttccatgttactatcctgtctctcaagttgaaacagacaagcaattgttgaaacagtgctggtctggaaaaaatcctgtatcaacacaagaaattccaggaagaaaagaccctgatgttaactgctattagctccagggccctggagaattctgagttgttgacaaacctgtaaggttgagacagcggataacctgctgaaagcagagatgagataaatgtggctgatttgttgataagtatcttgcaagagtctttaaccctttgtcttctttccaatgccttagtatagctgggtggttttcattgtaaatcactcagtgacttttggtgttatttttaactgtgctgaacattttaaagttggctgtaactctttgggaaggggccttcagaggtgtatagcagcattgtgaagtaagtctgtattgtagctaatagttaaaatatttttctaaaatagaagacatttaagaattgcaagtattggcaaagggaaaaattaaaagcatccatatcctatttattacacttgccttaaaagtactacttgttacannnnnnnnnnnnnnnnnnnnnnnnncccccaccccaggtatctgagtggagagaaaattgtgttttaaattgtatttactacttataaaggacagtgaacaatctcctaatgcaattatatttacaacctctttggaaatccaccacaaaacttgaggcacactattatcttaggtgatttccttggtgaagctgcttttcaatatctgtgatcaaagtgaattctgggctgggcgcagtgactcatgcctgtagtctcaccattttaggaggccgagacgggtggattacctgaggtcaggagtttgagatcagcctggccaacatggtgaaaccctgtgtctactaaaaataaaaaacaaattagccaggtgtggtggtgcatacctgtaatcccagctaccagggagcctgaggcaggagaattgcttgaacctgggagtcagaggtttcagtgagccaagatcatgccactgcctccagcctgggcgatggagtgagactccatctcaaaaaaaaaaaaaaaagtgaattctggagagagaattgaaaattggctcagggtagcaaaagaaaggtagttactaggcgctactgttaaaaaaaagttagacattgttcaaattctgcataaattcttcctttgacaaaaaggaatcccaggaatgaagcaattctggggagcaaggtgactaatcgttcagaaagtaggagggatcaggaaagggaaaaaaaagagtgagatggcgggtggcagggtcatggccctctgctctgaatgtgaggtgtcagtagcacactggattaaatgcacctctgtgtctgtgtaatatggcctgtgagccactttttgtccagggccaagcagattgagttcggtaagtccaaaaataattaaagaaatccttctgattatagtaagtgaaatagaatgttaacaaaatggtagttaacaacaacaacaaaaaaaacttcacacccctggaaatgttgagaacacatctcttaggggtgaagttttgtgtgagggtaaagtaaggatgcttcagaatccgtggaactgtaagaaaccacaagtagacccagagtagcagggtttgattatgaaagtacattgttctatatgtgacagataagacgcaggaaattaccttaaaggaaggaagactgttcatttaggcttttaaaagactgttgttatctgtatgccctgtgctaagagttccacagtcatgggaacagagggtagcttttgtattaaatattctaggtatttgtagttcacatttcctcaaagttttagatagcaactttacagttttttctcatttattaaaataagcctatacatagttacattattttatcttcacattttaacattgattttaccctacaattgaattcctagtctgatcaatacaaattattaaaagttttgattttttttctctgagagaacaagcatattattggcaaactatgatagtaatgaaatataataaatatgatgctaaaacctctggagtttataaatcagatgattaatatggcctataagatgatttatttccatctcagatgacattcaacaagtttaaattatacaattctgagacaaatgttggacttcaggtatcttgtgcatgtctacaaatatatgaagataaataccctacttctcctgaggaagtaaattagcagtaaaaggcagcaatgcaagtgggaatagacaataaattaggagaaaactttatttttctattagagtgagccacctggctcccctgactagtagagtaagactactaaacaaactatcaagtgctctcataataaaaacattaaaaacctgttgtgtgtcttttcttttcttttttttttttttttgtttcgctcttgttgcccaggctggagtgcggtggtacgatctcggctcactgcaacctctgcctcccgagttcaagcgattttcctgcctcagcctcccgagtagctgggattacaggcacccgccaccaagcccagctaattttttgtatttttagtagagacagggtttcaccatgttggccaggatggtctcgaactcctgacctcaggtgatccgcccacctctgcctcccaaagtgctgggatctcaggcgtgagccaccgcacccggcctgtgtatcttttctataatgccatttctggtaattggatattggacataaaaacagttgtaatgttcttaaagtgtttaaagacaaaagcttgagagctcaatatgtagatttaaataaaaatggacagttggaaaaaaagaaacttaagcatttgaaaacacaacctgccattactattaaaataattcacatatttatattcttggaataatcagctttagacttaataacattcgttaacctaagcagtcataatcaaagttctgcaattccttgatttccagaatttgtggatgaaaaccttcattagaagcttaatggattattttttctgaatctctcagtaagctatttatggggtgggtgtgggtgagcatcaagcttattggatcttgattactctttttcattgaagaatgaaaacaaatgggaacttttcttgacagataatatgaatttataggccaccaaaatattacagataaatacacaagccatacagataaaagaatgatagtaaacatatattattcaaatatagaaacaaccttgccaaaatgaacaaagtcagcttttctttttttttttttttttttttttgagatggagtctcgctctatgcccaggctggagtgcggtggcacaatctcggctcactgcaacctccgtctcctcgggttcaagcgattctcctgcctcagcctctcaagtaagtgggattacaggtgtgtgccaccacacccggctaatttttgtatttttagtagagatggagtttcaccatgttagccaggatggtctcgatctcctgaccgatccacccgcctcggcctcccaaagtgctgggattacaggcatgagccactgcacctggcccaaagtctgcttttctaataaaagtctgcctacattctggggaagcaactttccttcctctccgtatacccagaatgacagagaacagtcgaaactatttgagcaccttccatctaccccaagacaaaagcatgtatgtgactatcatactcacattttagttccattctggtgagccacagaatacatacctgcctgaatgattaagcgcaaactgaatttgtgtaactaggatatttctaatgtacaggtaatctgactaatcaacaattaacttgtcaagtactgatacaagactgtgctagaagtggtagtgtaagatacagttctttctgtcaaaatctctttggaagagaaaataacctctttgttttaacgtggccccactccaatccattctccacacagctgctagagtgaactttctaaaatctcattgcatcatttcccagtttaaattccttcagtttcttactgttatctgcaagagtaaaattattgaacacagcattccaagttcttcgtgatctaatgcctgcaacttctcaaacttcatccctggggccactacccttgctccccaccaaacccacacaggcagtttatcttgcttggtatttctacccctccttgtctccctcccttccttctcttgcccagttaacttagttcagttgtgtcccttataggcagcctccttcacccctctcctctgatcttgaatgcaagttaaagaatttgataattgtgagtcacagatatttccacagggaagaaacatgaaaagtgcaggagttttgtgaaaatacatttgacagatttggtggatttaaagtaggaacagacctagcatggtggctctttcctgtaatcccagcactttgagaggccgagacaggagaatcgcctgaggccaggagttcaaggctgcagtgagctctgaatgcaccactgcacgccagcctgggcaacagagtgaccctgtctcaaaaaaaaaaaaaaaagaggccgggcgcagtggctcacgcctgtaatcccagcactttgggaggctgaggcgggtggatcatctgaggtcgggagtttgagactagcctgatcaacatggagaaaccctgtctctactaaaagtacagaaaaaaataagctgggcgtggtggcgcatgcctgtaatcccagctacttgggaggctgaggcaggagaatcacttgaacccgggaagtggaggttgcggtgagccgagatcgcgccattgcactccagcctgggcaacaagagtgaaaatctgtctcaaaaaaaaaaaaagaaaaagaaaagttgggttagcagttatgaatcagttgggaggggttaaccctggcacgtgagaggcaggggaaatataatgacttgaaagtcattacaaagaaaacctgtagtaagtattttaaagcaaaaaataatttgtgagttctataaattcacctttttttatattattgggagtataatgtgatatttgccatggaagttataaagtcttacaagtcttaaagtctcatgagatatctcagcaaataattggcaggaatgccaaagtaaagacacagttacagaaatgaacagtgtattcattcattcattcatgagacagcgtctgtctctgttgcccaggctggagtgcatcttggctcactgcaacctctgccccccgggctcaagccattctctcacctcagcctcctgagtagttgggactacaggtgtacgccaccacacccagctaatttttgtattttttttgtacagatggggttttgcctttttgcccaggctggtctcaaattcctggactcaagtgatctgcccaccttgacctcccaaagtgctgggattacaggcatgagccaccgtgcctggctgagaaatgaacagatttagatacttccaggatatttctatttaatacttcaccaggatgctaaattaccagtttataataacaaattctacaattacatattctaatacctcaaacaaaatatgacatgaacacctgtgatataaaagggccatttaatggctcacgcctaaagcgctggcactttgggagcccgaggcgggtagaactcttgaggccaggagtttgaggccagcctggccaacatggcaaaaccccatctctactaaaaatacaaaaattagtcagcatggtggcacacacctgtagtccagctactcggaaggctgaggcacaagaatcgcttgatcctgagaggaagaggtttcagtgagccaagatcgcaccgctgcacttcagcctgggcgacagagcaagactccatctcaataaaaaaagtgggagggggacatttaaaatgtgtttttgtcattacctagagcagtgatttgaggattgccccccaaatgtcataaattggtatatcagaagatagctcttgaattgcttagggggctcctgaaaaataaggactctagtggctggtatatcgtgtgagtgataacagcaatggattagtcagtcgcacactggcatgtggtatgtgtggcccactcttgcaggagagctgttctgtccctggcatattcaacgttttaagaactcatagccagtactttctagcatatacctgatacaccaagttgtttctcatggttgattatgtgagctaactggtcacaaaatatagcactgtacaactattggttaaattttcaatagtataaaactttattagactttcatctgctttgaaacaatttttcaccatagtgttccctttttttttttcctttttgagacagagtcttgctttctgtcacccagcctggagtgcagtggcccaacctcagctaactgcaacttctgtctccagggctcaagcaatccacccacctcagcttcccaagtagctgggactacaggcccatgccaccatgcccagctaatttttaaatttttaaaattttgtagagacgagatctcactatattgcccaggctggtctcaaactcttggactcgagtgatccacccacctcagcctccccaagtgctaggattgctagtgtgagccaccctgcccagccaactatagttttctaaaccaacaaattctacttattttccagcctaagcaaatgcttacttgggctgttgtgatttccatcaatatctggttgttcttcttggaaagtaagaatagaagataaaatatagttttaaaaaatatgtaagtccaaggaaatgaatcgtatgttttatgccaacacagacagacaaaaaacaaaaaaaattccttcaccaactcaggagtgcggacatacgtatggtctttgatgagtctcagtatattttatgctttcttttaagctcctactattgctagtaaatgactttaaggatccattcaaatatgaattgctatacaaattcctctgaataagtggcaagatcccatgtcttacctggaataacatgtcctcaactttactgtaatgggagaagttaaatcttttaagatttgtggagaacgagagctgttgcaagccagagattactgtagaaagaccaaataacagtaagatgataagcttttagactttcaggctctttccttctaaaagaccatcgtgaatccacactgtgaggacaactgctcacggttgttagcccaattacctgcagcatttaaatcaatactaatagcgaacacctgctgatttctgtggttacatttaaccacacctgtttttgtgggcacctctacatgtatcttcatctccagaaatcctccttttagagctcagtgtgaaccaaatcactttttttaaaccacactcagtgctagaagattgaaagaaaagacgcttttctgaatgtgagtgcacctctcttctctctaatagaagcaggctatataaagatcttgcttgtttagcagttctctgtcatttgcttactataaaagaaactgtagttggttttttataaatatgcccagaaacaggtaatggaaccacaatagagacttgtcaatttgatttcataaatacattcaatctaaccaattacataataaaattgttcacaaaactgtgattatgaaaatcaacttagttttttttttgggggggggacggaatcttgctctgttgcccaggctggagtgcagtggcacagtctcacctcaccgcaacctctgcctcctgggttcaagcccggcccccaagtagctggaattacaggtgcccaacagcacacctagctaatttttgtattttagagacagggtttgtattttatgttttagagacaggctttccccgtgttggccaggctggtctcaaactcctgacctcaagtgatctgcccaccttggcctcccaaagtgctgggattacaggcgtgagccactatgcctggccttattgactattttaaccctgacaataattcattatttcgagcaatgtttgtattggtgaccaaacacaaagcttctttttccataacagctgcttaggaatcacatcattccaatgaacactcagattgggaaagggagaaaattacattgtcctgtgacggcttcacctctgcaattttctgaggaatttagaatcctaccaccatccaaacagacctccttcaccattacccgcccccgcaattggtttgacctgaattgcttgttatttgagaagagtggagtttaaagttgctctgcaactacctactttattttccttaaaatgggctccataaaatgtgcatggtatttttagaaaaaagtataggtaatgttgcctgagcccatgttaatttgaaatatttcctagtaaatcatccccttctttaggaaacatcgaaagcacattatgcactgtgcaggtgaaatgaatggctggaaaacacagtaatatcatcgtgctcctcagtggcgggtcaatcagaagtcaccagaaaaagtccaattcaagaccagtggtaaacttagcagaaaaaaaaaaaaaactgctctacaacacagtgtaaaccatgcacactagtttatccctgttattagaatagactaattcatgaaaaaatgtgaaaatcaaatttttatgactcaaattctatttagaaaccttatctcatttttgcatattgcttgtgtagaggagaaaagttttcttttcttacccgtcaccaggtttatgcctgagacccctataacaaaagacagattaaaaagagaaaagcataacaaatttgtttaatataagttttatgtggcatgggagtcttcagaaatgaagacccaaagaaacagggaagactgtatatttattttttttcttgagatggagtctcactctgttgcccaggctggagtgcaatggcgtgatcttgactcactgcaacttctgcctcctgggttcaagtaattctcctgcctcagcttcccaagtacttgggattacaggtgcctgccaccacgcccggctaatttttgtcattttagtagagacgggatttcaccatgctggccaggctggtcttgaactgctgacctcaggcgatctgcccacttggacctcccaaagtgctaggattacaggcgtaagccaccttgcctggcagaagactgtatttttatagacagtcatgcagaagtctgatgagacaaaggtgggcctgatctaatggtaataaactgagggaatttagcaaggcttctttgttcaaattcttccctttatgacattcctttcctccaggtatagggaggatccttctggaatgagtctttgacctaattcaaaggaaggtcagcttgattttatatggtctgcttcaagggagaaggggtgagaggaaggcgtaaggatacacttcctgcgcctgctgcttcctcaaatgccaagtgccatattttgggatgacacgtcctgaaacccatcacttcacaattttgaaagcgtttgagtctatgctttctcaggtaaaccctctctctcagcagtcctattagtagctggaattacgggaaacaggcatctaactgatttgtccagacacatacaaagcggtagaataggggttccagatgaagcctacggatttcttcaatgtagggaagatgcctacttctttttcgaaataaacaaatcctttgaaatagaatcacacctcaattttcagtgtaagaaaatctggattttcatgttggatttgtttaaagctggatgcacctttgtgtatgtttttgtttgctttcttctattttcagaaaaggacatggctgagttattttatatgttcaacggtcatcacgatatcatcttattctctgaacagaaaatgacttattttaaagaaattcatttccatccttattagtatttactttaaaaaaattttactcagtccaaaatttctttaaaatcttagaacacagctattaattcatctttaatccagcatactgatctcaaactcatgactgcctaggcaaattagtctgcagtatttgttgtttgagattggctatttatccagaaaaaccatcgattgtgccaacttgcaggctgaatatctggagtcacatctttcatgtgtattccacagggagagtgtctgtgatttaaaaattcaatcttatttttttccctgtttccaactactttgtagttatttggcgaaccattaaaacagcctcagttcattcatctgaaaactgaagaagcagctttcttctaagaacttatgttggcaaataaagaattaatatttacagagtatttggagttgcgtaagtgaaggttttagaggaaagaaaaataatttttttgtcctcagatcaaaactataataataatccctctaaggccttgataaatgacaatgtcatagtagccaccttgcagtcagacagcagagaccaggggaaaggaggaacccaggttgatttaataatcaaccctgactattaaatctctttgcaatttaaagcaggtaatttaagtttccctatttataaacagagatgatagtagctggctccgcatcacagaatattataaaggaacataaaataatttgagctccttaaaggaaaagtcacattgaaatgtaaggagttcacacaagttgctttaaaaaggcttaaaactcacagcaacaacttgaatgtttaatgtcagttaaacattttagttcaataaacctgattataaatctcactgattaattagctatttgataggagatactgtttcactgggtcctgtccaaagattcttacgcatttagaaaacctttgcagggatctcagcttaaagatggaagaagcacgccattaactgttcctgaatatctacctactcctggaattagggcaagggtatattccaggtgatgatgggctaaaggggctgatttacagagtttttcttgaattcctaaaattgcctgctttcatcacctgccgttttattatagagtaacaggaattaatggttccagctacggtccataaatgaccattagtactttgccattctagattgtccctgactttcctaattcagttttcatgtggtctaaaggtttgaacatggatagccctaaactaatttttataaagacagtaaattggatttcttatgtatcagctaactaataatgttctgcctggctgtgggctttgtacaaaggcttgttttattgggggtggggatagtgtaagcactctccccagccacatccctctaccccgaacccttcccctttctgcatattcccagtgctgagggtactctggcccccggactcttcaggattagaacctttttatgttccctgtacctggcctgctagcctcctttcccacagcagcctggcccttgcaggcctacctccctagtggcctggggaggagagaaggagtgcagagtagaggataaagggttagcctaggcgcgagcctcagccaacataaaataataatatgaggccagacacggtggctcacagaggctgaggcaggagaattccttgaacccaggaggcagaggttgcagtgagccgagatcgtgccattgcactccagcctgggcaacaagagcgaaactccgtctgaaaaaataataataacaataataatatgagttgctttcaacttacttataataataaatgtcagcgtccttaaggatccaactgttaatgtgtccttgatttctctcttaaattggctgtcgggtcatggaaaagattgctttcaagtaagggaggctgaggcagaaggatcacttgagctcagaggttggagttcagcctgggcaacatagcgagactccatctctaataaaatttatagaaaaaaattttttttctttatttaaggtccaagttccagccgttctttgccatagagattaaaaattaagtggctgcctgaccttttgccagcccttgtggagaaatcaagcccctggaaacaggagatgcctggtttatctcaactgctcttgtctctagggtgacagttacaagcctgccactgcctcctcacaagactccttgaggcctgaaaattgtttatcaggcagattgtttggctataggaaataaggacacgtgtacaaacataatttaggatggatttagactttttagctctctggcaaaaataatttcaaattaccattctccctccccttgaatgtatcatcagtattttgaaattttgtctttataacagtttattggaaaagttatgttgatgtgttcccattgtactggaaaggagcaccctgtgttgttgtattctcaacatctttcatgagtctctgaagcctagaagagttaattgagtatattttccctctgatttctaaaaaatgctacatgacagaaaaaaatttcagttaaatgtaagaaagtagatattacttggcttttggagattgttgattattttgattagcctttttttaaggcagtaagagaaaactcaaaacaaaaaaagctgagagaaggataaaggaggcagaagagggacacaacatactgctttccaccactcccccctcctcagacaggagtatgtgaagatatatgagacaggcatcagttgaatccctgtaggcttcacagagctgagcacaaagggctggctgctgtctgtgttttcatgagagtgggctggctattagaccaccaaacaaaagaggggccaggtgattccacaaaagcagccatttggatggagcatagaggttgatttcctttcctgcctaactctcctgttgccaaatatctcaaccccagcattggcctgaagttgatccatgtttcccttgatcatgctgatctaccctgttgtttttcttgcttttgtttttgtttttttgagacaggagtcttgctctgtcgccctggctggagtgcagtggcgctatctcggctcactgcaacctctgcctcccgggttcaagcgattctcctgcctcagcctcccgagtagctgggattacaggcgcccaccaccacccccgactaatttttgtatttttaggagagaccggtttcaccatgttggccaggctggtctcaaactcctgacctcatgatccgcccacctcggcctcccaaagtgctgggattacaggtgtgagccaccacgcccggcctatcctgttgtttatacaagctgtcttatctagtagtgctgagtcaccattatatttattgcctacacctgcttattacaagaagcttccgaattcctgccttgggaacagagttctgtgactcgggaaactgaattttatagtctcgaccagctaaaccagacaatgagtcccaaatttttcagcactataacaaccaaacatttttagatttttgtgaatttcctctcccttctttttctttttttaaattcaactttcattttgaaaactttttttttttttttttgagacagagtttcactcttgttgctcaggctgtagtgcaatggcgcaatctcagcttcactgcaacctccacctcctgggttcaagcgattctcctgccacagcctcccgaatagttgggattacaggtgcctgccaccacgcacagctaattttttgtagttttagtagagaggggctttcaccatgttggccaggctgctcttgaatgcctgacctcgggtgatccacccacctctgcctctcaaagttctgggattacaggtgtaagccaccgtgcccagccaaaactttctttttgagacagagtttcacttttgttgcccaggctggagtgcaattgtgtgatcttggctcactgcaacctctgtctcccgagttcaagtgattctcctgcctcagcctcctgagtagctgggattacagatgcccgccactatgcccagctaatttttgtatgtttagtagagatgggtttcgccatgttggccaggctggtcttgaactcctgacctcaggtgatccacctgcctctgcctcccagagtgctgggataagaggcgtgcgccaccacacccagctgaaaaacttttgtagagaatgttttgataacctttgatcacttgccatatcccagggtggtgtgaaactagcatttaaaaacattaacgtacgtttaatacttgttcttggccttcattacttaaatttaaaagtttaatacatcattgttatacagtctgtaaatattaattagcctacttgtattctgagttattttaatatttgcttgattgcaggaaatcttcaccgaaccagcagtgttcctgagtatgtctacaacctacacttggttgaaaatgattttgttggaggccgttcccctgttcctaaaacctatgacatgctaaaggtaggatatcaaagaatgtaaccctagtgatcagattactaccatgaaaatattttcaaacttcctaagattatttttgagtgtttacttttcccaagtattatcatttcctaaatgagttttgagaaaattgatatttatgaggataccatggaaaactagggatgtgaaacattcttacatcctagtgcaaataaatatgactcaagtcaaccaagtcttattttcaaaaagcctttacccagaaaggggcaaacttctcgtcatctgattcagagaaacggacatgttgggtaatagtcccagagtaattagtcctcagcaaagttgaaatttgatttatgccccctttaaactttatttctctcatgtgcaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggtaagtcccctcctgactctgcagttcagtcattgccagcacattctgttcccacagccctgacagcatgagctggcacttctggggcttgagagaagggcttccagagataagtgattaaaataatgacttttcaggcagctgcctaattgacagatcagcctatttacctcagggacaggggccaagctacctgctcacatggcagctttgtatggaaatgtgacatttagtccatctgttccagattagatgctggctgaagggaccctacccctcagccatatgaaaatctgctctaaactccaaagtaggccaagaattggagaattgcatgcgtattttcttcatcatcccatgaaataaaaggaaaaaatgcttattcttagcacgaatgccatttggataactatgactgtaaaaagagctaaggaaagatggctgacttctagatgtcttttttcttcctttggtacttggtaccttttagatttctagtgtcagtgatttgaaggggtattcttttggcagtattaaattattaaaataactgaatttttaagtcattcctttccattcctatttactttatagcttgactaatttagtgtttggaacttaacccttattcaagtttaatgcctgatcacaaattttataaactgtgcacgttactaagagaaagattgagaaatggatggctgattagatcagtaactcctgcaataatgatctaacatcattaggctaaaacattagatatgttattgtcatttgattgctaaagttgtctaatgatagttgttacctctaaacatcccttcaagtgaaattgtacagcatgctcactgaccaggtagcatcattaataaactacttctcaaaatgatgagggctaatctaatcttaacacaggaaatattttttatgatgtaaaattcaccatgagatttctaacatttcttatagtaagcagaccttaggcaatatgagcatacttacaaagaggaaaaataagccgggagcagtggcccaggcctgtaatcccagcactttgggatgcccaggcgagcgaatcacttgagtttaggagttcaagaccagcctgggcaacatgatgaaaccccatatctacgagcaatacaaatattagctgggtgtggttgtgtgcacgtgtggtcctaactactcgagaggctgaggcgggaggattacttgagcccaggagatggaggttgcagtgagccaagatttgtgccactgcactccagcctggggaacacagtgagaccttgtctcaaaaaaaaaaagagaaagtgtatcaggtcattgtttatggaggaaaaagctgataaaggcttttaaacaggtaattcaaaatttatggaatgcctaccatagcctaggatttgtgatagccacagttttagcaaaatgattttaacagtaacaaaattattatctgacatcctccaacaactggcattctctccctccatctctgtgtcccttgcttcttgaaccaccctgtcacttcccagtctctcgtcaacccactgcaatatgatttcagtcccctccattccacctaaacagtctcctgacaaatgtagcaatgatggccttatctgctacatcctaagcagacactatattgagtaatataagcactgcttatattactcaacctgtgggtggtgtttgagacaccatgaaattctctcatcccttggttttcagggcaccagcttcccctggttttccactcacctctccagccattctttgttagtgttctctgcgtgctccctttctgcctgctcaaagaaggcatcttcagtaacccttctattccaagtcttgatgctcttccagagaggctctgtgtacctcacttttatccttatggttctcaaagttttgtctgcaattccatccttgatgccaaattctggacctatatgaaaatgtaacaacctcctggaaatttcacactcagtatatcctaaactaaactcatcatctccctatcctcaacttccacccatctcctcctgctgtagtctactattttcaaacctggaagtcattcttatcttctccctctgtagtcacctatcaccaagccatatttttccttctatgatgggtcttgaatttttacccttctttccatttccattacacagggctctctgcctctggtcttgctcagtcagaaccgttctctaggactgtcagaattatctttccacatgtgattgtttataacccttccataattccactaagtgttcatgcttttaggcatgacctacaagccccattgtgttttcagctctgcttatcacttcagcctcttctccttctactcttctctgccattcatcaccaccatccccaaacatacccacataccaatacccaaaccacctggaacctctttactttccttaatgcaagatatttatccatattcattctctctctctttccttcttttcccccactccacacctttacatatgcagctctacttttgtctgactacttataattctggatttagctcagataccacctattttctgaccacttccttcccagtctagcttaggtgccccagatagcagccttgtgtgagtgtctctatcagaaaaatatattgtggctattcatttgcttatctgttctccctctggactttgagatttttgtgaatgctcaatcatctttatattctcagcaccctaaaatggaagtaggcctatagtaggcactgtataaatatatgatgaggccagcacagtggctcacatctgtaatcctagcactttgggaggcccaggctggaggatcgcttgagcccaggagtttgagaccagcttgggcaaaatagggagaccccgagaccccacttctattaaagataaacaacttagcctggcgtgatagtgcccacctgtggtcccagctactccggaggctgaagtgggaggattgcttgagccagggaggttgaggctacagtgagctgtgattgtgccactgtaccccagcctgggcaacagaatgagatcttctttcaaaaaataagtatatggtgaaagagtgaaggaattaaaggaaggagaaatgaaatataaattttactttttgccatctaggttcttttgttgctcaaattctagaagtattagtcatactatttttggattattgttttaatagacagggtaaattgtattataatatttaatcatatttccaagagtagaaggaacacttggggtcaagaaatttaaaaataatgagtaagaaatctcttcctgagatttccccaaattctagagagtagaaatcatagaaatcaactttttttctctgattatgaaaggaaaatttggctctctgtgaaaaggagagggagccagacgtattttgtgtaatgaggaagatagatgcccaaggtggtgcctgtgcctgtctgacctccccctttcctctgctgggctccacgcctcatttcagttccccaggctgctccctgggacacctgccctgagaccacacactgtgttctctttggtcccgcattgtcaaactttgtccagcccttttttgggggggatttaagtttttatgcctagtgaaactcccacatgtaaaggagtattctttcatatatgttgaatattaactggacaaaaccataaacctgcataatgacttaaggtattaaacaatggacctggctttccaaaagaagaatggctggttaaacagttactaatgcagctaaaaactgagacttggagtgtgagagagacaaactgatgaaaccgatgttctaaatcaaactgatgaaaaaggtttttaagaatcaccacaaaaaaaattatagatgaatttttctaaaaccatgatttatgaccagttggaggctgatggttctgcaaatgagtagtaggatcttcataggtccttcccagtaagcatcacaaaagatgaaaatgggccggacgcggtggctcacgcctgtaatcccagcactttacgaggccgaggtgggcggatcacttgaggtcaggagtttgagaccagcctggccaacatggtgaaaacccgtctctactaaaaatacaaaagttagccaggcatggtggtggatgcctgttatcccagctactcaggaggctgaggcaggaaaattgcttgaacccaggaggcggaggttgcaatgagctggtatcgtgccattgcattccagcctgggcgaaggagcaagactcagtctccaaaataataattaaataaataaaagatgaaaattgagtgagatgtatgatggtctaggagaggagcagtgaaaaataggatatatcatcaagtgctaggttgtgtgatacatattagtgtctacagaaatttaaagaacacaagagcagggccgggcatggtggctcacacctgtaatcccagcactttgggaggctgaggctggcagattgctggagcccaggaatttgaaaccagcctgggcaacatggcaaaaccccacttctacaaagtacaagaattagctgggcatggtggtgcatgcctgtagccccaactactcaggaggctgaggcaacagaatcacttgagcctgggaggtccaggctgcagtcagccatgatcgtgacactgcactccagcctgggcaacagagtgagaccctgtctcaaagcaaaacaaacaaaacccacaagagcatcgtgctctgggattagttgagggagactaagcagagagggtggatcttctctaggattgacagtcaaatttgtgaccaagagcactgcagagcagaaaacagatcatattgacttccctccacgtcctcttaattactacctgctttagttctttaatttttcatctctttcaactctaccttttttttccatttccatttttaacagcccagttcaaggcttttttgcctcagctgaaccttttatagtgccctcaacgctgtctctctttcaagaaacacatatccattccagagtcatctttccaaagcattgctttcatcctactttaaaatatttgtggggatttgcatttactgagcgtctgacaatacttgtaggagctatccattcatcattttatgtttgctttgccttcagaggtgtagccatattctaatatcaggggaaccagcctgggcagggctgtgttgttagttggcaggaatgctggctacggggagattacacacgcacacaagttactgggttgttttgttttgtttttttttgagacagactttcactcttgttgcccaggctggagtgcaatggcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatagagacggggtctcattatattttccagactggtctcaaactcctgggctcaagtgatcctcctgtctcggccttctaaagtgctgggattacagacatgagctaccttgcctggccttaaaaatgattttagcttggccaggcgcggtagctcacgcttctaatcccagcactttgggaggcccaggcgggcggatcacaagatcaggagatcaagatcatcctggctaacaaggtgaaaccccgtctctactaaaaatacaaaaaaattagcccggcgtggtggcgggcacctgtaatcccagctactcgggaggctgaggcaggagaatggcatgaacccgggaggcggagcttgcagagagccgagatcgcgccactgcactccagcctgggtgacagagcaagactctgtttcaaaaaaaaaaaaaaaaaaaaattagccgggtatggtggcgtgcacctgtagtcccagctattcagaaggctgaagtgggaggatcgcttgagcccaggaggttgaggttatggtgagctatgatcacatcactgcactctcacacctgaaacagaataggactgtctctctaaaaaaagaagaacaagaagaaatgaagatacttgaattgagtcttgaagaatgggtgagaattaggtagtatgataagcttcctggaaaagtcaaagaaggtggcttgtgaagaaggtggcagtgtttagagaaggattaaaagcctggtgtgattggaggggtgtagtagatccaaggagggggaggaaaagaggttgaggatgacaggaaatggagtcagacttgggccagaatgtatgccgtgttatggagttggacttgatagatagtcaaacagaaagttgaccccctgacagctgtagtaaaccttgctgaggaagtcttcacttagtttaggaatttttttagtgataaagtgaaatcgcattggattgcctaagtgtgaacacagagcttctatgtgaatcatgttcaggaaaataaaggattagagtagtggaattatttgtgggtgttagagatgggaaattcaaactttcctgagtcatgtatggcttatgaaatggattaatggctcaatctttttttaaaaaaaaagctgcataacagaaggctgttcttatgaatgatctttcatcagttaaaacaaccgtgatggctggcaaagactttgccattgagcttgagactagacttacagagttttgacttctctgtaaaggcctcagtccatgaatgtaaaatattcccatctcctttaaaaggtgtaatatcctctaatattagataaaaatattagataaaagtgactcaaattctagttttagtggtaatagcctgcattttttttttactaattataattgactcatgaggcacattaaaaatatgagatcattatataattctcagtatagatgccagagattttctgcttcacttttaataccctttatacttatgaggtaacccttctgtgtttgaacacgtgtttcagaagcagggggtattagtttttggtcatgaggcgcattactccttatcaccccacctgcaccgcccccacccacacacaggcacacccttcataaggctgtacacactaacacctgtacacatgtgcatgtattcatgggttagcctaatagaaaagagtatttactcactatgcttgctagtagatattggaaaactccttctcaggatgtctccagtgtctggaatgaatgtgtctggaatgttacctggaatgaatcaggtataaccctctttgaagccaaagaacactcctaaattacctttaaagcatgtctttagtcattattttgtttgtttgtttttgaaacagagtctcactctgttgctcagggtggagtgcagtggtgtgaccaaggctcattgcagccttgacctcccaagctcaagcgatcctcccacctcagccttccaagtagctgggtctacaggcacatgccaccacacccagctgattttgtttgtctgtttgttttttgtaaagacagggtctcactatgttgccagggctggtcttgaattcctggactcaggcaatcctcctgccttgccctcgcaaagtgctgggattacagatgtgagccaccgtgcccagcctagaaataatttttaatttctgtaaacagatttcttttggattcttttaaaagtcttattgtgcctttaaagttgcttttataagatgtaagaatcataggatacatatttatcttttttctttcttttttttttttttgagatgcagtctcgtttttcctcctagactggagtgaagtggcactatctctgctcactgaaatctccacctcctgggttcaagtgattctcctgcctcagcctcctgagtattacagtattacacctgagattacaggtgtataccaccacacccagctaattttttttatttttagtagagatagggtttcaccatgttggccaggctggtcttgaactcctgacctcaagtgatccgcccacctcagcctcatatttatttttaaaagttcagcttctttctttggtatatggtataattcaatcgaatgacatcgtccaatgtcttctatctgatcaaagctgaagaatttctatccagtagtccctctgccttgtgatcttgggtgctgatttttcttttggctgaagaaaagccaaggttcagatgttctagtgcttcccagtattcgctgagtcgtctctggaggaccaggttggtaggcaggaggagggaggtttggaatctggctgaatctgtgcctgtttgtctaggaatgcagacatggagatgactctggagcgagcagtgagtatgctcgaggcagaccacatgctgccatccaggatttctgctgcagctactttcatacagcacgagtgcttccagaaatctgaagctcggaagagggtgagtgtcatcttcagtccattgcaaagcgcaacacactttcacttctattatggtgactttgcacactgaaaccaataatttatttaaatttttaaaaattgggaccgtgcgtggtggttcacgcctatattcccagcactttgggaggccgaggcaggtggatcacaaggtcaagaatttgaggccaacctggccaacatggtggaacccctgtctctactaaaaatacaaaaattagttgggtgcagtggcaggtacctgtaatcccagctactcgagaggctgaggcaggagaatcacttgaagccagaaggcggaggttgcggtgaactgagttcgcgccactgcactccagcctgggtgacagaacaagactccatctcagaaaaaaaagaaaagaaaaaatcaaccgggtgcagtggctcacgcctgtaatcccagcactttgggaggccaaggtgggcagatcacttgaggcaaggagttcaagaccagcctggccaaatgatgaaaccccaactctactaaaaaaaaatacaaaaattagccatgtgtggtggcacatgcctgtaaccccagctacttgggaggctgaggcaggagaattgcttgaacccgggaggcagaggctgcagtgagccaagattgcaccactgcactccagcctgggcgacagagcgagactcatcctgaagaagaaaaaacaaacaaaaacttaattgaggtcttttactttaaaagaaaacagccactcattaccaaaaatatttcctgcaattcggaaatgtagaaagtaagtcactacacaaatttccctcttcttttcctgtctccccaacctctccatttagaaccatccccagaggcaagggttttgcaactttttttcattcagtgattccattaacatttgtaacaattgttcaatgaattgctttgtgcatatatgttttgacacttctgttcctgtaggacagatcctcagagatggaatcaatatgttattttatatttgtcttaaaaagtgatacatttgtgagggaggaggaatcacagctcaaaaaggtgttcagtgaaaagtaagtctcttctactccaaactccagcctatatattctctctgttctgtctctttcaatctctctcacacacaaacacatatatcaatttttttatctttccagagatattttatacacgaagaaacaattgttgaaacagttgattgagtttcctttttaaaacatgaaatcataaatgataacttactacttataatactttatttttttataccgtatcttggaaatcttcaatatgtattaatcttactcattcttttaagatgctgcatagatttctgttgtctaaatgtatcagttttgttggttgattttttaactaccttattgaggtacaatctgacatagttttgacaggtttgacactaaaaccatcatcacaatcaagataacaaatatatccattacctccagcgttttcttgtgcccctgtgtaatccatataatccctccagccctcaacctacgaacagcctcccaaaacaaccagtgatctgctttctttctatgttttgagacagggtctcactgtgtcgcttaggctggagagcagtggtgtgatcacagctcactgcagcctcaactttctgggctcaagcaatcctcccaccccagcctcctgggtagctgggaccataggcgcacacaaccatgcccagctaatttttgtattttttgtagagatgggggtctcactatgttacccaggctggtctggaacacctggctcaagcagtcctccttcctcggcctctcaaagttctggggttacaggcgtgagccaccatgctcagccatgatctggtttctgtcactatagattgaattttctcgaattttatataaatggaatcatatagaatataagatttttttggtttgaattattttactcagagtaagtcttttgagattcacccatttcgtgttaatcagaagttttggctattacaaataaagctaccgtgaacatttgtatacaagtcttcatgtagacatgtgcttttatttctcttcagtaaatacctaggagtaaatgcctggatggtatggtaggtgtatgtttgactttttaagaaactgctaaaccattttacaaagtagctgtgccatttcacattcccactcacaatttatgagagttccagttcctcctcatcttaacatttgatatagtgagccttaatgttagcctgtaagtttgtacaggtgttttactgtggttttaatttgcatttccccaatgacaaaggggttgaactttttttttttttttttttttttttttttgagaaaggatctgcctctgttgcccaggctggagtgcagtggcacaattttggctcattgcaacctccacctctcgggctcaagtgatcttcccacctcagcctcccaagtagctgggcctaccggtgcactaccacaccttgctaatttttgtattttttgtagagatggggtttcaccatgttgcccaagctggtctccaactcccaagttcaaaggagccagctaccttggcctcccaaagtgatgggattacaggcatgagccaccacacccagccagaacatctctttatgtgtttatttgccacttacatatcttctttagtgaaatgtgtattcaattcttttgcccattttgttttgttttgttttcttattattgaattttgtaagttttttaatattttctgtatacaagaccttttctagatatataatatgaaaatattttctcccagttgtgctctgttttttcattctcctaataggttttcattttaatgggatttaatttattcagttttttccctttatggtttctgcttttcatgtgtatccaagaaatgtttctctattcaaaagttagaagataatctatattttatcctagaagttttgtaaatgttatatattttagttgttctatggtccatttgtggttaattttttatatattgtaagatgtggactgaagttcctttttttggtatatgtaaatttaattgttcaggtgtcatttgttgcaaagacttttatttcactgctaaattgtctttgtatctttgctgaaaaggaattgatcaaatatgtgagtctatttctggactgtgtattctgttctattgatctatttgtctttttttttttgagacggagtcactctgttccagacaggaatgcagtggcgcaatcttgcctcactgcagcctctgcctcccgggttcaagctattctcctgcctcagcctcccaagtagctgggattataggcatgtgtcaccatacatggctaatttttgtattttttttttagtggagtcgaggtttcatcatgttggccaggctggtcttgaacttcttgcctcaagtgatctgcccaccttggcctcccaaagtgctgggattacaggcataagccactgcacccagccgattttttttttttttttttttctgagatggagtcttgctctgtcactcatgctggagtgcagtggcatgatcttggctcactgcaacctccgccttctggcttcaagtgattctcctgcctcagccttctgaagagctgggattacaggcaactgccaccacacccggctaatttttgtatttttggtagagacaggatttcaccatgttggctaggctggtctccaactcctgacctcaagtgatccactcacctcagcctcccaaagtgctgggattacaggtgtgagccaccacacccagcctgtaagattatttttgaatgtttactattcccaagtattatttcctaaatgaattttgagaaaattgattttttgaggataccatggaaaactggggatgtgaaacattcttacgtcctagtgcaaataaatatgactcaagtcaaccacatcctactttcaaaaagccttcacccagaaaggggccaacttctcatcatctgattcagagaaacagacatgttagataataatcccagagtaattagtcttcagcaaagatgaagactatttgtctgtcttattcaaattccacagtcttgattactatcgttttataagtctcaaaagtaggtaatgttagtccatccattttattctttttcaaagttttgtctattctacaacttcagcagttccatttgaagtttagaatcagcttgtcaatttcttaaaaaataattgctgggattttgttagagattgcactgaatctgtagatcaatatggagagaattgacatcttaacaatattgagtcttgtgacccatgaccatggtacatgttaacatctatttaggtcttcagtttttctcagcagagttttatagtttttactgtagaggtctttcatgtcttttcttagatttatccctaagtttatcatatttccagatgctattataaatggtactttttaatttctatttttggttgttcattgctagtatatagaatagataatatatatataatatatatatttacgtgtgtatgtgtgtgtgtgtgtgtgtgtgtgtgtatgtgtatagtacttgctagaacctctcctacaatcttgaaaagaagtggtgagcgtgggcatattatcctgtttctgatcccagggcaaaagtattcagtctttctttcacccttaaatattatgctacctgtaggttttttataaatgaccatatcaagttgaagaacttcccttctactcctgctttaatggagtttttgaatcacgaatggatgttggatttagtcagatgctttttatgcatttattgaaatatttttatggtttttaattttaattttgccattatggtaaattaccttgattgattttaaaatggtattccattcataaaccccacctggttatgatgtactgtcactttgtaggttttatgactagatttgctaaaatcttgttaagaaattttacgtctgtgtaaaagacatgatctgtacttttagtgtctgtctgattttgagttgtgggtaatactagtctcatagaatgaactgggaagtattcccttcttttcagttttttgaaagagtttggttagaaatggtattatttcttccttaaatgtttggtagacttcagcagtgaagacgtctcagcctgaagatttttatgtgtgagaaggttcttagctgcaaattcagtttcttgaactgctgtggggctgtttagactatcagtggcttttttagtgagctttggtaatttgtgtctttcaagggagtctttcaagggatttgtccatttgatctaagttgctccagtgctctttatttgtttgtgtagatagtgtgatcctttacctttacctgaaaatttttattttgttttgttttttacgaatccacttttatttattattgtttcattagtttaaatccttgaggggtacagcatcactcggactctgtgtccaatagctctagcaggaagattgcttcggaatttggcacaaaccatgccactgtgttcatgcgcccaagttacctttccccagattactctggttttgtttggtttgctgccaggagtcaccgtgttgttctttgctttgtatacataaggacatctcttgcccaagtagaattctgtttcatctcgggcataaacacctttaattttaagaagagatgtgttcccttttgttctggagaccgcacttatagccagcaaaaatggcctcggactacagactgctttccagtcgtatttccatttagaacatttagaagtcccgttcctagccggtctccacaggatccaagatggcgaggcaagaatacttctttatttctttctttatttctttatgagacagagtctcactctgtcacccaggctggaatgcagtggcgcgatcttagctcactgcaacctccacctttcgtgttcatgcaattctcctgactcaacctcccgaatagctggaattacaggtgcccgccactatgcccggctaatttttgtatttttagtagaggtagggttttgccatgttggccagtctggtctttcactcctgacctcaagggatccacccgcctctcaaagtgatccacttgggtcctcctgaagtgatctacctcccaaagtgcagggattagaggtgtgagccaccgtgcccagatgatctgaagaattttcttttcttttcttttctttttgagacggagtttcgctcttgttgcccaggctggagtgcaatggcacgatcttggctcactgcaacctccacctcctgggttcaagcgattctcctgcgtcagcctcccgagtagctgggattacaggcatgcgccaccatgcccggctaatttgtatttttagtagagatggggtttctccatgttggtcaggctggtctcaaactcccgacttcaggtgatccacctgccttggcctcccaaagtgctgggattgcaggtgtgagccaccatgcctggcctacctgaagaattttttttaaatatttattttagttcatcaccagcaaacctgcattatttcagcttctgtatgtctgaaaaagaatttcatctttgcttttgaaaggtattttcactggctttagaattccaggttaacagtttctaaatattagtactgaaagttggccacggcgtggtggctcacgcctgtaatcccagccctttggaggactgaggcgggcagatcacttgaggccaggagttcaagaccggcctgggcaacatggtaaaaccctgtctctactaaaaatacaaaattagccaggtgtggtggcgggtgnnnnnnnnnnnnnnnnnnnnnnnnnnnnnnnnnnnnnnnnnnnnnnnnnnnnnnnnnnnnaggcgaaggttgcagtaagctgagatcacaccactgcactccagcctgggcaacagagtgagactctctctctgtctcaaagaaagaaagaaagttgctccactgtcttctcacttgcatcacttgcattgttttagataagaaatctcctgtcatccttatctttcttcctccatacatgagtcttttcttcccacctctggctgcttttaagattttctctttcttactggtgttgatcagtttggtcacatgtgctttagtgtagtttctcttagttttttgtgcttgggagttcactgagcttcatagatttgtgaatttctactttgcatcaaaattagaaaattttcacagtttttctattcctcctttgggaactacaattacatacacgttaggcttctttagatctttcttttttagtcttctttctctgtgtttttagataagttcaattcctatgctttacatttgctaatctcttaatatgtgtttaatatgccattaatacattaatgtgtttaatatgccattaatcttactcagtgtattttttcttcatacattgtagttttcatctctaaaatttagatttcagtgtttttatgtcttctatgtttctatttaacatgttctatctttgctcaagatttttgaacatatggaagacagataaaattgctaccttaatgtccttgtctgctaattctaatatctgtgtctattctaggtagcttttgattgattggtttttctccatattatgggtcatatttttcttcttctttgcatgcctggcagtttttattggctcctaggcattgtgaattttatcttgttggatgctggatatttttgtaaatattcttgagctttgttctgggtgcagttaaggtgcttggaaacagtttgatcctttcaaattctgctttgtttgtttgtttgtttgtttgttttgagacagagtcttgctctgtcacccaggctggagtgcagtggtacaatctcagctcactgcaacctccacctcccgagttcaagtgattctcttgcctcagcctcccaagtagctgggattacaggcgcatgccaccatgcccggctaatttttgtatttttagtagagatggggtttcaccatgctggccaggctggtctcaaactcctgacctcgtgatctgtccaccttggcctcccaaagtgctgggactacaggcatgcaccaccgcgcccagaccaaattctactttttaaaaaaaattttacttgaagctttgggatacatgtgcagtgtgcatttgttatataggtatacatgtgccatggtggtttgctgcatctatcaacctgtcatctaggttttaagccccgcgtgcattaggtatttgtcctaatgctttccctctccttgccctcaaattctacttttaagatttgttaagtggaaccagagcagcatttattctagagataattaatccctgcttcttaaggcaagacacttctgagaactctatctaatgtagcaggaatttttgagatttttctggctggctgataagaatagtcattgttcctaggcctgtgtgaacatgaggagctgttcccttaaatccttttggatgattatttccctggcctcagacagtttcctcataccacatgtactaattaatactctactgaatactagcaggcaggtcctctgcacatctcaggagttctgtttctgttcagctcttttctctgtggtactcttttctgcaaaaattagctcctttggtcttctcaaactctgagctctgtgccctcaactctgttgagtttcacttaagttttctctcactgccccatagcctgggaactctcccaaggcagtgatatctaagggatcgctatccatcatttactcattttcagttattgaaaccattgtatgttttgtccaatttttgtttcaggcagtaagttgagttgttagttactatcgagtcatttttaattttgataaataactccccaataagtcctcccaaaaattgtacaaatttacactcccatcaacattttatcagagtgttcatttccatgtaccattactaccacaaggtattattcttttgtttgtttttgttaatctgataagcaaaaataggcatttcattatcatagaaattttcttatatttgaaatcaagactaatagttgtccaatcaaacagttattgagggccaggtatagtggctcatacctgtaatcccagaactttgggaggccaaggcaggcagatgacctgaggtcaagagttcaagaccagcctggccaccatggtgaaaccccatctgtgctaaaaatacaagaattaactggcatggtggcatgcacctgtagtcccagctactcagaaggcagaagcaggaggatagcttgaacccagggggcagaggttgcagtgagccaagatcatgccagtgtacttcagcctgggcaacagagagagactctgtcacacacacacacacaaaaaaaaaagttactgagaaaaatattttttaaaatgataaaataaacgcttttatagaatttatcatcatcttgcatgcataaactatgcccattataaatcatctgccatttttagtttaagtttaaagtggaatgagaacttaatggaactaattcatctgagttcaaatcctagtctcttacattaattctatccatcactaattacagagctctcttaagcttttcacctttatctagtctttccaaagcatcaaattaattttcagagaaataagtactctttctatacttatatttcatccatttatagaataggtaagtaaattacataattataacaaatacaattgacataaataccctgggaagcaaacctaaattactgttggtaaacatgtaactcaactggtagaaatagaagtgcaaaggctcaaatagagtaacctaccagctttgatagtactctgagaatcaaggaggtttcacagagggaaaagagaatgttgttggttagccttgcaggtcagtcaagtaaggatcacacaacagagcttctgctgatttttttttcacttgaattcattaattattcatgaagttgagcaccttttggtgtggtttttgactttgtatttcttcagtgaattgtcatttttaatccattgtgtattttttctactaagatatatctctttcttaatgacttacagttctttacctattacacatattaatttgttgttacatatgtggcaaatagtttctcctgctttatttttgttgttgtttttaactttgttttttgtatctttcatcatgcaggattttaaaattcttatgagatcaaactaaatatttttcatctcgatgtctatattttagatattgctttaaaagacctatccctacatctagactttgccgtttcaaaagttgtataattatggagcatttctcactgaccctttgcctatttgttccgtaggaagaatgaataaggattttagaagacatttagctagtgatgaacattctttatacatataggtgaagggaatggggctgaatattgatcctttaatagctagtcagagataaatctttaaatctttttttattcctggttttttggggcgttttgtttgtttgtttgagacagggtgttgttctgttgcccaggctggagtgcagtggtgtgatcatggctcactgcagccttgacctctgggggtcattcctcccaccggagcctcccaagtagctgggaccacaggcatggactcgcctggcttttatatatatttatatatatatatatataaatataaaatatatataaatatatatatatatatatatatatatatatatttttttttttttttttttttgtagagatggggtctccctgtgttcccagggctggtcacaaacccctgggctcaagcagtcttctcacctcagcctctcaaagtgctggcgttataggcgtgagccaccacaccagggcctattcccagtttttaaaaactgggcatcattacgtatgcttcgattttgtagtacaaattactggaatttttattctgtttcccaagttgggctagatttctactatctcttaaattactaatttgattaaaaatatcattttgcttatacataggattgaagttgtttgctggcttgactgtcactcagagataaaggtagaacaaagactggttttgagaatgatgaaacatgaaaattatatgcaaacctaaaaatgtatatgcttcatagaaaatctaagaagtataatatcacaacccaagaacatttgaaaaatccttcttaggttaaacatggtgctatagtttttaaatgtatgtataagagaaaattataatttggacatagagatcaaaattttaaatcataatacttttaaaaccagtagcagcttttcagtcctcattttgtttgattaggattcttggtatttgacgctgttgatctctctctctctctcttttttctttttttttgagacatgttctcactctgttgcccaggctggagtgcagtagcactatcatggctcactgcagcctcaaccttctgagctcaagcagtcctcctctctcagcctcccgagtagctgagactacaggtgcatgccactatgcccagctaatttttaaacattttttgtgcagatgggatctccctgcattgcccaggctggtctcaaactcctgggcttaagcagtcttcccaccttggcctcccaaagtgctaggattacagacatgagctgttgcgcctggcctgaacatattatcttcttttgcttttcttctctactctccaaccctccctctgtcctgttgggctgggaggcaggacattggtggtttaatcatggactctgaagagtcactgctagctgagtttgaatcccagcaccctaattacataggtgcccttgggcaagatattttacttctctgagcttcagctttcttacctataaagtagaaatagttctcctaccaagagttgtcctgagaatgcagtcagataatggtgcactgcctgccacaaggcaataactccgggcaaattgttccctgtcagtgaacggtaggagggtggttcacccaggtaatttcacaccaaaacgtgaacactctttgaatcttcttttttttttttttaattatactttaagttctagggtacatgtgcacaacgtgcaggtttgttacatatgtatacatatgccatgttagtgtgctgcacccattaactcgtcatttacattaggtatatctcctaatgctatccctcccctttcccccttccccatgacaggccccagtgtgtgatgttccccgtcctgtgtccatgtgttctcattgttcagttcccacctatgagtgagaacatggggtgaaccttcttttttccttacctctcatagtcagtcagtcttcaggtcctgttaatgctacttctaaaagtatttggaatctacccacatctttccctccctactcagagatactgtcttggtcccagcaccatcttctgttaatccagctgtctccagattaacatccctgtctccattcttatccattcctaatagtctcatgcttcacagcccccagggagacctttccaataactgcccccattgcctgcaggataaaagacaaatcccttaatttagtctgtaagacccttcttaacgtggtcttattttcatgcctgtttcatatctcatcactgaagtagtcactgccataagtatcttgcaaaaacttactataaaacaaattcaagtttttgataagaaatttgagaaattaaaaaacaaaaaaggaaatgcacccataatctcaccattatcattttggttttgttctctaatttttaatgcatatacttacatatcttcaatcaaattgcatatgtagctttctttgtccccacaaaaaaaaatttttatttcgatttttaaatcgaaataaatacaggctcattatttgaaaacatagaaaatggcagatcctatttatgattcatacatttaccacttctcccaaattccctaatctcatttcctttttgcctgtgtttatgagtagaaattcatagatattttcttccttttttttttttttttttttttgagatggagtctctctgtcgcccaggctggagtgcagaggcttgatctcggctcactgcaacctctgcctcccgggttcaagcaattcttctgcctcagcctccccagtagctgggattacaggcttgcgccaccacacccagctaattttttgtatttttagtagagacggggtttcactatgttggccaggctggtctcgaactcctgacctcaagtgatctgacctgcctcggccttccaaagtgctgggattacaggcgtgagccatcatgcccggccttattccattttttaaatgacatatgaatttttataacattaatattttataaatttcagttaacattgttaaaggtgatggtagttgctaccttgtgttgagtaactactgtgtgcctgacatgtaactgctcatcttacacagtaattcccatttgactaatgagggaactgtatggctaataaagtgtcagctctgcctctcccgtggatacctcaacatgtgggtatgtgacaaccatcaaccagtcttcccccattgctggatgttaatggtttcttattttctgctattacaaaagatgtagtcactatttttgcatgttagtctgtgtcttcatttcacattgtttcccaataaaagttactagaagtgaatattttaaaagttttgacacatattgccacttgccttcctgaaagattatgccagtttacagggagtgattaattctaatgggagggaaagcagagaaaggagtgacatttcatagaggaggtgacatttgagctggatcccacaggatgagtagggctttgccagaagagaggcagagtggactgaaccttccagacaggaggaggaagcaagagcaaaggctccaggtctggagagagcctttgcctcagcagaggctgtgtgttccctatgcttatttgcaaccagaagtcctcgtcatttacttattttataattggcagggaagatagaataaagccacagagagagttaaaattctcatatgtgactctgccctttcatgtatttagaaaccaactcaaatgagaacttctttgaagttctgaaacattcatggtagtctatttcttttttccttttcccaaaggagggaaaaataccccgaggattcagtataattgggaaactcatcaaacctccctggttccagctgcttccctgaacgttaagggacaatagcagcatatttgacattggtcctaatgtggataggattcatcacctaccatcttctagttacatgcaaggagaaggtcattaactttttgcatttagcaggatttatatccatttgcttgataaaatggatgaaagtaactaaaatctatttttaagcttgggataagtgccagacactagggagtcaagttatacagtaagtagagctgtagccggatttcggcctttatctaagcactggtatgtctgtagttctctctttccgggctagagcaagtgctgaaagccaaggtgataaaggtgacagggtaagggagcaggtctgagctggggaggcttccgtatgccacttcttactaattctatcattgcagcttgaaatgcaatatggccagtaagccatttcccatcatattttgaagaaagcaacttataaattatgaattaagttaataaaatatttctaaagctgccaaagtacctcaggacaaataggattttttttgcatctgatatatatactgctactgggaggatttggtatatctggcattcatgaagcttataaagtgtgaatgtatattatgaacttatattttcttaaaaacctaaaaacaggcactgtgccacagtagcagaataacagatcgtacccagaagacacgggtatatatcccacagtgctattttgccagtcaaggcctttctttctgtagtttaacttattaaaaggaggaagccagctgggcgcggtggctcacgcctgtaatcccaacactttgggagcctgaggccggcagatcacctgaggttgggagttcgagaccagcctggccaacatggcaaaaccccatctccactaagaatacaaaaattagctgggcatggtagggcgcgcctgtaatccctgcaattagggaggctgagtgagacaggagaattgcttgaacccagggggcggagattgcagtgagccaagatcgtgtcactgcactccaacctgagcgacagagcgagactccgtctcaaaaaaaaaaaaaaaagtatgaatttaccttaaaaccttaccatgaaataaaaattagggaattagggaaacgtgaattacaggttgttttaacataaattgtgtattttggttttttttttttttttttcgtttaaggaaatgtaatacaggttaagtatcacttatccaaaatgcttgagaccaggagtattttgaatttagggtttttcaaattttggaatattcgcattacattggttgagcattcctaatccaaaaatccaagatctgaattactcccttggagcattatgttagcattcaaaaagtttcagattttgaagtatttcagatttcagattttcagataagggatacttagcctgtaataggaatagatgaagtgatgaaataatctgttggaccagatttacttgacagctaagaaatattttttttgagatggagtctcacactgttgcccgagctagagtgcagtggtgccatttctgctcactgcaagctccacctcctgggttcaagcaaatctcctgcctcagcctcccaagtagctgggattacaggcacccaccaccatgcctggctaatttttttgtatttttagtagaaatggggtttcactatgttggccaggctggtctcgaactcctgacctcatgatccgcccaccttgacctgccaaagtgctgggattacaggcataagccaccgtgcccggccagtaagaaatctttatcatgcatttaaatggctttagacacagtccaacaaaattgctgtggccactctcccatctgtctcttgttctgcaaatgtctcctcagaagggagccagcaagtggaagtatttactccttattacgtccagtgaagccttaaaggaatcaagagtactttcttcttaaggttcttgcaatctattaattagataatgtatgtaaaactcctaacattatactgacgcttcttaatgttagaagtaggagggagaggagttgtaatttttgctttattatgatgactgtggttgttattgttgtggctattatttagattgttttacatttctgatgtttatttccgcctttctagtcttttctccaatcctgtcaaaggaatatgtaatattggagggctgtgtcctaaataccatttacctgtctatgaaagggaggctagaacttggtacatagaaaatatgcaaatctgcccctggccaggcgtgcagctctccgctgagcataaactgctggtagttagggtgtccttcctaagtgacaaacttcgtctgaaaggcaagttcatgcccgttcatgaaaacttatttcctcaaaatttcttcatgaagatagtgaaaatgagatctttaccaacagctcttggcaacttaaaagtttcaaaatcagatgtgaatggaagcctaagagaaggaaagccttcagtctacaacctaatgttttatttcaccaacgctgtgtctgatttctttagatcatattttccgactaaaacagaaaatctccctgcttagattaggattatttggccccttcttagatcaatttgtttcccattcctggttgtgccctttctctaatagcatgcgctttcttacgtatttggatagaaggaatattttttaaataacacatttaaaagtgtaaaattattttatctgcttaaagtgcttgcataagttttataagtcttttaaaatactccatgcaattggttataagaatttagggttagtggccgggcgcagtggctcacgcctgtaatcccagcactttgggaggccgaggcgggtggatcacaaggtcaggagatcgagaccatcccagctaacatggtgaaaccccatctctactaaaaatacaaaaaattagctgggcgtggtggcgggcgcctgtagtcccagctacccaggaggctgaggcgggagaatggtgtgaacctgggaggcggagcttgcagtgagccgacatcccgccactgcattccagcctgggtgacagagccagactgcatctcaaacaaaaaagaatttagggttagtttgcattactactgaggctgacatggtaaatgcatttttatttctgttaatgaaagtgatactattcattttatatggactataaagttttgtcttaggaaaaaacttacgtaattttggattatttaataaaaaaaactctccttactgcctagattcccaattcttttcatttttattatgctccaagcttttatcacttaactttgtttaactagtacctatgcaccctttatcacttaatcttccccttcaattatttcataggtttcagtcttaacttcccaaatgtactataagttccttgatgacagatactgccttatagccggggtatattctacaagagcctcagttgtgctacacatagttgttgatgaagaaaggttatagtcagcatcagtaaacttcatctgtttgtattacattgaatgccttgatgccacatcaaaattaatattagaaatatgcatctgcttcttccccaggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacaggtagtgcttactgaacattgaagaacctaacacatttgcaccccagccagatgccttacatcatctctttttcttaagtttcctggagcaaatgattgatgggctcattgttatgctagagaaggctttaaaggaacattgttacctgctggcttagactccagatttgagccacattcgaattccttttttttttttttgagacagaatcttgctctatcacccaggctgaggtgcagtgactcaatctcagctcactgcaacctccgcctccagggttcaagcaattctgcctcagcttccctagtagctgggattacaggcatgtgctaccacacctggctaatttttgtatttttagtagagacgatgtttctactaaagtttagtttcaccatgttggccaggctggtctcgaactcctgaccttgtgatccgcccgcctcggcctcccaaagtgctgggattacaggcatgagccatgagccactgcgcccagcctgaattccttttttctaaaggggaaaatgttctgcggcttttgcttaatattcttaattagaaactctatgcacctttgactaaatgtctttaaaacaatttgacaagactcactgcaatgaaaattctgcttaaattcactaacagcccactttgtagtttaagaacgtgtaggatttcactgttatcctaggtgtcccaaactaaattttggtttctttctttctaaagaaaactgacaagaaccacacccagttgtttgtattatttactcaacaaccagcttgctggatctatagaaaatgaaatggagtgtcacatagttttccagtgtggaggatcaatgtaatcaaatattagaaactgttttttccaatctttccattatctggactcctctcagtaccacctccttagctcactgaaaccttaaagaagaaaagagtaactggatatgtttgtttttttaattctctacttcacatttttgttcaaatactgattggagcaaatgtctcctttttatgcaatgaattggagagatggactaatcagatagaattaaaacagcagtgttagtaatatgtcctctaagcatgaagagaaggggctactttcatttaaatgaacagtcgtatgataaaagagaagatgatttgttgatgttccagaataagcactctccctgccatcaccatcagctctccgcttgtgttccctgcacacagtacaaagagtacaggaggggctgggtgcagtagctcatgcctgtaatcccagcactttgggaggccaaggcaggaggattgcttgagcccaggagttcgagaccagcctggccaacatagtgggaccctgtctctatgaaaaataaagaattagccaggtgtgttagtggtgtgtgcctgtagtctcagctattcaggaggctgaggtgggaggattgcttgagcctaggaggctgaggctggtgcagtgagccatgattgcaccactgtactccagcctgggcaacagagtgagaccttatctcaaaaaaattaacaaagattgcaggaggcataactgagtgcaatcatcagtaaatttttgttaaatatcttcaatgtctcagcgatatacgtacattttctaatttaattatcacagaaaccttgggtttctaggtattatcaggtgctatatctcaattttacagatgaggaaaccaatgctcaaagaatatacatcatagaagaggtttttttttttttttttttaactgtgtaatagttgacagtgttctggtaaatacttttaacggaaatactccacaaatattgttttaaagtaaattgaatatattttgctcttctacctgcttcatttagttatataataggtttaatttttctataaagattttgtcattatgttatctctactcgctttatgtcttaaaatatcacattttaaaaaattcaacattcattttagatttggggttacgtgttcaagtgtgtcacatggatatattgtgtgatgctgaggtttgggatacgaatggtcctgtcacccaggtactcagcatagtacccaacagatagtttttcaacccttgcccccgtcctttcctccctcttttattcatctttaagtccatgtatacccaatgtttagctcccatttgtaagtgagaatatgtggtatttgattttttgtttttgcattaatttgcttaggataatgacctccagctgtatacatgttgctaaatatcacattttaaattctgatatattttaatgttataaaactatgtgaggtaccatgctactctctctattctctttttctttttgagacagagtcttgctctgttgcccaggctggagtgcagtggcatgatctcagctcactgcaacgtctggttccagggttcaagcaattctccctgcctcagtctcccaagtagctgggattacaggtgcccaccaccacgcccagctaattttttgtatttttagtagagacggggtttcgccacgttgatcaggctggtcttgagctcctgacctcaggcgatccgcctgcctccgcgtctcaaagtgctaggattacaagcgtgagccaccgcgccctaccagtaccatgctacgctcttgccagcattctgtcaggtcccatgagggatttcttttcatatccatgatttgtattcaaatgcctgtagaaattaaaagtgattccattcatttaaccaacatttacagagcagctttcaggggtcaggtactgagaatcacagcctagggacggtgtggatttggggtttttttgtttttgttttttttaaaggatggggatctcgctgtgctgcctgggctgttcttctgggctcatgagatcctcctgcctcagcctcctcagtagctgggactacagggacatgccactgcacccgcgttggattttgtttctccatctactagttttatagtcaggaaatacttcctgaaggggttatgtttcattgtggaccttaaaaaaggaataggctttggattggtgttttgaaagaggatgaaagttattcctggcaaagtgagcatcactagcaaggcaaagaggcagaaagaaactagctgccggtcatttagaggagacatggaaaatagcgtgatttggagttagggtgcctggtagttagaaagcttgggaagtgtgtgtgtgcttgcgtgcgtgtgtgtgtgtgtgtcaagggaacaagccattgaatcacgcttcctcttctcctgcataggcaataggagactaacgtcagagaacattctgtgatgttgatgccatgtgaaaccattcaggcatcattagatcatctatagagttgataaatggaagttgattgtgcagcacccaggatttctagtataagccaaacatccctactggagggtgttcattacatgctaattgaaccaaacagacatttgaacatctgatacaaatccttctaaattactccctttggctctactaatagaagagctaaataagggctttctgggcctcagaaataaattgttaacctaatatagacatgtttatatctttgtttagaaacacaaagaaagtaagtatatatgtgaatcttactggtctatttctttgaccttttttttttctgaacccctattatgtgttggtcactaagctaaggctttctgtttttttatccctatttctcctgacaactccgtaagaggtgaaagcataattggtgacttacatatgatcagtgtgagactcagaggggttaagtaaattgcccaaggttgcctaaatggtaaagaacaaagcccaggtttgaacctagttgtatctgagtgttttgctgtcaccccacctacttttgaggcacgtgatgactcatttgtatagtctttgagaaggggcttgtctttgagactcctctgatcagagagctcttcctcactcctctgacacccttcctctctcttcttttttttttttttttttgagaagaagtttcattcttgttacccaggctggagtgcaatggcgcagtcttggctcactgcaacctctgcctcccagattcaagcgattctcctgccttagcctcccaagtagctgggattacaggcatgcgccactatgcctggctaattttgtatttttagtagagatggaggtttctccatgttggtcaggctggtctcgaactcccgacctcaggtgatctgccggcctcagcctcccaaagtattgggattacaggcgtgagccactgtgctggcccctctgtcttcttgtctctgccttggttcaagctgtcttcatctctcgctctacttctgcagtagtagcctaggatcttctcttctaatgaaagaacttcaggatcaaagacacccccactccccccaccccggtgagattgttctttctcccttactaagtgagcgtggtagtgttcccgtaattgaaatgagaacggcacatcttagtctcagaagttcatcttcaaggtcactgagtagtgagcattggctggagtgagcagggatatgccttggattaaaacggacaagtcatgataagagtgcagcaggggttcttatccctctttcattacatatgaaagagtcagggtaattgtcagtgaaatgtgttaaaactgcatattaatccctgcatattttatagaagtacttaattggattgctgtatttaataaaatactcagaatgttttgctataaaatatttattatgcactttctttaagtaattgtatattattttattccgcattcgtaatgtgtaacaaggtaccctgggtttatatataacttggaatacgtggccgtttcaataatctgatattccagttaagatttgcaaaatttaggtgaaaggaggggtatatctatgcaagggaaattgtaaataaataaaaaaaaattcctcccactctttgaccactttgaaaaacacggttaaaaagaaccagttttctttcttgtccttgtccgagcggtcattgtcctcatctctgcctcctcattctttttcactgaagatagggatttatttaatcataaaacttgtaagttttgctgcctatgtgttaaggcagatttgttaaattactatattttctgtcctagaggtcattaatttttttattattatttttatttatttttttgagacggagtctcgctctgttgccgaggctggagtacagtggcatgatctcggctcactgcaagctccgcctcccgggttcacgccattctcctgcctcagcctcccaagtagatgggactacaggcacccgccaccacgcctggctaattttttttgtatttttagtagagacgagttttaccatgttagccaggatggtctcaatctcctgacctcgtgatccgcccccctcggcctcccagagtgctgggattacaggcatgagccaccgcgcccagccgaggtcattattatttaacatgagttgtaatatctaagctccctttactggttagctattttttacaaacatcacggttggcagtaaatttctggctaatggagttattgtctcttataattggtaattattctaattatatcccttaacagagtccagatccctttctttttggctagaatgagagcctcatggtagaaaattacaggcagacagaccatctgcaacaaagagctatactagtagacattaagacactatgaaaaaattgatcagaagttaaggatgagacacatgaaaacccaaaccgtaaatattatattaggtaatccagaatctgatcattgaagggacatctattcagaatcatctagtctattggtttcctcatgcccaaactggaatctttttttaaaatataagttcctgaactccatcctgagactctggctcagcaaatttggggcatggcccaagactgtgagtctgttttgtcactgggctcatttggaaactgctcatctagtctaacactttaatttcagggtaaaagccctcatctactttctgataagagataagctaatttttattccctctagtgatagagctgggtcttacaagtagttctttctgttttcttcaaagctctcttagaagtttatactttcagtgagccaaaatctccttctttagaatttccactcatcggttctggttttgcctcctctagtcatggaaaatgatatctagttgtttaaatttgtatttctttagttactagagaacatggattcctgtgtacattagctcctaatatcagttggttttgtgttatgtaccttcccaatttttctactggtgtttcgctttttagtgatttataaaaattctatatattaagagtattaaacttttatctcatattgtacatattttcccagtttgtagttggttactcactgattttgtgtgagggtatgtgtgtatgagcatatgtaattctgaatctctattgaacatcttagttctttcacagctttcatgccacccagaaatttgacaggcatgacatttctatgcaaaatcctatattagaaattctaaaattatgctgaaacttccaaaatcatatacttttgtagaaataatggagcatggcaagctctaaaggatattgactgttgaaggaaaattccactccctttgttccaattaatcctctctggtttttattgtaaggtgtactttttctttgagtgtcctgtgtggtcctttttaaaaggaggaaatgtcattatgcttcacattcttaagcttctggcaggcagagactattaatttgtttgcttatttaggactaaagaagcttttgttttttttcttcatttctctcttctttctaacttgcttttgtagcttagtaaccaaaactcagcctcagacttgtctttaaattgttttcaaccaccttctgagttttatctgtccctcttccagggcctcttaaggagaagcaggaggaatgaagtcattgtattgcaaaacctgtggctgagggacactgctccttaaccccaaatgctagtttgatcaggaaaatacctcctcataagccagaaatctagtcctcacaagacaccagacacagtgtcactgtatctaatggaagctctgtgtaggctccagtggaaatctggttacagtttcaaaaagtagctacctgtgcacagcagaagcaaactgtttaagcccaaaagactgcatgaagcctaatgtgttctaattggttggaccaaatataagtatgctgagtaattaccaagctttaactatacaggctcttatttcaggggaggtgatgtttgccacatagttcagccaagtctgccacatttgctgtgttcataaaggagcctgccctgagtacctatgcttcctctttcctttgtacagaccatacagtcaatttaagaagtaggaatggctggccgggcgcggtggctcacgcctgtaatcccagcactttgggaggccaaggcgggcggatcacgaggtcaggagttcgagaccagcctgaccaacatggtgagacccctgtctctactcaaaatacaaaaaaattagccgggtgtcgtggtctgcgcctgtaatcccagctactcaggagactgaggcaggagaatcacttgaacccgggaggcagaagttgcagtgagccaagattgtgccactacactccagcctaggttaccgagtgagactctgtctcaaaaaaaaaaaagtaggaattgctgggccaggcacagtggctcacgcctgtaatctcagcactttgggaggccgaggtgggcggatcaccaggtcaagggttcgagaccagcctggccaacatggtgaaaccccgtctctactgagaatacaaaaattagccaggcatggtggtgtgtgcctgtaatcccagctactcgggaagctgaggcaggagaattgcttgaacctgggaggcagaggttgcaggtagccgagattgcgccaccgcacttcagccttggcaacaaagcagtactccatctcgggggagaaaaaagaagtaggaattgttgcctgggcagtgagaaggatagggtagaaagggaagagtcatcccttctctttctgcccctcttctccttttcctgggcattagtgagttagtgtaacccattacggtatgaaagataatgaggcgggccaggcaatggctcatgcctgtaatcccagcactttgggagatcgaggcagcagatcatttgaggtcaggagtttgagaccagcctggccaacatggtgaaacccgtctctaccgaaaatacaaaaattagtcaggcatggtggcgggcgcctgtaattccagctacttgggaggctgaggcaggagcattgcttgaacctgggaggtggagattgcaatgaaccgagatcaagccaccactgcactccagcatgggcaatagagtgagacgcagtctcaaaaaaaaagaaagaaagatgacgaggcaactttacacctgctgggagtccctggaatagcaagcaatcagtgtacagtcttccttccactgaatcagaaggattcgagctccaaatttcaaaaacaaaaaaaatcctaaacgtatatgccactttctattttctctcagtactcagcctcagtctgtatgtcacagtatataccttataaagtacaacatgctattatctcagtttcttctggattggcctatatggtctttctctttaatatgggggattcaagaggaaagagaaaatttaatgagtaaatagggtactaatctttgagcagtacttaggccatgcaagttggccaatagggaagatgctgttgtctctccttcactgccaaactataaaataaggatacatgaggtagccagaataaattgctggaggacatgattctgtcattgggtaacagtcaataacattaattggtgatgttgatcagcttcctgttgacaggcatggagaaaggctttctgcagaccttccctgctcttactgggaggcacaatgtcaggtgaaagttacagttagtggggaaggaggcagggaagatattttcccatgtgtatctaagggagaaaaaaatatgactctttaaaaatgttgaagttttagttacaataggaccattttaagcctgcctattggtgagcccagactttattatcccggtcaggtcagctttgtggtagggccctttaggagaaacagcaataaatgcttaagcatgtctggcctttatttgtatatctgattagtttaaacctgcacagtttgtagcctaagccatgtatttattgctcatgtgggtcagcctccatcaccatctaatgagttctaattgggttcttctagttgagaaagaggctggccccccaaccccccaaatttttttatgactagtcatagccctggagttgatggccttgactgaacttttcagcggtcattttggtcccaccctgcactgttttcatggtaactctgtgcttttctaggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaaggtaatgctacctgtaccctgccctgatagaagatgcaataaaaaattaggtagccccaaggaagtcaggatatattctgcctttggttcttttctagttacacagtttgtttgatggtttgtttattttatttatttatttatcttttttaaaacagagtctcgctctgttgcccaggctggagtacagtgatctacctgccttggcctcccgaagtgctgggattataggcgtgagccaccgtgcccggcctacacagtttattttttgagagactttatttggatggtaactgaaagaatttattatgataagatgtttattttatctccatagttaatcacacagtaatacatatcaaataccaattttgtgtaaagcattatgttagctactgaaggctatacaaagatgaataagaaaacccttggctgggtgcggtggctcacacttgtaataccagcactttgggaggctgaggcagaaggatcagttgaggtcaggagttcgagaccagcctaggcaacatagcaagaccctgtctccacaaaaaaatgaaaaaattagctggacatggtggtgtgcacatgtagtcccacctactcaggaggctgggacagagaatctcttgagcacaggaggttgaggttccagtgagccatgattgcaccactgcactctagcctgagtgacagagcaagaccctgtctcaaaaaatataaaacaagaatatccgtaagaaatgtttagtggagcaggggacacagataagcaagtgaactagaagacagctacaatgaaatgtgttagagcagcagttctcaaagctggccacaggtccagcaccacctggaagttgttagaattctcaggtcccaccccagaccttctgaatcagaaacactcaaggttgggcccagcaatctagttttaacaagcctctaggtgattctgacagtcactgaagtttgcgaactaggatgtcaaaggtgcaagtgaagtgctgcgggaatgcagaacaaaggaccattcatggcatctggtgagatcagaagggcactagaaaagaggtgtcgagtgagctgggccttgctggactattttggtagtcagaaattctctaaagataaaggaccacattcttgaaaggcataagaagtgcctaagtggccttcctcgaatccatcttctgtactgcccattgaatctgcttttctagtgcactttgatccatcgctcacctgcttaaacatatttcacgtcttaaagtttctctccagctcccattgccttaccacataaaacagagttcttagtatggcagatgtattaggactctttccattgaaaatggtgggaaccgaacttaaactcactgaaacaagtcggaattcattggcccatgtggctgagatattgcaggtcacttgaggaagtgaaggaagtataccaggaaccatgaccgtattccctttttgggacagaattcagcattcctaggactcactctttttctgtttgtatgtcatctctgcttgctcttcttttttcatagtgggctcatttcctgcaaatgcaaagaagccttctctactgagcagataacttaatcgtaggcagcccttgcttagccacaaaaaaaaaaaaaaaaaagtgcacatctttcttaaaatgattgtgccaatcacagggaaagttttttcctggccttgattcagaaaggggcacatcatttgagcaactgttggcctggattgtccaagcctggatcagatacctccttttatagcaaggacagcaaaatctgttaccataagaaaaggggtggaagaacttagtgggtgaaccaaacaaaaatggaagacatcttggtccatcacagcatacacagcctttttcagtctatccacaaccttcattaccaccttttttcccacagatatacttcacacccaccaaagtgcttgcttttccttagatgtcatagtactttcatatcaatactttatttaattttatttgcctggtaaacattttctattatctgcctgttgaatacttaatctcctaacgatttaaaaccaaagataaagttcataatgttcataaatgttctatgaaacattttccagcttccccagcaaaagctagtgcttgttcctgagggttcaaacgggagttcatagccaagtcaccactgttactgattttgtcacattgctgttatatgatagttgtttacatacctttgctactattaatagattttgccataaaagctaagcctatgcatttaaaaaacatttttaatgcctgacacttagcaaagttttcagcatatagtaagtaagcaaggtatttgaataaaatgaataaatgaatgagtgaacaaatgaaaattgatggtgaaattggtgaataatcaagtctgataagagtatggagtttgtgatagaaagtaatcaaacagaaattggaaacataggctaaagccagatagtggcgatcttgaggatcacattaaggagttaattttttttttttttaattttcgattcaggaagtacatgtacaggtttgtcacacaggtacattgcgtgatgccgaggtttggccttctaatgtgccgatcactcaaatagtgaacttagtacccaatagatggattttcaaccctttttcctgctctgtccctccctgcttttgaaatccccagtgtttattgttcccatctttgtgtctatttgtacccagtgtttagctcccatttttaagtgagaacatgtgatatttggttttctgttgctgcattaatttgcttagaataatggcctccagctgcatccatgttgctgccaaggacacgatttcattctttttcttggctgtgtagtattccatggtgtatgtataccacattttccttatccagtcccctattgatgggaacctagccatgtctttgttattgcgaacagtcctgcgatgaacatgcgagcgcatgtgcctttttgatagaacaatttattttcctttgtatatacacccagtaatgggattgctggattgaatggtaattctattttcagttctttgagaaacaggagttaatttttttcttctgtaagcaaaattagctagtatggaggacagagatatgataatttttgtgggaagaagaagaataatagtattaacaggaaaggtgtattgtgaaggtaaaaatctaaaggcaacgatgttagttacaaatctcttcctgtagtctccccttatgattgatgagtagaagctatacattggttggttgtagcaatgccctggttggcacacatttttcagaacatatagtagctgaatacactccagtcagaatagcactgttttaaacagtgtttgcaaaacagtccagaccactcatttgaatttcaccttccaaaagcagaatatagccaaaatctgggaagtgagtgccataatgtatatgcttactaaactgtccattccgatttcatctgtatatctaatttataacaataatagctaacatttattgttgttatgttctagaaactgctctaaatgctttatgaggcttttctcagtttactctcagtagcactccctacaagataggttttcctcattttatagatgaggaaacagcctcagagaggttgagtgattttcctaaagtcatatggctagtagtagacagagttgaaactcaaatgccggaagcttgtcttcaaattcgaaggtcttagtcagtatgctagatacattagtatttgtcacatgtccacagattgtgattttgtggataaagcccctgcccttcatagtctcaagacatcacagggtcagatattgccaatttacagacatattcagttgtcattatgggcactgtatcagcatttcagtgttgttctttttgaagttctgtgcatgtagaactctgcactgcatttcatataatcaaagaagatacaaagatgaagcatatgaaatgggacacctttccaaggtaggagatggcattgtagacaacttcagggtaaatgttgtcacaatgaatagaaaggccactaggagaatactcaggatatgagtcagaatgtaagaaaagaactccatggaacctgcagtcacgtagcattgatttccaggacatagaggtatctgctgagtagttgctcatttatgtctacagctcactcttaaaaatcttaagacagatgttgactcgttctagtaagagttaatcttagctatatttttaaaaatcatgaatgttaccgaatatcttaattgccacaaattcattggtgttattttcagagccgagagtgtattcagagccgacagtgaactaaattgagtagtatttcaggcattgtgtttgatttagattactatagtaaattatttccatccattttggagaaaaacttgtgcatacaacagtgaactttctccgtttactagacttgacattgagatcatttctggtctgcatgtggcaatggtgctgagtaaatctgctctgcatataaaatgtttgcttaactaatgaacttgtgttagtgacttcagttctgcccatctgaagcttctatggtgagatcactcatctaagagaacatgcataacttatccttcaaaaaagactagcactgtcaggtccaccaccttgaggatgtatcggatcatttgtctttagaatgagcatgtgcccacaacagcatttaccacaggcatcagtgctgtctttaggtccctttggaattacatacttttcacaattgaagtcactcacttaaaggtgatgcaaattttgcaatagggataaccatgtgcccacgtaagtttccaattttttcttaagtaatactacactagcttaatgagtgggaaaatccaagataggagaggaaaataaattgtacactccagtgtgttggagccagcaagtgagagtgattcttggcatttcagcataattccatgttcagtgacatcatgttggtagcttgaaactagccatgatgggagtattttactaagaaactggcaaacaagccaggcatggtggtgtgtgccagtagtctcaacaacttgggaggctgaggcaggaggattgcttgagcccagaggtccagcctgggctacatggacccatctctaaaaacaaagaaagaaagaaattggtaaactctgtaagtcagacatctccccctcccccagccccagaaagctggttgttaaacatttatcagcacgctgctagcattgaatttccattagttgactactttaacatcacaatctagataactaaggtacaggcatatttctctaaaacattccttttcaaagaagaaacaattcctttgttttcttggacagtataaggaaacttcagcatgttttcttcttcttgcttttttttctttctttttttcctctttttctgtttttcctctttttcttcttcagtggagaaaagctgctaaaatatctttttttttcacagcctcctttatttacttggagtaagaagtataacttagttaaaatatgtattgcagttatcagattgctcttccaaatattttaaattccaaaatatttatataataggcttagaattttaaattacccaaaagtaggccgggcacggtggctcatgcctgtaatcccagcactttgggaggccaaggcaggcggatcacaaagtcaggagttcaagagcagcctgcccaacatggtgaaacctcatctctactaaaaatacaaaaaattagctgggtgtagtggcgggcacctgtaatcccggctactcgggaggctgaggtaggagaatcgcttgaacccgggaggcagagcttgcagtgagccgaagtcgcgccactgcactccagtccgggcaacagagcaagactctacttcaaaaaaaaagaaaaaaaaaaagaaatggctgtcttctttgattccataccctcctagacacacacacacacacacacacacacacacacacacacacgcctattgtgagtcccttttttttttttaatttagtgtgaatttatactgtggctcatagtatcagttcctagggcattggtgtgacctgactattaactctgttttctacatcactgattggaaaacccctggatgtagcatcaataaaaccaatgtttattattcgggagaagtctgaaattgctgccaaagttttatcatcatttctgcatattattcttatagcttctttcctcctctttcttttcttctttcttccctcctcccccccagtcttctttcttctcttaaaggacaagaactggaagcaatttagaggtaataaattaaaatgcctcagagttcaggtaggcacttaagtgggcaggtgtaagaccatgaggaatggtaggggctccatcagactagagaagggaaaaaacacttgccccaagagcagtgagagtcaagttttggaaaacatttaggtcaaaaacaaacacatctagggagcttctgttagtggcctcattcttcaggtgaagaaattaagtccccaagactcttccgcaattgtagaaccagctatcagaaatttgagaatgacagctagctagtccagccttcttggtattctgccactggtctgcctttattctccctcttatccaaccctattgttattccttgagtacttgttgaaggcctgctctatccaaaccactatttaaatttctgagatttcaaaagggaatgggacctatttttgccctggaggaactctgggtttcgtggaggaaactggcacctgaagagatcatgacaatgcatttggtaagagatttaagagagggatgaaagttgcttcactaactttgccttgggagttgggaattttttctggagaaagtcaaacttaaagagctgttaaaggatgagtaggtgtttaaatgtccctctcagtctttagttcatcattctatcattaggtcatcaccaacgttcttaaatactgtagtcatattaaaaatgtgaattcataaagccctaaaaagtcactttcctgagttactatagtttcttgaccgtccacttacgagacaggcttataaaattgccaccttaagataaaggtgcagtctgctttgtgaaggcctccccagaatttgtcattacacattttaaaacatattcttttttctcaatgcattttatgcctgtgtatgctggttaaagaagaaaagcaatttgtaatgcatttctcctacaaatggcataaacttcactttttcccacctgtcatcgtatagtaaatgtgttttgaatgtataatatccttttatatattaaattttattacttaaaattatttaaattcttaaaagaaattttcattgtctcttacactggaaatctagctggagtggggagttgtcagaggaagcaaaccatacctttggaaagaaaggctataactatcagtcttgtttctaattagtcacagagttaagggcaagttgttttggaatatcaatatgagctactctctggaaaatgaatgtctccatgtacatttttaatgcattcagttacaactgtcttctccagcacatacacaccaaaaaaaccacataccaaatataatttttaatgcgtatcttggtaccaaactttagaaatttactgcatctacattttcatgattatgcattttcttttctttctttttgtattatttatttgtttattttttgagacagagtcttgctctgtcaccctggctggagtgcagtggcatgatctcaggtcactgcaacctctgcctgccaggttcaagcaattctcctgtctcagcctcccgagtagctgggactacaggtgcacggcacctcgcccagctggttttcatatttttagtagagacggggtttcaccatattggccaggctggtctcaaactcctgacctcatgatctgcctgcctggcctcccaaagtgctgggactacaggtgtgagccagcgtgcctggcctgtatgcattttcattctagttacctttgctcatccatatcttattctgaatactcatgacttatttgatctagccttgtgcatagtcccagataattaagaagataattaaatcagggtctaattttcttgactatcaaatagctatttttcttttttgtaagatgtagaccccaaaagaggccagaacttactattgaaaatcagaatctaaatgcatttacttctggagaagaatttaccataaaactagaagagtaatgctagatgagatagtgcaaacaaaatggaaacttgatgaaagtatctagatagttcaccccagagattggctttcccaaaaatagaaagacaactgaatcatcaacttcagcctcagttatttggctaattatttaaactctttatgtttcatgtgtaaacataagcaatatgaagttaataaataatggaattggcaatatttctaatgttatactatcataaccagtcataaccatattttctgttggttactttagatatacaaacaagtacatggtttaattaattaaattactttgtaaattttttttttttctttttttgagacagactctcattctgtcaccaggctggagtgcagtggcacaatcttggctcactgcaacctccgcttcccaggttcaagtaattctcctgcctcagcctcctgagtagctgggactacaggtgcgcaccaccacgcccagctaattttttgtatttttagtagagacggggtttcaccatgttggccaggatagtctcaatcttctgatctcgtgatctgcctgccttggcctcccaaggtgctgggattacaggagccaccccgcctggccagctttttctttaagtaaatttaaaaggtggaagtggtatttaaatgggtaaataagatcctgatttttaaaaatgattgttttatgaactaagcttcagggttttaggccattattttgaaatctctcaacagttcttaagttgttaaagcaaacaaataaaatcaaaacaaatatggctatgcttgcctggtcacccatgttcttcctgaacccagtgtttttaagagtacatgtctcactgagatgctgaagcagcccatctacaaccagttgaccaccttacaaaggtccctgttcttcagactatcattttccactgtcctattcatatctttaccagattggtccagattaaaagttgtactttacagaaattatgtaacacttctctttgctaaagagactctttattcttatcaatcagtgcataaatattgactgcctgaaaatacatgaataggaacaatacagaggaataaaaatcaggaaaggaaacaaaagattaatttttactcattatatcaagtggactctttttgctgggctttcttaatcggttagcttatgagttgagtcttgggcagaaaaaagaattcacaagaatgtctttctcagatacttttaataccatcttcatgtttaaagaaaaatatctgtgtatagctcaaattggtgttttatgaactgtattttgtgacacaaggtcttattccaaaaaatttaagactatcatcataatcaaaatgactgctaaaattttttttattcattattataaaaagtgagtgggctgatacatcaggataaagcaactgatgattttgtcactattgtgtggttaaaatctgtgcctatcttggaggtatggattgagcatcatattattctactctaggtcttaaacatctttcttattcctggtctgacattccaaacatctcctttacatgtcaagaatgcttattcaagttgcaatagctcttaggtatatttttaaaattatagtttgctgtttataattaattttaaatggaatttgggattctgtcctacctaacatattctagctaattgagaggaaattaatgtagcctaccagccagatgattactggctgaattaactattcagaatgcttttggaaaacctgaaaatgcaggaaagcagagctaaaggatttttttttttttttagatgcagtctcactctgttgcctaggctggagtgcagtggcactatctcggctcactgcaacctctgcctcccaggttcaagtgattctcctgcctcagcctcccaagtagctgggattacaggcatgcgctactacacccagctaatttttttatttttaatagagacagggtttcaccatgttggccaggcggtcttgaactcctgacctcaggtgatctgcccacctcggtctcccaaagtgctgggattacaggcatgagccaccgtgcctggccagagctaaaggatttttaaggatagattttctcctctaccaccttctagtttcttggtgtggaacagatgacaacatagcttttttccattaatttttcttatccccgtaggaccaagatgtgtaggttgtagggccttgttctacctcccaatgttctctatttgcagaatgaacagctgactttggctgatgtttgctgataccttcaggaaataatgttgacttcagaataacagacaagccttcttttggcatcgagtttttcttcctctgccagttcaaatgaggctccccttttgttgtgtgcaaccacaagctgactgtactgcttctcttagttaatcacagacaaggcccaactgtttgatatgtatcaggtgggagttaaacaaaagcccaagcctaaatctcaaataacaagaggaagaaggatgcttccatgtcagccgatgtctcatcaagtacctacttagtcttggaatagactctaactttgcctaccaagtgtttatctgactggtaccacttagagtcttaccatataatttacattacacagtattaggaagtctatacttgttggtgatgcgtgcataattttttaaaaccattgaggtgatcactatctcagagtgctgattagaacttcaagactggtcccaggccaggtacagtggtttacgcctgtaatcccagcactttgggaggctgaggcaggcggatcacctgaggtcaggagttcgagagtagcctggccaacatggtgaaaccctgtctctactaaaaatacaaaaattagctgggcgcagtggcacacacttgtgatcccagctactcaggaggctgaggaaggagaacccgttgaacttgggcagcggaggttgcagtgagccaagatttcgccactgcactccagcctgggcaacacagtgagactccatctcaaaaaaaataaaataaaataaaagactggtcccacagccaccaggccttgtatacaatacatgcacataaactgtgtgttagttaaaaaaccatacccattatcaagtagcaatagtcccatttaaaaaacaaaattttggctggtcacggtggctcacgtctgtaatcccagcactttgcagaaggattgctagaaaccaggagtttgaaaccagcctgggcaatgccatgagaccctgtctctacaaaaaataaatccactgagcatggtgacatgcgcctgtagtcccagctactcaggaggctgaggtgggaagatcccttgagccgaggaggttaaggctgcagtgagctgtgattgtgccaccacactccagcctgggcaacagagtgagactctatctcaaaaaaaaaaaataagaaaaaataaataaaaaataaagaaatttctgggccaggcacaggggcttacacctgtaatcccagcactttgggggccaggctggaggatcacatgaggcgaagagttcaagaccagcctgggcaacatagactctgtctgtacaaaaaataaattagctgggctcggcagtgcatgcctatagtcgcacctactcagatggctgagataggtgcactgcttgagcctggaaggttgaggctgcagtgaggtatgatcatgccactgcactacagcctggacgatagagtgagactatctcaaaaaaacaaaacaaaacaaaaaaaaatttctgcctcctaaagttatttattttgtatggtggtgaagtgtcttgaaaagatgcactcagacgttattgttcccggccattctcatgtcctggaaactaactgtagccttttactttaaccatctccttcagctcattgtttccccaggccagctgaccacacactgtacactaagcttggatgttctgtgttgtaacaaacttcctttcagcactggtcaattaagcatatttgacagcacccctgcacatagccacagacaaactactttatatcctaccttatgtggaagagcctgtaacaatcctgttagagcagttaattctgattttaaatgagaatcacaggtcagaatttcccagaatgaaattctagggtaccctaatttcaggaattttgtgaaaattacagatcatgctatttataagttgcctaccataatgtctagtgcaaacactaaattgcagctgtttttttccatttgtcactgtccattctttggtttaccatatgaatctaagatttactcacactgtcattaatctcaaccattaacataccattctttcttttaattctatcaaggtccagggtgttgtgttttcttttctctttttcattgtgacactcaggaatgtgtgagataagaggtcctagagggagtgaaaagtcacagatttgctttctgataaaacacctgaatccccctaaatatgtgaagctccgtgaccatttcagagacacacagaggtccagattctatttcttcccccattacaagtcacattgctagagagattcttcccgatatcaagcactggccacaagtcaaactggcgtcttcccatttgggaccagtggaggtgaagaactccaaataattcctgcctttatgtgaagagtaatttgtctccttcctcactctacttctcctaaggccctggccccttgccttcaacccctaaggacctgtttttaaatttcagtatataacagtatgcagttttagttttcttaaaggtctgcagatatttactcagacttaggcttgattataccagaggaaataaacccatcgtttaatcaaatgcaaacgacaggcactaaattacacgtttttaatatattctattggtaactttaataagcactatttattaagtaactaccatgtttgtatgctcattctcttttaattttcgataaggtaattgtttcagtatatttcacttacagttttgagatatttttctattgagccaccattgggtaatgtatgggaaaccaatcaataaatagttcttatgattcaagagatacgttgtaaaaaagatcaattctgcctaaaggtagccatgttaattttctgattcccacaagcttaagtactagctgttaaaaaaaaatattttaagatggatgtatcattttctatagttattggttattttcggaatggtgcaataacaaattactttctgtctaatgacttctattcatggatgcagtggtataaaataatctacccttatcattcatatttctgtgtagttgagtaaggtgggaactatttttgatatgcaggagcaaatactaaagcaatggggttccatgcactttctgtcagcaaaagtatcaactgccagaaacccctgataagtcccatttcaagcaagtagagtctggataataccaaacagcaagacaacagttagtacttgtgaactggcagtactgccaacttgacttaccattctaacccgaaataaacaccccggagttaaacaaagctaagtcatccatctgcaaggtatgtagtgggcttagccaggaagaaagactttttgatttgtcaaagcaattttaaactactgccatttatcctggccagaggttgaaaaggccaaagggaagcttttaaacatatgataacatcatgtagttggggacatatggtatttgcagactgaatgaatgctagctgggatttgctctgttctgggccaccctgggtgtagaataaagaacagccctcttttcctgactttaccactaatttgctgtcaccaggaaaagtaacggaaacttttggcttctagtttttcatgtataaaataaggagactggaaaagatgctttttcagtttctgtcaagcttctgaatccccatgattcttaaagggctcacaaagtagatagaggatcttggttgaaatgatcattctttgaaaaaagctaagtaaaaaattgttttatttccagcttatgaacccattcatttttttttaaatgaacaaactgtccgagtttttcaggtacagtaaaaattaataaggaagtagaagggtcaaatgagaatcagtcacagaagagattttgttaaaaaattcattgtatcaattcagcaaccattaaattgttagtatattcttagttttaggtatgttatctcctcaactgtcacgttgaatcatgaaattgccatttttgagggttaaaacagtcgggttttgtcagtttccagagttcaacctatagatatgatctctgtgaaagcaaggtataatattgtgcatcttcctctcattccctttagttcttttttttttttttttttttgagacggtgtctagctttgtcacccgggctggagtgcagtggcacgatctcggctcactgcaagctccaccttccgagttcacaccattctcctgcctcagcttcccgagtagctgggaatacaggcgcccaccaccatgcctggctaattttgtttggtacttttagtagagacgggttttcaccatgttagccagatggtcttgatctcctgacctcatgatccgcctgcctcggcctcccaaagtgctggaattacaggtgtaagccaccacacccagccacctttagttcttgatgtaatgcttaggcacctttgtttctttgacaaatatgcactgaaagcagtattttgaggcagaaggccttttggaaatcacttatattatattactttattttgttaattttttagacagggtcttactctgtcacccaggctggagtgtagtaatgctcactgcagcctcaacctccaggctcaagcaatcttcttcctcagtctcccaggtagctgggactacaggcacatgccaccatgcctagctaattttttgtattttttcatagagacagggtttagccatgttgcccaggctggtcttaaactcctgggctcaagcagtcctcctgccttagcctcccagaatgctgggattacaggcatgagccacagcttctggcctatattattttaaagatgaagaaagtaaggctcaaaaatgtctcaaagttgcagttctttttgatgttcagaatgacactaacacattataaagaaaaagtcctgaacatattctggatattctacctaccagtaaaagaaactgatctgggccaggcgtggtagctcacgcctgtaatcccagcactttgggaggccaaggcgggcggttcacaaggtcaagagatagagaccatcctggccaaccaacatggtgaaaccccgtctctactaaaaatacaaaaattagctgggcatagtgacgcacgcctgtagtcccagctactcgggaggctgaggcaggagaatcgcttgaacccgggaggtggaggttacagtgagccgagatcgcgccactgcactccagccctggtgacagagtgagactccgtctcaaaaaaaaaaaaaaaaaaaaaaaagaaactgatctgatacattttataggcacagttcttagcaattaaagttgggaatagaggtgattctcaagttcttaaaacctgaaggccctattttttgtcattcttgttgactgaggtattgacatttttggaaaaaaaaatatttttttaagtagttaatgctagtaagaaaaacttaatctaaaggaaggtagtaacaataataccagactatacacatgatctgaatctgcactgtaatccccaaatgcattactttcctgtatttgataagtttcatttctctatcagtaaacaacttccaattataggtttagttactgtttatagaaaggtgtcatgacttagcaatattagaaatagactaagtgtaaagatatttataggtcatacttttgactgaagccttacacactgcaaactctcatgttttctgtaacatctctctgccattttaatgataaaataatcgcattttagagcatctgatttaatatttgtcaataacagtttatactgaaatttagaaaaccacaaagaatgtagtccaacacactgtctttacaagtgaggaaactgaggcccagagcaactttaagttacttaaagttaaaacatggggcaaattgggacttggcatccagtatattataatgtctaatgtgccatttgctcttgttctagttgcaaaaacatttgcctcatatccacactcaaaatggagtgaagattaagtaaataatgttttgatcatggtacttggagtgaagtagaagacttatgacacaattacgtgttgtttggaaatatttagaaagtatgttcatagttgatctattaagcagtcaatgatttgttgactgggcaagtctgccacacttttacaaatttgccagtttccaaacacctggaagaagcatcaagtaaaacttcaaaacaaagacctgttggatacacagcctagacttacttttttgttttttgttttttctgatagaaacatgagttctgctggcgctgatgggagaaaagcgatgagaagatgtgacggactcattgactcactggtccattatgtcagaggaaccattgcagattaccagccagatgacaaggtaattcaagagataaatatcctgttttgtcttactaagatgcttcagaatattcttaagatagccgcttggttttaggtttattcactgattcatttactgagcctaagatcttccattcatccttagaaatattaaaacctaggccaggcatggtggctcacgcctgtaatcccagcactttgggaggctgaggcaggcagatcacgaggtcaggagattgagaccatcctggataacatggtgaaaccccgtctctactaaaaatacaaaaaatatagccgggcgtggtggcgggcacctgtagttccagctactcaggaggctgaggcaggagaatggcatgaaccccagagcttgcagtgagcagagattgcgccactgcactccagcgtgggcgacagagcaagactctgtctcaaaaaaaaaaaaaagaaatattaaaacctattgccttatttttctattttccaggctccaatgtctgtctgtctaaccacactatgtggatatttgaaaggagcccaaatgctacatggtcagcaatgaattttaatgtatctcttttttcattcccaaacttgttccttctttttataatcctttttttttttttttttttggaggcagagtctagcttcatcacccagcccaggctggagtgcagtggtgcgatctcagctcactgcaaccactgcctcctgggttcaagcaattctcctgcctcagcttcccaaataactgggattacaggtgtgcgccaccatgcccagctaattttttttgtatttttagtagagacagggttttgccatgttggccagcctggtcttgaactcctgacctcaggtgatccatcacctcagcctcccaaagtgctgggattacaggcgtgagccacagcacctggactataatccttcttaataatcatcaccatccaccaaaagaagatggaaatctgagtaattgtgtgctgtctacctctgaaaaggctttcagttcttacacttccctctaatgcttctaatgttttcctacattgtgcatctttcatgccgattattgcaatagcctcctagttggtccctataaacagtatctcctccccttctccagctcaacatggctagtaagttacgtatctaagctatacagttgttctggacacactctttagaaagtaaactaaaaagactcagcctctacttcttagcattgtactcctgactgttcatgaaaaccttagcttttctagccatactcattgcatttcccccaggcaacccgcagtttaagcacacccagttgcatctggtaaaccttgtaagagctaaagcctgtgtcctgtgatatcacacctgcaaggatatctatatgtatacgatcaatattcttgtcctgttttctcaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagaggtatattgggaagtttttgaaagaatgagaaagggagagaatgagagagagtgtgtgtttgtgtatatgtgtatgtctaagtacttggtatatatcggcactattttaagttattttaattcttacatcaaccttttgaagtgtgtattattaataccctcatttaccagtgaggaaacagagacacagtaagattaattttcctggaataattcagcaaataagtggaagagattgaatacaatgccaggcagtctggctccagattttcattgctacccatgaaccgtactgctttatgccttataggttaggaaataagcttaatgcagcatagctaattgtatataaattgtttttattaaagtcggccctgatatttggccttgggtattctaaaaacaaactttggacatactaaaagcaaacctcataggaaggaatacatatttatttccatactgatatgaaaactaagagaatgtaacctcccctccttctctgagtatcgtggtatttgtggaaaccagctggtaaatttagaaccctggtgctatcctggacactttcacaagactctgagggaacaggcctgtttttcttatctacagggtggttgtgactaatttagcttttagctcaacagcagcctgaaaaccattctagaatgacctatgcttaattctctgaattttctctcactgggagaaatatcaagttaggggtgtggagtgttattaggaagaaataatcattatgggctaaaagttaagtgattagaaattatatatatttgcttttaaaatttctatttcaagggcttcttatgcaaattatgagcctttctagacagtatttctggtctcctggtttgagtgtgaaattatagccatcacctgacatgcattaattctggattccttttgtgtgtggtcagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccagtgagtattgggcctgatttcctactttttaaaataatgatattatagacatacctacattcaattcagagatgaaacagtgagggaagagaaaaaggtttcttattttagtaaagacaattctcagaaattacagagggcttcggtctcagcttatgcaaagtcaagtcaggctgcttgactgacaagtcaagtcagtactctttcagttacagatctcagaatcctgcctcaagctggtttaagcaaaaaagaggaaatttttggcttatggcactgaaaactccagggtgggccttctttctgtcgtgactggacttaggtgcaccagtgattacagttgactttcttcatctccgggcttggttttcctctgctgggtttgttctcaaaggctctctccatagggtaacaaagacagccatgaattatttcaggctcacgttttatcagcccaatgtgtcccccacaagaaacaaactaccattttcccaatagtgttgttaagaagttggagaatatgtctcacgggctggcttgggcctcttgcccatttctgaaccaatacctgtgtctatgaggctatgatgttctaattggccaagtctggatcatatgcccagatgtgcacttccagggcatgggtttgattggatgagggccactgccacttgtaccacatgggctgaaatggtaaaggagtgctccctaatggaaaatgagactgttactaccaaaggaaggaggaataaatgctgggaaggcaaaaacaacagcagatgtctactgcagtatggagttggaaaggccatctgtgcttttgtgtcccagaaattcaactacaaaataaagagctgatcctctttccagatgcacttactttatagcagcaaagtcaaaataattaaaatagtaaaaggttattcccttccccatgtattttatacccttcctatatattaaggtattctgtaagtatttaatgatttaaactaagcttgtattctttgccttggtcatgaaacgattagaataaactccccccaaatagctcattgtctgtctagtctccaattatctctgtagagaaaagtactattgtaagtagcaaaaaatatttatgttttacttgagaaaccatatttattctttaatatgtgtgtttacacagaagcttgttctctgaataaaattgtgaaatgctaaaaccaatatttctcttaccttagcattgtggttaagaatgcaaccaaactttcatctgtttggctttctgcaaaatgtacattgagaaagaaactgggaactaccagggagcccttaatgacacagggacactaatgaatcacgttattccccattttcctatgctaggtttcccaaaaccatttctcttactttgctaaactatagaagccctctttttaattcccagctaacataaaagaaaattaaatgggggaggggttgtgtgtgcgtgtgtgtgtgtgtgtaagcttgctgtggtctgagtctagttcaatataagctaaccctttaagcttggattttagcctcttccattccaagagcctcccacagaatccagaccaggggtgctttcatttttctgaggatacagggatatttatgccacttaatctctcaatattagtgtattacctagttcctacattcatttgctgaacaaacattcttttgagcatattacataacagacactagcagttatggtgtaggttacacagcagtaaataagacaaatccctgtgttgggtaatagtcttactgggatgaaaaacagaaatttaaagtactaggaaaaatttaaggtaccaggtccataaagggcccaagtcatacctaaggggcctaataggccatccctaaagggaagcttacactaaactgatactgattcatacccaaggttgttagaattggacttgattggagatttataagagaaaatcattagcagcatgggacaaatatgaagcccctttattttattttattttattttattttattttattgtattgtattgtattgtattgtattgtatttattttgaggcggaatctcactctgttgcccaggctggaatccagtggcacaatcttggctcactgcaacttctgcctcccgggttcaagcaattctcctgcctcagcctcccaagtagctgggattacaggtgcccgccaccacgcccagctaatttttgtatttttagtagagatgaggtttcaccatgttggccaggctggtctcaaactcctcacctcaggtgatccaccagcctcagcctcccagagtgctgggattataggtgtgagccaccgcactcagcctccctttattcttttaagttacgggatgctttttaaaattttgacatatgtgtttttttaataatacttttcctacttttgtatgcttagatgctgtgataaagatctctggctttataatttcaaacaaggaatcattgaataggaaaacatgaaaattaggtcatacacatagtaccagaaaatatcaagtccattggccatgtgatcgtaactgagatagcactgagcaattaatgaccgtgtaccttacgtggcaaagaacccaagctgaaataaataggttcctaaaagacagattatataatttacatacagaattatgacagaatttctagttagtaaaagtatgttagtctaagctttattagttcagttataatggtcactctagtagcaaaaggatggaataataaaatttacttatttagcaagcttttaaatataatataaattaaaagattaaacattgtatagtaaaagttaaaagtcattgaaataaagtttcgggtttttttgggttttttttgtttttgagacagagtctcattctgttgcccaggctggagtgcagtggcacagtctcggctcactgcaacctctgtctcctgggttcaaataattctcgtgcctcagcctcttgagtagttgggattacaggcatgtgccaccactcccaactaatttctgtatttatagtagagacgggtttcaccatgtcagccaggctggtctcgaactcctgacttcaagtgatctgcccacttcagtctcccaaagtgctggggacaggcgtgagccactgcacccagcctgaaataaacagttttaaaagccctttatttaatatcgatcggaaaaaaatgaaacatattccctcagcggcccccaacctttttggcaccagggactggtttcatggaagacagttttttcacagactaggctggggagagatagtttcaggatgaaactgttccatcttagatcaattagattcttataaggagcacacagcctagatccctcatgtgcggttcacaatagggtttgcgccctcatgagaatctaatgtcactgcggatctgacaggaagtggagctcaagcactaataatactcgctcactgctcactttctgctgtgcggcgggttcctaacagtccacggactggtactgtgacccgggggttgggatcttccccactaccgcataccttacccaaaaataaataccaacaggaatgaaacctaaatatgaaaggtaaaacaataaagatgctaaacaattacatggaagaatatcttcatgacctgaaacagggaaagacttcattaaaatggacacaaaaaagactagccttaaagtaaatatttgataaattgactaaattaataacttatgctatcaaaagacatgttaagacattaaaaaggcaaaccacagaatgggaaaagatttttgcaacatgtataagtaacaaacgtgggtatccagaaaatatagaagagttgaggtaacaatacataaacaagacatggacagcccagtagaaaaataaatggacaagagacttaatagacgaaagataacattgaaatagctaacagttataaattctttcccatggccaatgtccagaatggtgtttcgtaggttttcttctaggagtcttacattttgaggtcttaacgtttaaatcttaaatccatcttgaattaatttttatacatagtgaaaggtagaagttcagttttgttctgcatatgactagccagttatcccagcaccatttattgaatagggagtcctttccccattgcttatttttgtcaactttgtcaaagaccagatggctgtaggtgtggagcttcattgctgggttgtctattctgggacctaattaagctaaagagcttctgcacagcaaaataaactatcaacagagtaaacagacaacctacagaatgggagaaaatgttcacaaagtatgtatctggtaaaggtttaaatccagaatctgtaaggaacttaaaaaattcagcaagcaaaaactaaataaccccatttaaaaagggagccaaagacatgaacagacatttctcaaaaaaagacattaccagtggccaacaaacatgaaaaaacgctcatcatcactaatcatcattaattatcaatcaaaactacagtgagatgccatctcataccacttagaatggctactattaaaaagtcaaaaaacaacagatgctggtgaggctttggagagaagggaacacttacatactattggtgggaatataaattagttcagccactgtggaaggcagtttggaggtttctcagagaacttaaaacagagctaccattccacccagcaatcccattactgagtagatatccaaaggaaaataaattattctaccaagaagacacgtgcactcatatgttcatcaccatgctattcacaatagcaaagtcatggaatccaccagggtgcccatccgtggtggattggataaagaaaatgtggtacatatgcaccctgcaatgatatgcagccatgaaaaaagagtaaaatcatgtcctttgcagcaacatggatgcatctggaagccattatcctaagtgaattaatgcaggtacagaaaaacaaataccacatattctcccacttatacgtgggagttaaaccatggttactcatggacataaagatggcaacagtagacactggggactacaagaagagggagagaaggagggggaaagggatgaaaaactaactattatgtactatgcttactacctgggtgacgggattattcatatcacaaaccttagcatcacacagtatacccgtgtcacaaacctgcacatccaccctctgaatctaaaagttgaaattttttttaaaggccaataaacatttgaaaacatttttcaacctcattaatgatcaaggcaatatgaattagaagtgttatttgcaaacagttgaccagagaattaacagtcattctcacatacttacaaaagctagaatacagaatctctatttggtagcactcattgcttattttccttatggagcaaattctaaaggtcatcctacttcaggcattctcatttccctcagcaaatcggaattagtgaaattttgccatgctgtccccaagctgagcaaacagcatttaaggaatcagacctcatctagagtcacatgttttcaatgattgttcttacaaattaacatgaaaacattaatgctctttattatatctcagcatatatcattaaatagtatagtatgatgtatctataaagcgagattttagttctcaagaaattctcatgttttaaaagaaaacaaaaattttaagaaatattttgtgactttatttgattccccatcttgttttcaagtaccttctgagatgataaatcttcagggaaacttgatagcatattatttgtacaattcaggtcagtaaacatttgtataggacctatcatgtggaaggtaccatacaaggcactgaggtggagaaaagatggataagatatgttctttcaagaggctaatgaatggtctagtaggagagataggcagtttaggagagttgtaaaatagagaattagggagtagtggtaaggaaggaaatgaaagaaaatgtcaggctacagaggactgtatgagccatactaagatgtttgaacatcattcggaaggcgatgaagagtcatgaaagggtttaaatctgaggtgtggaacataatcagattaaattttacaagggtgattctggtgtaaggctttgaaacccccactggtgtttaagagacaacaagtttactagcaacattgagttccttgtagagattggaggccataatttgcagattggttcttctgcaaatgcattgttcgccctagcaatatttggtagacaagtataaaatcagaaaagaaaaaagttaaatgaaccgtatattgcagttttgatgggtgagagaaaaataaaccagactgacaagattgttgagattattggaatttttttttttttaagacagagtctcactctgtcgcctagggtggagtccagtggcacgatctcagctcactgcaacctccgcctcctgggttcaagtgattctcctacctcagcctcccaagtagctgagattacaggcgccaaccaccatgctcagctaattttttgtacttttagtagagacggggtttcaccatgttggccaggctggtctcgaactcctgacctcaggtgatctgccttcctctgcctcccaaagtgctgggattacaggcttgagccatagtgcccagcctggaaagataatatttaatgtgatggttcatgcaccatagtctaaataagaaatttaagacaggagagaattgataacttgaggtgtaaggaatgaaggttaggtaaaggaactaaagttcttgatgaggctgaagagaaacatggtaggagggagggagggagagcagggagaacgggaaactatgttcagagcctgacattgctgagtttatgttttcagaggcaacatgtctctgagtgaacacaggctctgtgtgaccatggaagtgagtggctgatgtatggaagagatgaaagtcagggactgtggggaagtctaggaactgtgaggtaatcattttgatgaggtatatgaataggaggtggagaaggctgtgaactgggctccaaagcctccagcaaatgttgaggaaagaataataggccttgtgatagcaaagaaaatgctgtggggggtgatagagctggacggtggtgactcagaagagcaggacttatgcatttgagggaaaacggaatagtgtagaagcgcaactgggaagacagagagtgccaaacgtccctcctggcccaggatacaggagtggtgtccagtagtctcctccttggatggctacaggggaaggattcttctcagaggagagcaaatagtctaacagaatgttctgcaaattaatgaaagacaaattttaatttgtttataatagaacaaacattagaaaatagtaattaaattcctttgagtcatggacactttgagagtctaataaaagttatgttttaataactaataaacagagtattgcaattgtatctaacaattacatgttttcttcctccttattttttttttttcccaagatgaggtcttgctttgtcacccaggctggagtgcagtggtataatcatggctcactgcagccttgaccaccagggttcaagtgattctctcccacctcagcctcccaaaaagctagaaccacaggcacataccacaacacccagctaaatttttttatcatttgtagagacagggtctcactatgttgcccagctggtctcaaactcctggcctcaagcaatcctcctgcctcagcctcccaaagtgctggaattacaggcatgagccaccaggcccagcttcttcctactatttttaatattgaaaaaaagatactgactaaattataaaaacaataagacatgacagttatttgtttcattatatattaagcaggctcagtttaaagtaagttgattagcattaaagtcatatctgaaggcccaaaatgaacttgaaatgattctacttcccaatgtttatacattttctcccactgatctgataatcctgttcctaaaatccagacatccatatgagagttcacaagaggtccttatggcttagtccatttgtttggttgtttgggggttttgttttgcttagttttttgctttggttttgtttacatttttgttttatgtttgtttgtttggtcactattgggctaatactgaccattatttagatttataaccttcaatcttgtgatgaattggttttgaaaactgcaggctacaattttttatttctctagtaagctcctggaagtcaagatattttatattttcaaaaataaaattctctccttcagactgactgtgcccacgatagtttacagctacaaccaggaataacaaatgcaaggactgcgatcaagttaacatggatttgactgaatatacatccaaacttataagtgggttacagaaagtcaattggcaagtcatttgtatggaaatagtgatgagttttcccatttaaaagttaataatggccaggcacggtggctcacgcctgtaatcccaacactttgggaggccgaggcaggtggatcacttgaggtcaggagttcaagaccagcctggctaacatggtgaaaccccgtctctactaaaaatacaaaaaattagccaggcatggtggtgggcgcctgtagtcccagctactcaggagactgaggcaggagaattgcttgaacccaggaggcagaggttgcagtgagccaagatcatgccactgcactccagcctgggcgacagagcgagactctgtctcaaaaaagaaaaaaagaaatgagtaaattaattagtgtgtgtaaattgccaaaacttgaacaagaagaaacagaaaagatgactaatcatcaaccagtaaataaactgaaataatgaaagacatctccctttaagattttttctcagctcagttagctttctgggtgaacacagattccatgttaccgtggaagtgagtggcagatatacagcaatgtaggttgagcatccctaatccaaattttcaaaatctgaaatgctccgaaatccaaaacctttttagcaccagcatgacaccatgcgttgaaaatgttatacttgaccttatgtgacgagtcacagtcaaaacgcaggcacacaatacacagtttactcagcatcctcaagcagaaaaaaaaaaaaaaaaaaaccctcccagctcccttcagctgccatatatcttttccacatacacccagtttcccccacgcaagcaagcacacacacaaaggatagtaaaatggcatatgtgcaggccaggcatgctgatggcaggtttcccacaatgccccacatggagccaagacctgcatgcatgactcaactgtgtttggttgcttactctctttgctgtgtggtgtaaagatattgttgaaaatgacaaaatggcctgcagatacccctcagggtaactgataaaaagaggaagcatttatgtttacctctagcacagaaagccaagctgttggagaaactggacaggagtatatgaaacatccatatatgacctgaagaaacagaaggatacaccgctgaagttctgtgctgaaactgattcacagaagttagtgaagattagaaaactgcataaagccaaacatgaagattttgatcatgtattgaaagtgcggatctgtccacgtcacagtgaacacatggcacatagtggtatgctgaccatgaaacaaaggtcaatgatgaactgaaaattaaaaggaactgtgaataatcaatagtctggttgcagaaatttaagaaaagacacagcattacatttttaaagatttgtgatgataaagcatctgctgatcacaaagcagtgaagaaattcattgagtttgccagagtcatggctaatgaaaatctgaagccaaaacaagtctataatgctgatgaaacatcactgttttggcatcattgcctcagaaagacactgactacagctgatgagacagcacctactagaattaaggctgccaagaacagaatatgctgggatatgctaatgcatcaggcatacataagtggggtgatagataaaaacttgtgtcctcactgttttcaaggagtgaatttcttaccagtctgttattatgctaacaaaaagacctggagcaccagggacatcttttttgattggtttcacaaacatttggtaccaagtggctcatgcttgctgcagggagactcaattggatgatgactgcaaagattttgttattacatgacaactgttctgctcatctcccagctgaaattctcatttaaaaaatgtttattctatgtactttcccctaaatgtgacttcatcaatttagccatgtgaccagagtatccttagatcaataaagagtagattaaaaaaacacttttcttaaatagcatgctagctaccagcagtgtgcagaggtgtgggtgtgagaaagtgttcaaaaggagtttagcctgaggatgctctatatgctgttgccattgcttgaaacaggtgtgcatgactggcacaactctggcctacaactatgtcgactggtaatgaagtcaccagatggtgactttgaaggattatatatgtcaagtgagaaaaaaaaatgatggctgaactccttacctttgcaaaaaaatagaccttcacaatctgtcagttagctggaagaagtgaatactaaagaagtttctaacattgataacaaggctctacttgttcattcattgaccaatggtgaaatggccaaaatgattctgaataaggtaattgtggtaatagtgatattgttaacactgcagaaaaagtgcctgtagatgacagggtaaaattgtgtgatgggcttattgaagaactagagcagcaggcattcataacagaacaactcatgtctatttataaaatcaaagagagactgctaaaataagagctattgttgagatgggggccaagagggcccattagaagcagctgcagtccacagcacagagaggaatgaaagcatcaagtgaattcagcaccttcaactgaaatatccaggttctcgcattgggactgactaaacaatcaccctgatccagagagaataaagaaaagcagagtgggtcagtggcccacccaggagcctcacggagccaaaggaacccccacccccagcaaagggaagcagtgaccgattgtgcgacccgcccaggaccatgcttccccacagatctttgcaacttgtggatcaggagatcccctcatgagcccacgctaccagggccttgggtccaataaacagagctgtgcggagtctcagcacaggtacacacagagacaagagttttacatactccggccccggaatttccagcaaggtgacagatccctttgtacattcccctaggaagggggctgaatccagggagccaagcagcattgttctgcaggccccacttccacagcacctcacaagttaagtcccactgtcttggaattccagccagccaatggcaacacaatgagtctgcctgaaacaggatggagttccctgtgggaggggtggctaccatttctgtggtttggtcaactgcacattccagcctgccagctccagagagtctgggtggtccagatgaggaagggatacccccaacacagcacagctgctgtgccagattgtgcccaaactgctttaaagtgggaccctgatccattcctcctcactgggcagggcctccctgtggggggccttcaatcactccagctgggcttatatggacagagagctctgatctctccctgggatgcagctcccagaaggaggggaggctgccatctctgtggttcagtcaactgagctgttccagcttgcctactctagagagtctgggcagtccagatgaggaagggtcctccccaacagagcacacctgctctacagccagactgcttctttaagcgggtccctaattctgttcctcctgactgggtgagacctttcaataagggtctccagaaacctctgaaacgagcatttgggccagcagcaggtcagtacccaccctgggatggagtgtccagaggaaggagcaggctgccatctttgctgcttcacagccttcactgttgatacctccaagtacaggaaaagcagaggcaactaaggtctggagcagacccccaacaaaccacagcagccctgtggttgctaagagtcagtagcctgaccgtgaaaagaaaaaaacaacaacaacatcaacaaaaaagaccccacagaaaccttttcagaagtcagcagcctcaaaggtcgaaggtagataagcccacaaagatgagaaagaatcaatgcaaaaacgctgaaactcaaaaagacagagtgcctcttctccaggtgaatgcaacacctctccagcaaggcctcggaactgcgatgaggctgagatggctgagttgacagaagtaggcttcagaaggtgggaaataacaaacttcgctgagataaaggagcatgtcgtaacccaatgcaaagaagctaagaatcatgataaaacaatacaggagctgataaccagaatagccagtttagagaggaacataactgacttgatggagctgaaaaatataacatgagaacttcacagtgcaatcacaagtatcaacagcagaagagaccaagtggaggaaaggatctcagaccttgaagactatctttctgaaataagacaggcagacaagaatagagaaaaaagaatgaaaaggaatgaacaaaacctccaagaaatgtgggattatgtaaagagatggaacctgcaactgactggggtacctgaaggagacagggagaacagaaccaagttggaaaacatactttagtatatcatccagtagaattaccccaacctatcaagacaggccaacattcaaattcaggaaatggagagaaccccagtaggatactccatgagaagattatccaagacacatacttatcagattccaggtcaaaatgaaagaataagtgttaagggcagccagagagaaaggccaggtcacctacaaaggtaagcccatgagactaacagcagacttctcagcagaaaccctacaagccagaagagattgggggccaatatttaaaattcttaaagaaaagaatttccaacccagaatttcattttcagccaaactaaccttcataaacaaaagagaaataagatccttttcagacaagcaaatgttgagggaattcatcaataccaggcctaccatgcaaaagctcctgaaggaagcactaaatgtggaaaggaaaaaccattaccagccactatgaaaacacactgaagtacacagaccagtgacagtatgaagcaaccacataaacaagtctgcaaaataaccagttagcatcatgatgacagaatcaaattcacacataacaatactagccttaaatgtaaatgggctaaatgcaccaattgaaagacacaaaatggcaaactggataaagagccaacccccattggtgtgctgtcttcaagagacccatctcacatgcaaagacacacttaggctcaaaataaagagatggaggaaaatttaccaagcaaatggaaaacagaaaaaagcaagggttgcaatcctagttctgacaaaacagactttacaccagcaaagatcaaaaaaagacaaagaagggcattatataatggtaaagggttcaattcaacaagaagagttaactcagctctggatcaagcggacctgatagatatctacagaactctccaccaaaaaacaacagaatattcattcttcttctcaccctacagcacttactcaaaacttgttcacataatcagaagtaaaacactccttagcaaatgcaaaagaaccgaaatcataagaaaccatctctcagacaacggtgcaaccaaattagaactcaagattaagaaattcactcaaaaccacccaagtacatagaaattgaacagcctgctcctgaattacttgtggataaataacgaaattaaggcagaagtcaagaagttgtatgaaattaatgagaacaaagagacagtgtaccagaatctctgggacacagctaaagcagtgttaagagggaaatttgtagcactaaatgcccagatcaataagctagaaagatctcaaggtatcaacctaacatcacaactaaaagaactagaaaaccagaccaaacaaaccccaaggcaagaaatagccaagatcagagtggaactgaaggagatacagacacacacacacacacacaaacccttcaaaaaatcaacaaattcaggagctgtttttttgaaaaaaattaataagatgatctactagctagactaatagaaaagagagaagaatcaaataacacaatcagaaatgataagtgggatatcaccactgaccccacagaaatacatacaaccatcagagaatactatgaatacctctatgcacataaactagaaaatctagaaaaacatggataaactcctggacgcatacaccttcccaagactgaaccaagaagaaatcgaatcccttagtagaccaataatgagttctaaaattgaggtagtagtaaatagcctaccaaccacaaaaaacccaggaccagacagatttacagctgaattctgccagaggtacaaagagcgggtaggtaccatttctactgaaactgttccaaaaaattgaaaaagagggactcctccctaactgattgtgtgagaccagcatcatcctgataccaaaacctggcagagatacaacaaaaaaagaaaacttcaggccaatatccatggtgaacatagatacaaaaatccttagtaaaatactggcagactgaatctagcagcatatcaaaaagcttatccaccaccatcaagtgggtttcatccccaggatgcaaggttggttcaacattcgcaaatcaataaacgtgattcatcacataaacagaactacagacaaaaaccacatgatctcaatagatgcagaaaaggcctttgataaaattcgacatcgcttcatggtaaaagctctcaataaactactgcccaaagtaatttatagattcaatgctatccccgttagactaccattgacattcttcacagaattggaaaaaactattttaaaattcatatggaattgaaaaagagccgaatagccaagacagtcctaagcaaaaagatcaaagctagaggcatcatgctacctgacttcaaactgtgttacagggctaccataaccaaaacagcatggcactggtacaaaaagcagacacatagaccaatggaattgaatggagaactcagaaattaagactgcacacctacaacaatctgatcttcaacaaacctgacaaaagcaagcaatggggaaaggattccctatttaataaacggtgctgggagaactggctagtcatatgcagaaaattgaaactggaccccttctttgtaccttatacaaaaattaactcgagatggattaaagacttaaatgtaaaacccaaaactataaaaaccctagaagaaaatctaggcaataccattcaggacataggcactggcaaagatttcatgacaaaaacaccaaaagcaatagcaatgaaagcaaaaattgacaaatgggatgcaatcaaactaaagagcttctgcacagcaaaagaaactatcatcagagtgaacagacaacctacaaaatgggagaaaatgtttacaatctatcttcctgacaaaggtctaatatccagagtctataaggaacctaaacaaatttacaagacaaaaaaaaaaacaaccccattaaaaagtggacaaaggacatgaacagactcttctcaaaagaagacgtacatgtggttaacaaacgtgaaaaaaagctcaacatcactgatcattagaaaaatgcaaatcaaaaccacagtgagataccatctcatgccagtcagaatggtgattattaaaaagtcaaaaaaacaacagatgctggcaaggttgcagagaaaaaagaatgcttttccaccattggtgggagtgcaaattagttcaaccattgtggagaacagtgtggtgctttctcaaagatctagaggcagaaataccatttgacccagcaatcccattattgggtatatacccaaaggaatataaatcgtcctcttataaagatacatgcatgtgtttgttcattgcagcactattcacaatagcaaagacatggaatcaacccaaatgcccaccagtgatagattgaataaagaaaatgtcatacatacacaccatggaatactgtgcagccataaaaaggaacgagatcatgtcctttgcagggacatggatggagctggaggctgttatccttggcaaactaatgtaggaacagaaagccaagtaccacgtggcctcacttataagtgggagctgaacaatgggaacacatggatacttggtggggaactacacacactggggcctgttgggggatgagggagagcatcactggaagaatagctaatgggcgctgggcttaatacctaggtgattggatgatctgtgcagcaaaccaccatggtacacattaacctgtctaacaaacctacacatcctacacatgtacccctgagcttaaaagttgaaggaaaaaaagccattgttaatgaggcagatgactctagaggcaacattttgcaaaaccatccaacagaatgcctcctcatccctaaaggacccagttcctggtccctcaattgcttttcatgtttcttctcacctgaaaacaaaaaatacagtggacagttacctttccatcaaaacacagcatggtagagacggaaagcctgccgttgtctgttgctgtctaacagctgagacaggtattctggtgatgctactgtgcttcttagttacctgaacacattattttttttaactgtattaatggcatatcatatttttaactgttaagtacatgtgtaagtgtaagaaaatgattgcttatcagtagtacatgaattcagagtcaggaataatggtgatgccaaacaaccacagattgtccacatgggtggctgagttagtgacacctttgctttccagtggctcctcgtatataaactatttcatgcacagaattattacaaatattggataaaatgacctctaggctatgagcgtaaggtgcatatgaaagataaatgaatttcatatttagacttggttctcatccccaagatatttcattatatatttgcaaatattccaaaatctgaaaaaaaccaaaacacttctggtctcaagcatttcagtgaagggatattcaatctgtatggctaaattctaccaaaagaagagattacttgtattacacaaatagctaaaggagatagaaaaagattaaatactacccaactaacttaatgatgttagtataaccttgattctaaaagtgaaaagggtagtacaagaaaaggaaaagggaaatccattttatttataaacacagatggaaaaaatgttaataacctaattaaatccaacattgcattgcatttgtttgtttgtttgtttgtttgtttagacactgtcactctgtcacccaggctgagcgcagtggcatgatcttggctctctgcaacctctgtctcccaggttcaagcgattctcctgccccagcctcttgagtagctgggactacaggcacgtgccaccacgcctggctaatatttttgtattttttagtaaagacagggtttcaccatgttggccaggctggtcttgaactcctggcctcaggtgatcagccagctttggcctcccaaagtgctgggattacaggtgtgagccaccacacccggccccaagattgcatttaaaagtactgaataaacaggtttttatctagtaattgacttgaaaacttaataagagtttaaagaaaatacctttagactagttccatcacagttctaatttttaaaacatcttcggctgggcatggtggttcacgcctgtaatcccaacactttaggaggctgaggcaggtggatcacctgagtcaggagttcgagaccagcctggccaacatggtgaaacaccatctctactaaaattccaaaaaattagctgggcgtggtggcacacacctgtaatcccagctagtctggaggctgaggcaggagaatcacttgaacctgggaggtggaggttgtggtgagctgagatcacaccactgcactccagcctgaatgacagagagagactttgtctcaaaataaataaataagataaaaataaaacatcttcatcaacctctggtaatctacagaaaacttaatgttatcgtgaaatcaaatacaatagcacttataggatatgtctcacaaaacagatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattggtgagtcggtataagtatctatgtgtaatatgtacatgctgaagatacaatgcaatgaaatgttgtctgtatcacctcccgttcacaaagatgcactggaaatgggagtaaggagtaggtgataaaccggcctgccttttgtgccaccagatatcacaaacaggctttctcagtggatctcaccagagattttttttaaatatccaacatttaaaaaaaaaattactacaaaagagaaattttagagcatactaataattaacaagataagtaatattgttgatatttttcactgggtggcaccctcagtcacaccatccaatgaagtctttctaatccatatagttgtctttcagaatgttctctctgtggctctcttaagcaccacaattctagaacatttgaaaaacacatatagtggtggtttactttagtagtttggcagtgtgttggactattaaaaaaatggataaacagataatcacaataaaaagacaaggagtcactgaatatagcaaatttggcatggattttttttgagtaactgtgatgagacatattttgcctttgactgtattattgacagagatgataacggtacttttttatttgtttgcttataccaagaagtatgtgataaatgtttgttgtatctagtagaaaattacaaaatgagatgatagaaagataatgctaaaattaaacatgcttcataatgctctgtaatcggtcgtttctaacaactcaaattcggtttttcacatttcacaaaaattataaacaatattttgcctgttttaatggattagatttttaaatatgcacatatatagccccagagatattaaaggctgcagttatgttttagtaatgtcattttcaaagccagccagcagcacatttgacaggaggttttatgcaatggcttcatgctcattctaagtagagataagcctggaacattctcagtgaatctgaaagagacctcgccataggcactctcagaattattaaaatgctctccccatggtcttttgtgctgaacttcaatggcagtgtattatcctttcccttttttgttcttttcccaaatgaaaaattgactccatctttaaaacaccaccaaggtaaataacagcactatacacattaagcatgtaccttcagggcagaaatgctgttggcctcaggttctgcagtcccctaaatgtcgggaaggtatagctgtagccacatggtttatattagaggattctgttgataaacttcactttaaggataacagagaaaagaggcttcagcaagataaatgctattttaaaattccagattggcttcatgtcaaatatataagtaaaaggacttctcttaattcagaattttaatagcaagaaataagtgaaagtcagcttgaacacatgctttgtgtttctcatgagagctttctaagccaggtaactttccctgttctcacctgcaataaagttgttatgttttacttacatctagagaaataaacttgaaacttacattttctcaaaaacttaaagacaggcaatggagcatggtaacagaataacagatttcacacagaaaacatgggtttgtatctcacagtgctattttgccagtcaaggcctttcattctgtagtttaacttactaaaaggagggagacttctgataatagcatccactgagagcttaccacatgcgcagtactgcaatacaattaacatgcattgactcgttccctcagaacaaccctgtgacgtagacattattatcccacattgcaacttagggaaaaacaaatagagacattaagtagcttgctcaggccatagagctgtaaagtagcagaaccaggactgaaactacagcactctggctttagatgaacgctgagctctccacagtatgctgtgtgcttgaaccacagtcaaaaggaaagtgttcaggcctgtgagcaaaaggtatgtcttacctgtcaatcaggtccaggtattatgatgacatatcattcagtgccttttattgagtacttgtccatttcaggaataatgatcaacgctgtaaacacagaaataagtaagataattggcttcaaggaacccacagcctcatctgaagttgagacagtcacacaattcattactatcagtatcatagagagagaaatgtgcttcaagatgccacatgaacacagatgaaggcacacaataaaattaggcagtatttgttaattgctgataaacacaacacgtattcagaagctgtggggatcagcaaaagcaaaagatgcatgctctctatcttttaagaagagtctaaagtggttagaggaaaaagaggaaaacatacatgaaaataactattacaaaaagtttaagcacaagttcacattgaccaaaatatgtaccataggacaagttccagtggatttatcaaatattaacaccttttaagaattttcaatagatttttgggtacaggtggtgttcagttacatgcaaaagttatttagtgattatttctgaaatgttggtgcacatgtcacctgagcagtgtacactgtacccaatgtgtagtcttttatccctcaccccttcctacctttcccccaagtccccaaaatccattatataactcttgttcctttgcatcctcatagcttagctctcacttataagtgagaacatccaatatttggttttccattcctgagttatttcacttagaatagtggtctctaattccatccaatttgccgcaaaggccattatgtctttctttttaatggctgagtagtattccatggtgtgtatataccacatttcctgtatccactcgttggttgatgggcatttaggttggctccatattttgcaattgtgaattgtgctgctataaacatgcatgtacaagtgtctttttcatataatgacttcttttcctttgggtagatacccagtagtggtattgctggatcaaatggtagttctacttttagttctttaaggaatctctatactgttttccatagtggttgtactagtttacattcccaccagcagtgtagaagtgttcccttttcaccatatccatgccaacatctattaaattttgatttttaaattatggtcattcttgcaggagtaaggtggtatctcattgtgcttttaatttgcatttccatgataattagtgatgttgagcattttttcatatgtatgaggcgtatcaaaaaatttttcttatgccatttgtatatcttcttttgagaattgtctattcatgtccttagcccactttttgatggaattatttggcttttttcttgcttttttgagatccttgtagattctggatattagtcctttgtcgaatgcagtttgtgaatattttctcccactctgtggggtgtctgtttactctgctgattatttattttgctgtgcagaagctttttagtttaattggatcccatttacttatttttggttttgttgcatttgcttttgggttcttggtcatgaactctttgcctaagccaatgtctagaagagtttttccagtgttatcttctagaatttttatggtttcaggtctcagatttaatctttgatccatcttgagttgatttttgtataaagtgagagatgaggatccagctttattcttttacatgtggcttgccaattatcccagcatcatttgttgaatatgttgaatagggtggcctttccccacttaatgtttttgtttgctttgtcaaagatcagttggctgtaagtattttgctttatttctgggttttctattctattccattggtctatgtatcttttttattttctatagcctaattgtgaaagtggcatgtctatttttttaatacctttcttgttagtacaaaaaaaaaaagccaaactcaaaacttataaccaagaagttatatacatagtagaaaagtacatttaaaatagtttatttctctttttaaaatagtaggccaggcgcagtggctcacgcctgtaatcccagcagtttgggaggctgaggcgggcagatcacctgaggtcaggagttcgagaccagcctcaacatggagaaaccccatctctactgaaaaaaaaaatatacaaaaaattagccgggcatggtggtgcgtacctgtaatcctagctactcgggaggctgaggcaggagaattgcttgaacctgggaggcggaggttgcagtgagatgagatcgtgccattgcactccagcctgggcaacaagagcgaaactccatctccaaaaaaaaaaaaaaaacaagagtagtattacttatgtattggaaaaaccttgggaagcaaagattattcgtttattatttatttactatttaattttactttttaaaatagagacggggtctcattatattttccagactggtctcaaactcctgggctcaagtgatcctcctgtctcggccttctaaagtgctgggattacagacatgagctaccttgcctggccttaaaaatgattttagcttggccaggcgcggtagctcacgcttctaatcccagcactttgggaggcccaggcgggcggatcacaaggtcaggagatcaagatcatcctggctaacaaggtgaaaccccgtctctactaaaaatacaaaaaaattagcccggcgtggtggcaggcacctgtaatcccagctactcgggaggctgaggcaggagaatggcatgaacccgggaggcggagcttgcagagagccgagatcgcgccactgcactccagcctgggtgacagagcaagactctgtttcaaaaaaaaaaaaagattttagttcactattaatattgttgtagaaaaacagctcctattaacatttttcctcaggtttcttacgtgggttttttggtaatagtatgtattctttttttttttttttttgagacagggtctctctctgttgcccaggctggagaatagtggcgtgatctctgcccactgccacttctgcctcccaagctcaagcaattcttgtgcctcagcctcctgagtagcagggactacaggcacaggcatgtgccactacgcccagctaatttttgtatttttaatagagacagggtttcaccatgttggccaggctggtcctgaactcctgaccttaagtgatccacccacctcagcctcccaaagtgctgggattacaggtgtgagccaccgaacctggccaataatattatgtattatttatataaatatactgatttttcacatacactattaacataattattttctttttattatacatgcttcatagataggttttgtgatgaataatagtctttgcaggtgtgttttagttaatcatagtcctattataaggatattcaggctttttagtttttcagttacatgtagtactgtcataaagatctctgtagaaagcttttttcattttcaaagtgatatttttaagatgtattcctagacatggaattaccgaattgaagaagatgaaaatgttttaagttcttgacatttctgccaaattacactctgaaaagattttcaatatactgagcacagagtatcctcttttcaaatatttttaaaaatttgttattagggaaattacatctttccatgtgttgttaaccagctgtgtttctttttaagaaagttcttggccgggcgcagtgtctcacgcctgtaatcccagcactttgggaggccgaggctggcggatcacgaggtcaggagatcgagaccatcctggctaacacggtgaaactccgtctctactgaaaataaaaaaaaataaaaaaataaaaaaattagccaggcgtggtggcgggtgcctgtagtcccaactactcgggaggctgaggcaagagaatggcgtgaacccgggaggcagagcttgcagtgagccaagatggtgccactgcactccagcctgggcaacagagcaagattccgtctcaaaaaaagaaaaagaatgttcttcacccaaaatatattgggatcttgggattaagaaacaatctttttaatcaagtgttttgttttttttttcattttgtagccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcgtaagtccttcagttctgcccgtcagctgcctccctttcccctcaccagcctgtgtgtaaataatccggttgtgaatgtgcggtcatgaccatcatgtgcaacatggcagcaaacaggatgtaaagccaggccagatcatctggtcagccctcagtgatcagccaaggaaagaactgaatccaccacaccacatgcttgtcccttctcttctaaagtatcaacagagggtcagactccagaacttctcttggttgtgcattccagcattgtattggcctaatgaattagtttcccaaagccacagctgtgatttaataacagcagaatgtaggcaaagcaggagtcctctgaataggcaagtgcccttttcctcacttccatcttaggaggggatgtcacaccaggtggtttagaagaagcagtgatgggctgggcacagtggctcatgcctgtaatcccagcactttgggaggcccaagcagatggatcacttgaggtcagaagttcgagaccagcctggccgacatggcaaaaccctgtctctagtaaaaatacaaaaattagctgggtgtggtggtgcgtgtctgtaattctagctacttggaagactgaggtttgagaatcacttgagcccaggaggcagaggttgcaatgagccgtgatcgtgccactgcactccagcctggttgacagagtgagattctgtctcaaaaaagaaaaaaaaaaaaaagcagcagcagcagtgatgacacaggagaagcagtcagggggtagcctgatgagaaagtcttgctttcacagttttttctctgtcttatctcttccgcatcttattcccttttgataatagaaggtccaatgcatgtcattccacatctgtgttcctgttttcaacttttccctattaaaaaaaaaaaggaggagaatgaaaaaccttgtataaccaaattatttactattagttaatttagagtgatgagattggaaaggggcatgaagattatctttttctctttatacaattctgaattgtttgacttattacaaatagatatgttacttttgtaaataaccaaacaagaaaagaaatggctatgatagcctagttttaatgagttacaaagcagatgacttcacctgtactgaagaaatgtgtgcttggctgtacagggatgtacatgttacctctactacagccccacccaatttaggccccttctgctctgcagccccactctgcagtgcacacaaggaaggaagactgcatttagagtcagattaaaacaagccctgagcactggctggagtgtcagttccccaagaatattcacccatccccagaggctggcagatagtattagagttgctcagtctttgtggaaagagtgaattactgttgcaaaacagaaatgacttttcttccaaatagtcatccaaacttccaagcaaatcaccgtaagatagtatgatgctcattattcgagtattcagacataacaattgttgcacatggcaatatgcaattacttttggaaacttctggtagcttagcaagataaggggtgagctactctgttacttgtttatttccgagtgtccacttgtgagtcctcacatgccctgtctcaaaaacaaaagttaacaaggagcttcttgccagtggtgtctgctgctctttccttactagagtgttatatatctgacctaccgtttgtggactagcctgggaactaattatcatttataacattacatctttgaataaaagagtaccaagtatcaaacaaccaacttataaacaaatattatgaatataacagccttgcaatttaataactttttacagttttgaatattagagacccatcactttgatggatttatttgcccttcagttattaccaagtgattctgaaaagtccaggggttactaataagtgctgatttgactgctcctccctgccaggctagtatggaggagaaagacttttcactcttgaaggaacacaccatgctcttctccgtacatctttgcactctctggttttggttttatgtttacaaatgcctgtgatatggggggaaaaagaatctttgtttaagaaaaaaaatcagccatgtgctaatcaggtgatagaagagaaagagatctaaggcggcactgatctaagccagaggtgggacatttaggataaagttaaaagcagaacatgggctgggcacagtggctcacatctgtaatcccagcactatgagaggccgaggcaggcggatcatgaagtcaggagatcgagaccaccctggctaacacagtgaaaccccatctctactaaaaatacaaaaaattagcctggcgtggtggcatgcgcctgtagtcccagctacttcggaggctgaggcaggagaatcgcttgaacctgggagacggaggttgcagtgagccgagatcgctccactgcactccagcctcaaaaaaaaaaaaaaaaaaaaaaaagcagaatatgaaagactaagtacagttcaaatgcagtggtgactttgatttatagcaagaacaagttttccatttgctctatatggaaacgtaaagagattttgaaactgctttaacaagggctgccacaagaatttcttttattgacttgaaaaattactcctacattcatgatgtcacaaaatcgtatgtatttttcagtcatggtttcatgcatttttattctataaacatacattataagtatacaaatatagattatattctataaataattcaaggatttataacatatctaaagatacattccttataaatatcagggatttttctgtataaattacttgtttgtttattattattattattattttgagatggagtctagctttgtcaccaggctggagtgcagtggcgtgatctcggctcactgcaacctccgcctcccgggttcaagtgattctcctgcctcagcctcccgagtagctgggattacaggcacacactgccacgcccagctagattttgtatttttagtacagacggggtttcaccatgttggccaggatggtctgacctcgtgatctacccacctcagcctcccaaaagtgctgggattacaggcgtgagccaccccacctggcctataaactatttatttattagcactgtgctagtggtttaaaaagaaaacaaaaacagatatggtccccgccttgcagagcttgctgcctaattgtctggtcaccgagtggcctgacttcatggatggctgctgcggagtagcagttgaggagcgaagaggtcttacagaacacccacaggccgcatccagaagcctcactcattctccctgatctcagaatgtccttttcttttcagctatgcctccaacaaagcaagtaaagctgcttccgtccttctgtattctctgtgggcacacacggaactgcatcatgcctacaagaaggtaagaacatgaacaaggaatgtgtcatagttaacagagccaggtaataatggcccacttgacttgaccctgggaagaaatcgctaaaaaactgcattttcttgtgtgccagttttgttacctttcacgtttctgtttgcttattccaaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccaccagtagataccggccacaggctcgacaaatagtggtctttgttattagggcttatggtacatggcttcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacagagaaaggcaactgtgatgataaaatttaacgttcccccaaacactgagtcaatgagatttttctcaggagatactttacctataacaacgccgttaaatccaaatctcttctaaacgatggcattctatgtaatgcctttcctggacttttttggccactgccctggactagtgaaagaatggactctatctttatctgcaagaggaactaaggccttctatcagactgcctggccagcctggggcactgaaaatacggctcatgttaatgagttacattatcagccagcccagccttgcccaccatttaagaaatatcacagagccactagatctcatatgatcttcttcaagccattattttaactcaagaaaactctagagaagaaaagtgaagaagtcatgttgaagaagatgtaagaatgtgtcaagaccatccagaaatgatatgagaaatactgatattttaaatggttgacatcatccagcgaaatgaatctacattaaatgttgttttaactgcgctatgattaaaaccattcatatagagttagtctttacaactactattctgttatttttttttttaatctgacaacatttgtcctaagtaagataagcaaaaaaattcttcaactccttttggcaagaaaactgtaacagaaaataaattttgaatgtgtacttaagtctttattatatttgaaacaattttttttcaattttaaaagctgaatgaagacaacttaggttgctaacctagttcaaaatgaaattatttagataccaatttttaaaatactggagagaatttatatgtctttttccagagttctgatgataagcatttggagtgcatttattcctccagataataaatgtgtgttcagaactttttgtgttttttaaggcattaataaagccttcgataatattaaatacaaaatgagaccaaagtagtgttgcttgcattggcgtctgtgtatatctggtttatttgtgtatcttggaatatatagtatgattgacataaaatttgaggatttaaccttataaacttcaattactaagggtttgatactttgtaattagttatattttccccttaattaaaatcctaaatttttaccaagagacatttcctgtgagaatggtgggactagatggtgacctgaccataaaaatgaagacacatgcagacgtgttagctgcggttagattttagtatattattgggtgattctgtgactgtgaaaagacagactacgtttgatttccatgtgctgctttgttcactctgtttgcaaacacctcactactttacaatttgtgaacacctctcagggaggttcttctgtgaatgaacagttttgatcacaggtctatacataaatgtgtttgttttcctatgtgtc
